United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 6

SEQ ID NO: 68518 - DNA, 20 bp, Artificial Sequence
  Description of Artificial Sequence: Synthetic oligonucleotide
  Target: ATXN1; (-) strand; PAM type: NRG; PAM sequence: AGG
gttggctttgccttaattac

SEQ ID NO: 68519 - DNA, 20 bp, Artificial Sequence
  Description of Artificial Sequence: Synthetic oligonucleotide
  Target: ATXN1; (-) strand; PAM type: NRG; PAM sequence: CAG
ggttggctttgccttaatta

SEQ ID NO: 68520 - DNA, 20 bp, Artificial Sequence
  Description of Artificial Sequence: Synthetic oligonucleotide
  Target: ATXN1; (-) strand; PAM type: NRG; PAM sequence: TGG
tgtgatcctgaaagataggt

SEQ ID NO: 68521 - DNA, 20 bp, Artificial Sequence
  Description of Artificial Sequence: Synthetic oligonucleotide
  Target: ATXN1; (-) strand; PAM type: NRG; PAM sequence: AGG
tcactgtgatcctgaaagat

SEQ ID NO: 68522 - DNA, 20 bp, Artificial Sequence
  Description of Artificial Sequence: Synthetic oligonucleotide
  Target: ATXN1; (-) strand; PAM type: NRG; PAM sequence: TAG
ttcactgtgatcctgaaaga

SEQ ID NO: 68523 - DNA, 20 bp, Artificial Sequence
  Description of Artificial Sequence: Synthetic oligonucleotide
  Target: ATXN1; (-) strand; PAM type: NRG; PAM sequence: AAG
agttttcactgtgatcctga

SEQ ID NO: 68524 - DNA, 20 bp, Artificial Sequence
  Description of Artificial Sequence: Synthetic oligonucleotide
  Target: ATXN1; (-) strand; PAM type: NRG; PAM sequence: GAG
tactcataactggagattgt

SEQ ID NO: 68525 - DNA, 20 bp, Artificial Sequence
  Description of Artificial Sequence: Synthetic oligonucleotide
  Target: ATXN1; (-) strand; PAM type: NRG; PAM sequence: GAG
acttctcttactcataactg

SEQ ID NO: 68526 - DNA, 20 bp, Artificial Sequence
  Description of Artificial Sequence: Synthetic oligonucleotide
  Target: ATXN1; (-) strand; PAM type: NRG; PAM sequence: TGG
agacttctcttactcataac

SEQ ID NO: 68527 - DNA, 20 bp, Artificial Sequence
  Description of Artificial Sequence: Synthetic oligonucleotide
  Target: ATXN1; (-) strand; PAM type: NRG; PAM sequence: AAG
agaatggttagggaaagaag

SEQ ID NO: 68528 - DNA, 20 bp, Artificial Sequence
  Description of Artificial Sequence: Synthetic oligonucleotide
  Target: ATXN1; (-) strand; PAM type: NRG; PAM sequence: AAG
aggagaatggttagggaaag

SEQ ID NO: 68529 - DNA, 20 bp, Artificial Sequence
  Description of Artificial Sequence: Synthetic oligonucleotide
  Target: ATXN1; (-) strand; PAM type: NRG; PAM sequence: AAG
cgaaggagaatggttaggga

SEQ ID NO: 68530 - DNA, 20 bp, Artificial Sequence
  Description of Artificial Sequence: Synthetic oligonucleotide
  Target: ATXN1; (-) strand; PAM type: NRG; PAM sequence: GGG
gtgacgaaggagaatggtta

SEQ ID NO: 68531 - DNA, 20 bp, Artificial Sequence
  Description of Artificial Sequence: Synthetic oligonucleotide
  Target: ATXN1; (-) strand; PAM type: NRG; PAM sequence: AGG
cgtgacgaaggagaatggtt

SEQ ID NO: 68532 - DNA, 20 bp, Artificial Sequence
  Description of Artificial Sequence: Synthetic oligonucleotide
  Target: ATXN1; (-) strand; PAM type: NRG; PAM sequence: TAG
gcgtgacgaaggagaatggt

SEQ ID NO: 68533 - DNA, 20 bp, Artificial Sequence
  Description of Artificial Sequence: Synthetic oligonucleotide
  Target: ATXN1; (-) strand; PAM type: NRG; PAM sequence: TGG
atatgcgtgacgaaggagaa

SEQ ID NO: 68534 - DNA, 20 bp, Artificial Sequence
  Description of Artificial Sequence: Synthetic oligonucleotide
  Target: ATXN1; (-) strand; PAM type: NRG; PAM sequence: GAG
cagttatatgcgtgacgaag

SEQ ID NO: 68535 - DNA, 20 bp, Artificial Sequence
  Description of Artificial Sequence: Synthetic oligonucleotide
  Target: ATXN1; (-) strand; PAM type: NRG; PAM sequence: AGG
agcagttatatgcgtgacga

SEQ ID NO: 68536 - DNA, 20 bp, Artificial Sequence
  Description of Artificial Sequence: Synthetic oligonucleotide
  Target: ATXN1; (-) strand; PAM type: NRG; PAM sequence: AAG
aagcagttatatgcgtgacg

SEQ ID NO: 68537 - DNA, 20 bp, Artificial Sequence
  Description of Artificial Sequence: Synthetic oligonucleotide
  Target: ATXN1; (-) strand; PAM type: NRG; PAM sequence: CAG
tcaaacgagtcacctaaaag

SEQ ID NO: 68538 - DNA, 20 bp, Artificial Sequence
  Description of Artificial Sequence: Synthetic oligonucleotide
  Target: ATXN1; (-) strand; PAM type: NRG; PAM sequence: AAG
atttcaaacgagtcacctaa

SEQ ID NO: 68539 - DNA, 20 bp, Artificial Sequence
  Description of Artificial Sequence: Synthetic oligonucleotide
  Target: ATXN1; (-) strand; PAM type: NRG; PAM sequence: GAG
gagcagcttacatttcaaac

SEQ ID NO: 68540 - DNA, 20 bp, Artificial Sequence
  Description of Artificial Sequence: Synthetic oligonucleotide
  Target: ATXN1; (-) strand; PAM type: NRG; PAM sequence: CAG
atgccgaattagactcagag

SEQ ID NO: 68541 - DNA, 20 bp, Artificial Sequence
  Description of Artificial Sequence: Synthetic oligonucleotide
  Target: ATXN1; (-) strand; PAM type: NRG; PAM sequence: GAG
gttatgccgaattagactca

SEQ ID NO: 68542 - DNA, 20 bp, Artificial Sequence
  Description of Artificial Sequence: Synthetic oligonucleotide
  Target: ATXN1; (-) strand; PAM type: NRG; PAM sequence: CAG
gtgttatgccgaattagact

SEQ ID NO: 68543 - DNA, 20 bp, Artificial Sequence
  Description of Artificial Sequence: Synthetic oligonucleotide
  Target: ATXN1; (-) strand; PAM type: NRG; PAM sequence: TAG
tgttaagtgttatgccgaat

SEQ ID NO: 68544 - DNA, 20 bp, Artificial Sequence
  Description of Artificial Sequence: Synthetic oligonucleotide
  Target: ATXN1; (-) strand; PAM type: NRG; PAM sequence: AAG
tgtgcatggtatatggtgtt

SEQ ID NO: 68545 - DNA, 20 bp, Artificial Sequence
  Description of Artificial Sequence: Synthetic oligonucleotide
  Target: ATXN1; (-) strand; PAM type: NRG; PAM sequence: TGG
cacctcttgtgcatggtata

SEQ ID NO: 68546 - DNA, 20 bp, Artificial Sequence
  Description of Artificial Sequence: Synthetic oligonucleotide
  Target: ATXN1; (-) strand; PAM type: NRG; PAM sequence: TGG
atgaagtcacctcttgtgca

SEQ ID NO: 68547 - DNA, 20 bp, Artificial Sequence
  Description of Artificial Sequence: Synthetic oligonucleotide
  Target: ATXN1; (-) strand; PAM type: NRG; PAM sequence: AAG
aaatagggacagtttccatg

SEQ ID NO: 68548 - DNA, 20 bp, Artificial Sequence
  Description of Artificial Sequence: Synthetic oligonucleotide
  Target: ATXN1; (-) strand; PAM type: NRG; PAM sequence: CAG
tagtgctatgcaaataggga

SEQ ID NO: 68549 - DNA, 20 bp, Artificial Sequence
  Description of Artificial Sequence: Synthetic oligonucleotide
  Target: ATXN1; (-) strand; PAM type: NRG; PAM sequence: GGG
ggaatagtgctatgcaaata

SEQ ID NO: 68550 - DNA, 20 bp, Artificial Sequence
  Description of Artificial Sequence: Synthetic oligonucleotide
  Target: ATXN1; (-) strand; PAM type: NRG; PAM sequence: AGG
gggaatagtgctatgcaaat

SEQ ID NO: 68551 - DNA, 20 bp, Artificial Sequence
  Description of Artificial Sequence: Synthetic oligonucleotide
  Target: ATXN1; (-) strand; PAM type: NRG; PAM sequence: TAG
agggaatagtgctatgcaaa

SEQ ID NO: 68552 - DNA, 20 bp, Artificial Sequence
  Description of Artificial Sequence: Synthetic oligonucleotide
  Target: ATXN1; (-) strand; PAM type: NRG; PAM sequence: TAG
tacctgagtaatccagggaa

SEQ ID NO: 68553 - DNA, 20 bp, Artificial Sequence
  Description of Artificial Sequence: Synthetic oligonucleotide
  Target: ATXN1; (-) strand; PAM type: NRG; PAM sequence: GGG
gatgatacctgagtaatcca

SEQ ID NO: 68554 - DNA, 20 bp, Artificial Sequence
  Description of Artificial Sequence: Synthetic oligonucleotide
  Target: ATXN1; (-) strand; PAM type: NRG; PAM sequence: AGG
ggatgatacctgagtaatcc

SEQ ID NO: 68555 - DNA, 20 bp, Artificial Sequence
  Description of Artificial Sequence: Synthetic oligonucleotide
  Target: ATXN1; (-) strand; PAM type: NRG; PAM sequence: CAG
aggatgatacctgagtaatc

SEQ ID NO: 68556 - DNA, 20 bp, Artificial Sequence
  Description of Artificial Sequence: Synthetic oligonucleotide
  Target: ATXN1; (-) strand; PAM type: NRG; PAM sequence: GAG
cttttgcaaggatgatacct

SEQ ID NO: 68557 - DNA, 20 bp, Artificial Sequence
  Description of Artificial Sequence: Synthetic oligonucleotide
  Target: ATXN1; (-) strand; PAM type: NRG; PAM sequence: AGG
gtatcagtttgacttttgca

SEQ ID NO: 68558 - DNA, 20 bp, Artificial Sequence
  Description of Artificial Sequence: Synthetic oligonucleotide
  Target: ATXN1; (-) strand; PAM type: NRG; PAM sequence: AAG
tgtatcagtttgacttttgc

SEQ ID NO: 68559 - DNA, 20 bp, Artificial Sequence
  Description of Artificial Sequence: Synthetic oligonucleotide
  Target: ATXN1; (-) strand; PAM type: NRG; PAM sequence: CAG
taggcaatgcaaccctgtat

SEQ ID NO: 68560 - DNA, 20 bp, Artificial Sequence
  Description of Artificial Sequence: Synthetic oligonucleotide
  Target: ATXN1; (-) strand; PAM type: NRG; PAM sequence: AGG
aacgttattctgcttgtagt

SEQ ID NO: 68561 - DNA, 20 bp, Artificial Sequence
  Description of Artificial Sequence: Synthetic oligonucleotide
  Target: ATXN1; (-) strand; PAM type: NRG; PAM sequence: TAG
caacgttattctgcttgtag

SEQ ID NO: 68562 - DNA, 20 bp, Artificial Sequence
  Description of Artificial Sequence: Synthetic oligonucleotide
  Target: ATXN1; (-) strand; PAM type: NRG; PAM sequence: TAG
actcaacgttattctgcttg

SEQ ID NO: 68563 - DNA, 20 bp, Artificial Sequence
  Description of Artificial Sequence: Synthetic oligonucleotide
  Target: ATXN1; (-) strand; PAM type: NRG; PAM sequence: GAG
gatatcattttctttcagct

SEQ ID NO: 68564 - DNA, 20 bp, Artificial Sequence
  Description of Artificial Sequence: Synthetic oligonucleotide
  Target: ATXN1; (-) strand; PAM type: NRG; PAM sequence: CAG
aaaacgatatcattttcttt

SEQ ID NO: 68565 - DNA, 20 bp, Artificial Sequence
  Description of Artificial Sequence: Synthetic oligonucleotide
  Target: ATXN1; (-) strand; PAM type: NRG; PAM sequence: AGG
ctgattcttaccaagaatat

SEQ ID NO: 68566 - DNA, 20 bp, Artificial Sequence
  Description of Artificial Sequence: Synthetic oligonucleotide
  Target: ATXN1; (-) strand; PAM type: NRG; PAM sequence: TAG
tctgattcttaccaagaata

SEQ ID NO: 68567 - DNA, 20 bp, Artificial Sequence
  Description of Artificial Sequence: Synthetic oligonucleotide
  Target: ATXN1; (-) strand; PAM type: NRG; PAM sequence: AAG
ggtatcttctgattcttacc

SEQ ID NO: 68568 - DNA, 20 bp, Artificial Sequence
  Description of Artificial Sequence: Synthetic oligonucleotide
  Target: ATXN1; (-) strand; PAM type: NRG; PAM sequence: AGG
ttatggttgggctggcttgg

SEQ ID NO: 68569 - DNA, 20 bp, Artificial Sequence
  Description of Artificial Sequence: Synthetic oligonucleotide
  Target: ATXN1; (-) strand; PAM type: NRG; PAM sequence: GAG
tttatggttgggctggcttg

SEQ ID NO: 68570 - DNA, 20 bp, Artificial Sequence
  Description of Artificial Sequence: Synthetic oligonucleotide
  Target: ATXN1; (-) strand; PAM type: NRG; PAM sequence: TGG
gatttatggttgggctggct

SEQ ID NO: 68571 - DNA, 20 bp, Artificial Sequence
  Description of Artificial Sequence: Synthetic oligonucleotide
  Target: ATXN1; (-) strand; PAM type: NRG; PAM sequence: TGG
cataggatttatggttgggc

SEQ ID NO: 68572 - DNA, 20 bp, Artificial Sequence
  Description of Artificial Sequence: Synthetic oligonucleotide
  Target: ATXN1; (-) strand; PAM type: NRG; PAM sequence: GGG
tggtcataggatttatggtt

SEQ ID NO: 68573 - DNA, 20 bp, Artificial Sequence
  Description of Artificial Sequence: Synthetic oligonucleotide
  Target: ATXN1; (-) strand; PAM type: NRG; PAM sequence: TGG
gtggtcataggatttatggt

SEQ ID NO: 68574 - DNA, 20 bp, Artificial Sequence
  Description of Artificial Sequence: Synthetic oligonucleotide
  Target: ATXN1; (-) strand; PAM type: NRG; PAM sequence: TGG
atatgtggtcataggattta

SEQ ID NO: 68575 - DNA, 20 bp, Artificial Sequence
  Description of Artificial Sequence: Synthetic oligonucleotide
  Target: ATXN1; (-) strand; PAM type: NRG; PAM sequence: AGG
tgtcatatatatgtggtcat

SEQ ID NO: 68576 - DNA, 20 bp, Artificial Sequence
  Description of Artificial Sequence: Synthetic oligonucleotide
  Target: ATXN1; (-) strand; PAM type: NRG; PAM sequence: TAG
gtgtcatatatatgtggtca

SEQ ID NO: 68577 - DNA, 20 bp, Artificial Sequence
  Description of Artificial Sequence: Synthetic oligonucleotide
  Target: ATXN1; (-) strand; PAM type: NRG; PAM sequence: TGG
tcatcagtgtcatatatatg

SEQ ID NO: 68578 - DNA, 20 bp, Artificial Sequence
  Description of Artificial Sequence: Synthetic oligonucleotide
  Target: ATXN1; (-) strand; PAM type: NRG; PAM sequence: CAG
tgtcacctgaaggtagtcat

SEQ ID NO: 68579 - DNA, 20 bp, Artificial Sequence
  Description of Artificial Sequence: Synthetic oligonucleotide
  Target: ATXN1; (-) strand; PAM type: NRG; PAM sequence: TAG
aacctgttgtcacctgaagg

SEQ ID NO: 68580 - DNA, 20 bp, Artificial Sequence
  Description of Artificial Sequence: Synthetic oligonucleotide
  Target: ATXN1; (-) strand; PAM type: NRG; PAM sequence: AGG
ggaaacctgttgtcacctga

SEQ ID NO: 68581 - DNA, 20 bp, Artificial Sequence
  Description of Artificial Sequence: Synthetic oligonucleotide
  Target: ATXN1; (-) strand; PAM type: NRG; PAM sequence: AAG
gggaaacctgttgtcacctg

SEQ ID NO: 68582 - DNA, 20 bp, Artificial Sequence
  Description of Artificial Sequence: Synthetic oligonucleotide
  Target: ATXN1; (-) strand; PAM type: NRG; PAM sequence: GGG
tactttattttggcagcatg

SEQ ID NO: 68583 - DNA, 20 bp, Artificial Sequence
  Description of Artificial Sequence: Synthetic oligonucleotide
  Target: ATXN1; (-) strand; PAM type: NRG; PAM sequence: GGG
ctactttattttggcagcat

SEQ ID NO: 68584 - DNA, 20 bp, Artificial Sequence
  Description of Artificial Sequence: Synthetic oligonucleotide
  Target: ATXN1; (-) strand; PAM type: NRG; PAM sequence: TGG
tctactttattttggcagca

SEQ ID NO: 68585 - DNA, 20 bp, Artificial Sequence
  Description of Artificial Sequence: Synthetic oligonucleotide
  Target: ATXN1; (-) strand; PAM type: NRG; PAM sequence: CAG
agccttctactttattttgg

SEQ ID NO: 68586 - DNA, 20 bp, Artificial Sequence
  Description of Artificial Sequence: Synthetic oligonucleotide
  Target: ATXN1; (-) strand; PAM type: NRG; PAM sequence: TGG
cccagccttctactttattt

SEQ ID NO: 68587 - DNA, 20 bp, Artificial Sequence
  Description of Artificial Sequence: Synthetic oligonucleotide
  Target: ATXN1; (-) strand; PAM type: NRG; PAM sequence: CAG
aaatgtactaaaccattacc

SEQ ID NO: 68588 - DNA, 20 bp, Artificial Sequence
  Description of Artificial Sequence: Synthetic oligonucleotide
  Target: ATXN1; (-) strand; PAM type: NRG; PAM sequence: AAG
tctcaataactgagttggaa

SEQ ID NO: 68589 - DNA, 20 bp, Artificial Sequence
  Description of Artificial Sequence: Synthetic oligonucleotide
  Target: ATXN1; (-) strand; PAM type: NRG; PAM sequence: TGG
gccattctcaataactgagt

SEQ ID NO: 68590 - DNA, 20 bp, Artificial Sequence
  Description of Artificial Sequence: Synthetic oligonucleotide
  Target: ATXN1; (-) strand; PAM type: NRG; PAM sequence: GAG
aatggccattctcaataact

SEQ ID NO: 68591 - DNA, 20 bp, Artificial Sequence
  Description of Artificial Sequence: Synthetic oligonucleotide
  Target: ATXN1; (-) strand; PAM type: NRG; PAM sequence: TGG
ggttatttgggaccctctaa

SEQ ID NO: 68592 - DNA, 20 bp, Artificial Sequence
  Description of Artificial Sequence: Synthetic oligonucleotide
  Target: ATXN1; (-) strand; PAM type: NRG; PAM sequence: GGG
tttggttaactgggttattt

SEQ ID NO: 68593 - DNA, 20 bp, Artificial Sequence
  Description of Artificial Sequence: Synthetic oligonucleotide
  Target: ATXN1; (-) strand; PAM type: NRG; PAM sequence: TGG
ttttggttaactgggttatt

SEQ ID NO: 68594 - DNA, 20 bp, Artificial Sequence
  Description of Artificial Sequence: Synthetic oligonucleotide
  Target: ATXN1; (-) strand; PAM type: NRG; PAM sequence: GGG
agaaaattttttggttaact

SEQ ID NO: 68595 - DNA, 20 bp, Artificial Sequence
  Description of Artificial Sequence: Synthetic oligonucleotide
  Target: ATXN1; (-) strand; PAM type: NRG; PAM sequence: TGG
cagaaaattttttggttaac

SEQ ID NO: 68596 - DNA, 20 bp, Artificial Sequence
  Description of Artificial Sequence: Synthetic oligonucleotide
  Target: ATXN1; (-) strand; PAM type: NRG; PAM sequence: TGG
ttaacggtcagaaaattttt

SEQ ID NO: 68597 - DNA, 20 bp, Artificial Sequence
  Description of Artificial Sequence: Synthetic oligonucleotide
  Target: ATXN1; (-) strand; PAM type: NRG; PAM sequence: CAG
tggttaaaactcttaacggt

SEQ ID NO: 68598 - DNA, 20 bp, Artificial Sequence
  Description of Artificial Sequence: Synthetic oligonucleotide
  Target: ATXN1; (-) strand; PAM type: NRG; PAM sequence: CGG
atattggttaaaactcttaa

SEQ ID NO: 68599 - DNA, 20 bp, Artificial Sequence
  Description of Artificial Sequence: Synthetic oligonucleotide
  Target: ATXN1; (-) strand; PAM type: NRG; PAM sequence: TGG
aactgcattttactgcatat

SEQ ID NO: 68600 - DNA, 20 bp, Artificial Sequence
  Description of Artificial Sequence: Synthetic oligonucleotide
  Target: ATXN1; (-) strand; PAM type: NRG; PAM sequence: GAG
gtcaaaaaatggttacagta

SEQ ID NO: 68601 - DNA, 20 bp, Artificial Sequence
  Description of Artificial Sequence: Synthetic oligonucleotide
  Target: ATXN1; (-) strand; PAM type: NRG; PAM sequence: TAG
ctgtcaaaaaatggttacag

SEQ ID NO: 68602 - DNA, 20 bp, Artificial Sequence
  Description of Artificial Sequence: Synthetic oligonucleotide
  Target: ATXN1; (-) strand; PAM type: NRG; PAM sequence: CAG
aaactgtcaaaaaatggtta

SEQ ID NO: 68603 - DNA, 20 bp, Artificial Sequence
  Description of Artificial Sequence: Synthetic oligonucleotide
  Target: ATXN1; (-) strand; PAM type: NRG; PAM sequence: TGG
ctaacaaaactgtcaaaaaa

SEQ ID NO: 68604 - DNA, 20 bp, Artificial Sequence
  Description of Artificial Sequence: Synthetic oligonucleotide
  Target: ATXN1; (-) strand; PAM type: NRG; PAM sequence: TGG
ttcaggtacacatttttatt

SEQ ID NO: 68605 - DNA, 20 bp, Artificial Sequence
  Description of Artificial Sequence: Synthetic oligonucleotide
  Target: ATXN1; (-) strand; PAM type: NRG; PAM sequence: AGG
ttcctctagtagtctttttc

SEQ ID NO: 68606 - DNA, 20 bp, Artificial Sequence
  Description of Artificial Sequence: Synthetic oligonucleotide
  Target: ATXN1; (-) strand; PAM type: NRG; PAM sequence: CAG
tttcctctagtagtcttttt

SEQ ID NO: 68607 - DNA, 20 bp, Artificial Sequence
  Description of Artificial Sequence: Synthetic oligonucleotide
  Target: ATXN1; (-) strand; PAM type: NRG; PAM sequence: TAG
tttatttttttttcctctag

SEQ ID NO: 68608 - DNA, 20 bp, Artificial Sequence
  Description of Artificial Sequence: Synthetic oligonucleotide
  Target: ATXN1; (-) strand; PAM type: NRG; PAM sequence: TAG
gaatttatttttttttcctc

SEQ ID NO: 68609 - DNA, 20 bp, Artificial Sequence
  Description of Artificial Sequence: Synthetic oligonucleotide
  Target: ATXN1; (-) strand; PAM type: NRG; PAM sequence: TAG
gcttcagctgtctaaatatc

SEQ ID NO: 68610 - DNA, 20 bp, Artificial Sequence
  Description of Artificial Sequence: Synthetic oligonucleotide
  Target: ATXN1; (-) strand; PAM type: NRG; PAM sequence: CAG
tctgcacacaccactggctt

SEQ ID NO: 68611 - DNA, 20 bp, Artificial Sequence
  Description of Artificial Sequence: Synthetic oligonucleotide
  Target: ATXN1; (-) strand; PAM type: NRG; PAM sequence: TGG
aacatttctgcacacaccac

SEQ ID NO: 68612 - DNA, 20 bp, Artificial Sequence
  Description of Artificial Sequence: Synthetic oligonucleotide
  Target: ATXN1; (-) strand; PAM type: NRG; PAM sequence: GGG
ctgcaaatgctacacatcag

SEQ ID NO: 68613 - DNA, 20 bp, Artificial Sequence
  Description of Artificial Sequence: Synthetic oligonucleotide
  Target: ATXN1; (-) strand; PAM type: NRG; PAM sequence: GGG
tctgcaaatgctacacatca

SEQ ID NO: 68614 - DNA, 20 bp, Artificial Sequence
  Description of Artificial Sequence: Synthetic oligonucleotide
  Target: ATXN1; (-) strand; PAM type: NRG; PAM sequence: AGG
gtctgcaaatgctacacatc

SEQ ID NO: 68615 - DNA, 20 bp, Artificial Sequence
  Description of Artificial Sequence: Synthetic oligonucleotide
  Target: ATXN1; (-) strand; PAM type: NRG; PAM sequence: CAG
agtctgcaaatgctacacat

SEQ ID NO: 68616 - DNA, 20 bp, Artificial Sequence
  Description of Artificial Sequence: Synthetic oligonucleotide
  Target: ATXN1; (-) strand; PAM type: NRG; PAM sequence: AAG
tgggagtgtttacactacag

SEQ ID NO: 68617 - DNA, 20 bp, Artificial Sequence
  Description of Artificial Sequence: Synthetic oligonucleotide
  Target: ATXN1; (-) strand; PAM type: NRG; PAM sequence: CAG
tggtgggagtgtttacacta

SEQ ID NO: 68618 - DNA, 20 bp, Artificial Sequence
  Description of Artificial Sequence: Synthetic oligonucleotide
  Target: ATXN1; (-) strand; PAM type: NRG; PAM sequence: GAG
cttgaaattggccatggtgg

SEQ ID NO: 68619 - DNA, 20 bp, Artificial Sequence
  Description of Artificial Sequence: Synthetic oligonucleotide
  Target: ATXN1; (-) strand; PAM type: NRG; PAM sequence: GGG
accttgaaattggccatggt

SEQ ID NO: 68620 - DNA, 20 bp, Artificial Sequence
  Description of Artificial Sequence: Synthetic oligonucleotide
  Target: ATXN1; (-) strand; PAM type: NRG; PAM sequence: TGG
taccttgaaattggccatgg

SEQ ID NO: 68621 - DNA, 20 bp, Artificial Sequence
  Description of Artificial Sequence: Synthetic oligonucleotide
  Target: ATXN1; (-) strand; PAM type: NRG; PAM sequence: TGG
tattaccttgaaattggcca

SEQ ID NO: 68622 - DNA, 20 bp, Artificial Sequence
  Description of Artificial Sequence: Synthetic oligonucleotide
  Target: ATXN1; (-) strand; PAM type: NRG; PAM sequence: TGG
tcatgttattaccttgaaat

SEQ ID NO: 68623 - DNA, 20 bp, Artificial Sequence
  Description of Artificial Sequence: Synthetic oligonucleotide
  Target: ATXN1; (-) strand; PAM type: NRG; PAM sequence: GAG
taaatgttcagaaatttggg

SEQ ID NO: 68624 - DNA, 20 bp, Artificial Sequence
  Description of Artificial Sequence: Synthetic oligonucleotide
  Target: ATXN1; (-) strand; PAM type: NRG; PAM sequence: GGG
gttaaatgttcagaaatttg

SEQ ID NO: 68625 - DNA, 20 bp, Artificial Sequence
  Description of Artificial Sequence: Synthetic oligonucleotide
  Target: ATXN1; (-) strand; PAM type: NRG; PAM sequence: GGG
tgttaaatgttcagaaattt

SEQ ID NO: 68626 - DNA, 20 bp, Artificial Sequence
  Description of Artificial Sequence: Synthetic oligonucleotide
  Target: ATXN1; (-) strand; PAM type: NRG; PAM sequence: TGG
gtgttaaatgttcagaaatt

SEQ ID NO: 68627 - DNA, 20 bp, Artificial Sequence
  Description of Artificial Sequence: Synthetic oligonucleotide
  Target: ATXN1; (-) strand; PAM type: NRG; PAM sequence: CAG
tgagccaagtgttaaatgtt

SEQ ID NO: 68628 - DNA, 20 bp, Artificial Sequence
  Description of Artificial Sequence: Synthetic oligonucleotide
  Target: ATXN1; (-) strand; PAM type: NRG; PAM sequence: AAG
agcttgcacttttatgagcc

SEQ ID NO: 68629 - DNA, 20 bp, Artificial Sequence
  Description of Artificial Sequence: Synthetic oligonucleotide
  Target: ATXN1; (-) strand; PAM type: NRG; PAM sequence: GAG
gagccagcttgcacttttat

SEQ ID NO: 68630 - DNA, 20 bp, Artificial Sequence
  Description of Artificial Sequence: Synthetic oligonucleotide
  Target: ATXN1; (-) strand; PAM type: NRG; PAM sequence: CAG
gaccagtggtgtagtggagc

SEQ ID NO: 68631 - DNA, 20 bp, Artificial Sequence
  Description of Artificial Sequence: Synthetic oligonucleotide
  Target: ATXN1; (-) strand; PAM type: NRG; PAM sequence: GAG
aatggaccagtggtgtagtg

SEQ ID NO: 68632 - DNA, 20 bp, Artificial Sequence
  Description of Artificial Sequence: Synthetic oligonucleotide
  Target: ATXN1; (-) strand; PAM type: NRG; PAM sequence: TGG
gaaatggaccagtggtgtag

SEQ ID NO: 68633 - DNA, 20 bp, Artificial Sequence
  Description of Artificial Sequence: Synthetic oligonucleotide
  Target: ATXN1; (-) strand; PAM type: NRG; PAM sequence: TAG
gaggaaatggaccagtggtg

SEQ ID NO: 68634 - DNA, 20 bp, Artificial Sequence
  Description of Artificial Sequence: Synthetic oligonucleotide
  Target: ATXN1; (-) strand; PAM type: NRG; PAM sequence: TGG
gggatgaggaaatggaccag

SEQ ID NO: 68635 - DNA, 20 bp, Artificial Sequence
  Description of Artificial Sequence: Synthetic oligonucleotide
  Target: ATXN1; (-) strand; PAM type: NRG; PAM sequence: CAG
ggtgggatgaggaaatggac

SEQ ID NO: 68636 - DNA, 20 bp, Artificial Sequence
  Description of Artificial Sequence: Synthetic oligonucleotide
  Target: ATXN1; (-) strand; PAM type: NRG; PAM sequence: TGG
atcttggtgggatgaggaaa

SEQ ID NO: 68637 - DNA, 20 bp, Artificial Sequence
  Description of Artificial Sequence: Synthetic oligonucleotide
  Target: ATXN1; (-) strand; PAM type: NRG; PAM sequence: AGG
ttactgatcttggtgggatg

SEQ ID NO: 68638 - DNA, 20 bp, Artificial Sequence
  Description of Artificial Sequence: Synthetic oligonucleotide
  Target: ATXN1; (-) strand; PAM type: NRG; PAM sequence: GAG
tttactgatcttggtgggat

SEQ ID NO: 68639 - DNA, 20 bp, Artificial Sequence
  Description of Artificial Sequence: Synthetic oligonucleotide
  Target: ATXN1; (-) strand; PAM type: NRG; PAM sequence: GGG
tagggtttactgatcttggt

SEQ ID NO: 68640 - DNA, 20 bp, Artificial Sequence
  Description of Artificial Sequence: Synthetic oligonucleotide
  Target: ATXN1; (-) strand; PAM type: NRG; PAM sequence: TGG
gtagggtttactgatcttgg

SEQ ID NO: 68641 - DNA, 20 bp, Artificial Sequence
  Description of Artificial Sequence: Synthetic oligonucleotide
  Target: ATXN1; (-) strand; PAM type: NRG; PAM sequence: TGG
gaagtagggtttactgatct

SEQ ID NO: 68642 - DNA, 20 bp, Artificial Sequence
  Description of Artificial Sequence: Synthetic oligonucleotide
  Target: ATXN1; (-) strand; PAM type: NRG; PAM sequence: GGG
tttattttaggtaggaagta

SEQ ID NO: 68643 - DNA, 20 bp, Artificial Sequence
  Description of Artificial Sequence: Synthetic oligonucleotide
  Target: ATXN1; (-) strand; PAM type: NRG; PAM sequence: AGG
gtttattttaggtaggaagt

SEQ ID NO: 68644 - DNA, 20 bp, Artificial Sequence
  Description of Artificial Sequence: Synthetic oligonucleotide
  Target: ATXN1; (-) strand; PAM type: NRG; PAM sequence: TAG
ggtttattttaggtaggaag

SEQ ID NO: 68645 - DNA, 20 bp, Artificial Sequence
  Description of Artificial Sequence: Synthetic oligonucleotide
  Target: ATXN1; (-) strand; PAM type: NRG; PAM sequence: AAG
ttgggtttattttaggtagg

SEQ ID NO: 68646 - DNA, 20 bp, Artificial Sequence
  Description of Artificial Sequence: Synthetic oligonucleotide
  Target: ATXN1; (-) strand; PAM type: NRG; PAM sequence: AGG
ttcttgggtttattttaggt

SEQ ID NO: 68647 - DNA, 20 bp, Artificial Sequence
  Description of Artificial Sequence: Synthetic oligonucleotide
  Target: ATXN1; (-) strand; PAM type: NRG; PAM sequence: TAG
cttcttgggtttattttagg

SEQ ID NO: 68648 - DNA, 20 bp, Artificial Sequence
  Description of Artificial Sequence: Synthetic oligonucleotide
  Target: ATXN1; (-) strand; PAM type: NRG; PAM sequence: AGG
ttgcttcttgggtttatttt

SEQ ID NO: 68649 - DNA, 20 bp, Artificial Sequence
  Description of Artificial Sequence: Synthetic oligonucleotide
  Target: ATXN1; (-) strand; PAM type: NRG; PAM sequence: TAG
tttgcttcttgggtttattt

SEQ ID NO: 68650 - DNA, 20 bp, Artificial Sequence
  Description of Artificial Sequence: Synthetic oligonucleotide
  Target: ATXN1; (-) strand; PAM type: NRG; PAM sequence: GGG
aatgaaggactttgcttctt

SEQ ID NO: 68651 - DNA, 20 bp, Artificial Sequence
  Description of Artificial Sequence: Synthetic oligonucleotide
  Target: ATXN1; (-) strand; PAM type: NRG; PAM sequence: TGG
taatgaaggactttgcttct

SEQ ID NO: 68652 - DNA, 20 bp, Artificial Sequence
  Description of Artificial Sequence: Synthetic oligonucleotide
  Target: ATXN1; (-) strand; PAM type: NRG; PAM sequence: AGG
aagaaagccgaaaataatga

SEQ ID NO: 68653 - DNA, 20 bp, Artificial Sequence
  Description of Artificial Sequence: Synthetic oligonucleotide
  Target: ATXN1; (-) strand; PAM type: NRG; PAM sequence: AAG
gaagaaagccgaaaataatg

SEQ ID NO: 68654 - DNA, 20 bp, Artificial Sequence
  Description of Artificial Sequence: Synthetic oligonucleotide
  Target: ATXN1; (-) strand; PAM type: NRG; PAM sequence: AAG
aatatctatggataagaaga

SEQ ID NO: 68655 - DNA, 20 bp, Artificial Sequence
  Description of Artificial Sequence: Synthetic oligonucleotide
  Target: ATXN1; (-) strand; PAM type: NRG; PAM sequence: AAG
cttaaatatctatggataag

SEQ ID NO: 68656 - DNA, 20 bp, Artificial Sequence
  Description of Artificial Sequence: Synthetic oligonucleotide
  Target: ATXN1; (-) strand; PAM type: NRG; PAM sequence: AAG
tctcttaaatatctatggat

SEQ ID NO: 68657 - DNA, 20 bp, Artificial Sequence
  Description of Artificial Sequence: Synthetic oligonucleotide
  Target: ATXN1; (-) strand; PAM type: NRG; PAM sequence: TGG
gatagtctcttaaatatcta

SEQ ID NO: 68658 - DNA, 20 bp, Artificial Sequence
  Description of Artificial Sequence: Synthetic oligonucleotide
  Target: ATXN1; (-) strand; PAM type: NRG; PAM sequence: TAG
gacatggaagtgggaacaga

SEQ ID NO: 68659 - DNA, 20 bp, Artificial Sequence
  Description of Artificial Sequence: Synthetic oligonucleotide
  Target: ATXN1; (-) strand; PAM type: NRG; PAM sequence: CAG
caaagacatggaagtgggaa

SEQ ID NO: 68660 - DNA, 20 bp, Artificial Sequence
  Description of Artificial Sequence: Synthetic oligonucleotide
  Target: ATXN1; (-) strand; PAM type: NRG; PAM sequence: GGG
agaagcaaagacatggaagt

SEQ ID NO: 68661 - DNA, 20 bp, Artificial Sequence
  Description of Artificial Sequence: Synthetic oligonucleotide
  Target: ATXN1; (-) strand; PAM type: NRG; PAM sequence: TGG
tagaagcaaagacatggaag

SEQ ID NO: 68662 - DNA, 20 bp, Artificial Sequence
  Description of Artificial Sequence: Synthetic oligonucleotide
  Target: ATXN1; (-) strand; PAM type: NRG; PAM sequence: AAG
ggctagaagcaaagacatgg

SEQ ID NO: 68663 - DNA, 20 bp, Artificial Sequence
  Description of Artificial Sequence: Synthetic oligonucleotide
  Target: ATXN1; (-) strand; PAM type: NRG; PAM sequence: TGG
ggaggctagaagcaaagaca

SEQ ID NO: 68664 - DNA, 20 bp, Artificial Sequence
  Description of Artificial Sequence: Synthetic oligonucleotide
  Target: ATXN1; (-) strand; PAM type: NRG; PAM sequence: AAG
agatgaggaggctagaagca

SEQ ID NO: 68665 - DNA, 20 bp, Artificial Sequence
  Description of Artificial Sequence: Synthetic oligonucleotide
  Target: ATXN1; (-) strand; PAM type: NRG; PAM sequence: AAG
attccagatgaggaggctag

SEQ ID NO: 68666 - DNA, 20 bp, Artificial Sequence
  Description of Artificial Sequence: Synthetic oligonucleotide
  Target: ATXN1; (-) strand; PAM type: NRG; PAM sequence: TAG
tttattccagatgaggaggc

SEQ ID NO: 68667 - DNA, 20 bp, Artificial Sequence
  Description of Artificial Sequence: Synthetic oligonucleotide
  Target: ATXN1; (-) strand; PAM type: NRG; PAM sequence: AGG
aaggtttattccagatgagg

SEQ ID NO: 68668 - DNA, 20 bp, Artificial Sequence
  Description of Artificial Sequence: Synthetic oligonucleotide
  Target: ATXN1; (-) strand; PAM type: NRG; PAM sequence: GAG
gaaggtttattccagatgag

SEQ ID NO: 68669 - DNA, 20 bp, Artificial Sequence
  Description of Artificial Sequence: Synthetic oligonucleotide
  Target: ATXN1; (-) strand; PAM type: NRG; PAM sequence: AGG
aggaaggtttattccagatg

SEQ ID NO: 68670 - DNA, 20 bp, Artificial Sequence
  Description of Artificial Sequence: Synthetic oligonucleotide
  Target: ATXN1; (-) strand; PAM type: NRG; PAM sequence: GAG
taggaaggtttattccagat

SEQ ID NO: 68671 - DNA, 20 bp, Artificial Sequence
  Description of Artificial Sequence: Synthetic oligonucleotide
  Target: ATXN1; (-) strand; PAM type: NRG; PAM sequence: CAG
agacttaggaaggtttattc

SEQ ID NO: 68672 - DNA, 20 bp, Artificial Sequence
  Description of Artificial Sequence: Synthetic oligonucleotide
  Target: ATXN1; (-) strand; PAM type: NRG; PAM sequence: AGG
atacaagagcagacttagga

SEQ ID NO: 68673 - DNA, 20 bp, Artificial Sequence
  Description of Artificial Sequence: Synthetic oligonucleotide
  Target: ATXN1; (-) strand; PAM type: NRG; PAM sequence: AAG
tatacaagagcagacttagg

SEQ ID NO: 68674 - DNA, 20 bp, Artificial Sequence
  Description of Artificial Sequence: Synthetic oligonucleotide
  Target: ATXN1; (-) strand; PAM type: NRG; PAM sequence: AGG
gtttatacaagagcagactt

SEQ ID NO: 68675 - DNA, 20 bp, Artificial Sequence
  Description of Artificial Sequence: Synthetic oligonucleotide
  Target: ATXN1; (-) strand; PAM type: NRG; PAM sequence: TAG
tgtttatacaagagcagact

SEQ ID NO: 68676 - DNA, 20 bp, Artificial Sequence
  Description of Artificial Sequence: Synthetic oligonucleotide
  Target: ATXN1; (-) strand; PAM type: NRG; PAM sequence: CAG
gaaagctgtttatacaagag

SEQ ID NO: 68677 - DNA, 20 bp, Artificial Sequence
  Description of Artificial Sequence: Synthetic oligonucleotide
  Target: ATXN1; (-) strand; PAM type: NRG; PAM sequence: GAG
aaagaaagctgtttatacaa

SEQ ID NO: 68678 - DNA, 20 bp, Artificial Sequence
  Description of Artificial Sequence: Synthetic oligonucleotide
  Target: ATXN1; (-) strand; PAM type: NRG; PAM sequence: AAG
tcaaagaaagctgtttatac

SEQ ID NO: 68679 - DNA, 20 bp, Artificial Sequence
  Description of Artificial Sequence: Synthetic oligonucleotide
  Target: ATXN1; (-) strand; PAM type: NRG; PAM sequence: AAG
agcctaagagcattcaaaga

SEQ ID NO: 68680 - DNA, 20 bp, Artificial Sequence
  Description of Artificial Sequence: Synthetic oligonucleotide
  Target: ATXN1; (-) strand; PAM type: NRG; PAM sequence: AAG
acctagcctaagagcattca

SEQ ID NO: 68681 - DNA, 20 bp, Artificial Sequence
  Description of Artificial Sequence: Synthetic oligonucleotide
  Target: ATXN1; (-) strand; PAM type: NRG; PAM sequence: GAG
gctggtgcgacctagcctaa

SEQ ID NO: 68682 - DNA, 20 bp, Artificial Sequence
  Description of Artificial Sequence: Synthetic oligonucleotide
  Target: ATXN1; (-) strand; PAM type: NRG; PAM sequence: AAG
gggctggtgcgacctagcct

SEQ ID NO: 68683 - DNA, 20 bp, Artificial Sequence
  Description of Artificial Sequence: Synthetic oligonucleotide
  Target: ATXN1; (-) strand; PAM type: NRG; PAM sequence: TAG
acagaagggctggtgcgacc

SEQ ID NO: 68684 - DNA, 20 bp, Artificial Sequence
  Description of Artificial Sequence: Synthetic oligonucleotide
  Target: ATXN1; (-) strand; PAM type: NRG; PAM sequence: TGG
aaatcagaatacagaagggc

SEQ ID NO: 68685 - DNA, 20 bp, Artificial Sequence
  Description of Artificial Sequence: Synthetic oligonucleotide
  Target: ATXN1; (-) strand; PAM type: NRG; PAM sequence: GGG
tagaaaatcagaatacagaa

SEQ ID NO: 68686 - DNA, 20 bp, Artificial Sequence
  Description of Artificial Sequence: Synthetic oligonucleotide
  Target: ATXN1; (-) strand; PAM type: NRG; PAM sequence: AGG
gtagaaaatcagaatacaga

SEQ ID NO: 68687 - DNA, 20 bp, Artificial Sequence
  Description of Artificial Sequence: Synthetic oligonucleotide
  Target: ATXN1; (-) strand; PAM type: NRG; PAM sequence: AAG
tgtagaaaatcagaatacag

SEQ ID NO: 68688 - DNA, 20 bp, Artificial Sequence
  Description of Artificial Sequence: Synthetic oligonucleotide
  Target: ATXN1; (-) strand; PAM type: NRG; PAM sequence: CAG
tgctgtagaaaatcagaata

SEQ ID NO: 68689 - DNA, 20 bp, Artificial Sequence
  Description of Artificial Sequence: Synthetic oligonucleotide
  Target: ATXN1; (-) strand; PAM type: NRG; PAM sequence: CAG
agagaagtgctgtagaaaat

SEQ ID NO: 68690 - DNA, 20 bp, Artificial Sequence
  Description of Artificial Sequence: Synthetic oligonucleotide
  Target: ATXN1; (-) strand; PAM type: NRG; PAM sequence: TAG
acagtaacagagaagtgctg

SEQ ID NO: 68691 - DNA, 20 bp, Artificial Sequence
  Description of Artificial Sequence: Synthetic oligonucleotide
  Target: ATXN1; (-) strand; PAM type: NRG; PAM sequence: AAG
atgacaggacagtaacagag

SEQ ID NO: 68692 - DNA, 20 bp, Artificial Sequence
  Description of Artificial Sequence: Synthetic oligonucleotide
  Target: ATXN1; (-) strand; PAM type: NRG; PAM sequence: GAG
caaatgacaggacagtaaca

SEQ ID NO: 68693 - DNA, 20 bp, Artificial Sequence
  Description of Artificial Sequence: Synthetic oligonucleotide
  Target: ATXN1; (-) strand; PAM type: NRG; PAM sequence: CAG
atcaaatgacaggacagtaa

SEQ ID NO: 68694 - DNA, 20 bp, Artificial Sequence
  Description of Artificial Sequence: Synthetic oligonucleotide
  Target: ATXN1; (-) strand; PAM type: NRG; PAM sequence: CAG
tctagaatcaaatgacagga

SEQ ID NO: 68695 - DNA, 20 bp, Artificial Sequence
  Description of Artificial Sequence: Synthetic oligonucleotide
  Target: ATXN1; (-) strand; PAM type: NRG; PAM sequence: AGG
gccctctagaatcaaatgac

SEQ ID NO: 68696 - DNA, 20 bp, Artificial Sequence
  Description of Artificial Sequence: Synthetic oligonucleotide
  Target: ATXN1; (-) strand; PAM type: NRG; PAM sequence: CAG
tgccctctagaatcaaatga

SEQ ID NO: 68697 - DNA, 20 bp, Artificial Sequence
  Description of Artificial Sequence: Synthetic oligonucleotide
  Target: ATXN1; (-) strand; PAM type: NRG; PAM sequence: TAG
cctcacagacccctgccctc

SEQ ID NO: 68698 - DNA, 20 bp, Artificial Sequence
  Description of Artificial Sequence: Synthetic oligonucleotide
  Target: ATXN1; (-) strand; PAM type: NRG; PAM sequence: CAG
gggcagatgccctgccctca

SEQ ID NO: 68699 - DNA, 20 bp, Artificial Sequence
  Description of Artificial Sequence: Synthetic oligonucleotide
  Target: ATXN1; (-) strand; PAM type: NRG; PAM sequence: CAG
gctgtgcttattcctgtggg

SEQ ID NO: 68700 - DNA, 20 bp, Artificial Sequence
  Description of Artificial Sequence: Synthetic oligonucleotide
  Target: ATXN1; (-) strand; PAM type: NRG; PAM sequence: GGG
ggtgctgtgcttattcctgt

SEQ ID NO: 68701 - DNA, 20 bp, Artificial Sequence
  Description of Artificial Sequence: Synthetic oligonucleotide
  Target: ATXN1; (-) strand; PAM type: NRG; PAM sequence: TGG
tggtgctgtgcttattcctg

SEQ ID NO: 68702 - DNA, 20 bp, Artificial Sequence
  Description of Artificial Sequence: Synthetic oligonucleotide
  Target: ATXN1; (-) strand; PAM type: NRG; PAM sequence: TGG
agctcaatccaagtcagact

SEQ ID NO: 68703 - DNA, 20 bp, Artificial Sequence
  Description of Artificial Sequence: Synthetic oligonucleotide
  Target: ATXN1; (-) strand; PAM type: NRG; PAM sequence: CAG
ttattcagctcaatccaagt

SEQ ID NO: 68704 - DNA, 20 bp, Artificial Sequence
  Description of Artificial Sequence: Synthetic oligonucleotide
  Target: ATXN1; (-) strand; PAM type: NRG; PAM sequence: AAG
tcatttattcagctcaatcc

SEQ ID NO: 68705 - DNA, 20 bp, Artificial Sequence
  Description of Artificial Sequence: Synthetic oligonucleotide
  Target: ATXN1; (-) strand; PAM type: NRG; PAM sequence: CAG
ctcaacagatttcatttatt

SEQ ID NO: 68706 - DNA, 20 bp, Artificial Sequence
  Description of Artificial Sequence: Synthetic oligonucleotide
  Target: ATXN1; (-) strand; PAM type: NRG; PAM sequence: CAG
agcccagccagtcaactcaa

SEQ ID NO: 68707 - DNA, 20 bp, Artificial Sequence
  Description of Artificial Sequence: Synthetic oligonucleotide
  Target: ATXN1; (-) strand; PAM type: NRG; PAM sequence: CAG
tagacagaaggcagcccagc

SEQ ID NO: 68708 - DNA, 20 bp, Artificial Sequence
  Description of Artificial Sequence: Synthetic oligonucleotide
  Target: ATXN1; (-) strand; PAM type: NRG; PAM sequence: CAG
agactagacagaaggcagcc

SEQ ID NO: 68709 - DNA, 20 bp, Artificial Sequence
  Description of Artificial Sequence: Synthetic oligonucleotide
  Target: ATXN1; (-) strand; PAM type: NRG; PAM sequence: CAG
gtggcagactagacagaagg

SEQ ID NO: 68710 - DNA, 20 bp, Artificial Sequence
  Description of Artificial Sequence: Synthetic oligonucleotide
  Target: ATXN1; (-) strand; PAM type: NRG; PAM sequence: AGG
actgtggcagactagacaga

SEQ ID NO: 68711 - DNA, 20 bp, Artificial Sequence
  Description of Artificial Sequence: Synthetic oligonucleotide
  Target: ATXN1; (-) strand; PAM type: NRG; PAM sequence: AAG
cactgtggcagactagacag

SEQ ID NO: 68712 - DNA, 20 bp, Artificial Sequence
  Description of Artificial Sequence: Synthetic oligonucleotide
  Target: ATXN1; (-) strand; PAM type: NRG; PAM sequence: CAG
gctcactgtggcagactaga

SEQ ID NO: 68713 - DNA, 20 bp, Artificial Sequence
  Description of Artificial Sequence: Synthetic oligonucleotide
  Target: ATXN1; (-) strand; PAM type: NRG; PAM sequence: TAG
cctagctcactgtggcagac

SEQ ID NO: 68714 - DNA, 20 bp, Artificial Sequence
  Description of Artificial Sequence: Synthetic oligonucleotide
  Target: ATXN1; (-) strand; PAM type: NRG; PAM sequence: CAG
aggagcctagctcactgtgg

SEQ ID NO: 68715 - DNA, 20 bp, Artificial Sequence
  Description of Artificial Sequence: Synthetic oligonucleotide
  Target: ATXN1; (-) strand; PAM type: NRG; PAM sequence: TGG
aggaggagcctagctcactg

SEQ ID NO: 68716 - DNA, 20 bp, Artificial Sequence
  Description of Artificial Sequence: Synthetic oligonucleotide
  Target: ATXN1; (-) strand; PAM type: NRG; PAM sequence: TAG
agttcacttcaggaggagcc

SEQ ID NO: 68717 - DNA, 20 bp, Artificial Sequence
  Description of Artificial Sequence: Synthetic oligonucleotide
  Target: ATXN1; (-) strand; PAM type: NRG; PAM sequence: GAG
atcctagttcacttcaggag

SEQ ID NO: 68718 - DNA, 20 bp, Artificial Sequence
  Description of Artificial Sequence: Synthetic oligonucleotide
  Target: ATXN1; (-) strand; PAM type: NRG; PAM sequence: AGG
tgatcctagttcacttcagg

SEQ ID NO: 68719 - DNA, 20 bp, Artificial Sequence
  Description of Artificial Sequence: Synthetic oligonucleotide
  Target: ATXN1; (-) strand; PAM type: NRG; PAM sequence: GAG
ctgatcctagttcacttcag

SEQ ID NO: 68720 - DNA, 20 bp, Artificial Sequence
  Description of Artificial Sequence: Synthetic oligonucleotide
  Target: ATXN1; (-) strand; PAM type: NRG; PAM sequence: AGG
cactgatcctagttcacttc

SEQ ID NO: 68721 - DNA, 20 bp, Artificial Sequence
  Description of Artificial Sequence: Synthetic oligonucleotide
  Target: ATXN1; (-) strand; PAM type: NRG; PAM sequence: CAG
tcactgatcctagttcactt

SEQ ID NO: 68722 - DNA, 20 bp, Artificial Sequence
  Description of Artificial Sequence: Synthetic oligonucleotide
  Target: ATXN1; (-) strand; PAM type: NRG; PAM sequence: TAG
ctttagtccctcactgatcc

SEQ ID NO: 68723 - DNA, 20 bp, Artificial Sequence
  Description of Artificial Sequence: Synthetic oligonucleotide
  Target: ATXN1; (-) strand; PAM type: NRG; PAM sequence: TAG
ttcatgctacagattgactt

SEQ ID NO: 68724 - DNA, 20 bp, Artificial Sequence
  Description of Artificial Sequence: Synthetic oligonucleotide
  Target: ATXN1; (-) strand; PAM type: NRG; PAM sequence: CAG
cctgtgaaatcttcatgcta

SEQ ID NO: 68725 - DNA, 20 bp, Artificial Sequence
  Description of Artificial Sequence: Synthetic oligonucleotide
  Target: ATXN1; (-) strand; PAM type: NRG; PAM sequence: GAG
agtttggtgtgtgcagtagt

SEQ ID NO: 68726 - DNA, 20 bp, Artificial Sequence
  Description of Artificial Sequence: Synthetic oligonucleotide
  Target: ATXN1; (-) strand; PAM type: NRG; PAM sequence: TAG
tgggagtttggtgtgtgcag

SEQ ID NO: 68727 - DNA, 20 bp, Artificial Sequence
  Description of Artificial Sequence: Synthetic oligonucleotide
  Target: ATXN1; (-) strand; PAM type: NRG; PAM sequence: CAG
ttgtgggagtttggtgtgtg

SEQ ID NO: 68728 - DNA, 20 bp, Artificial Sequence
  Description of Artificial Sequence: Synthetic oligonucleotide
  Target: ATXN1; (-) strand; PAM type: NRG; PAM sequence: TGG
ctcttccttttgtgggagtt

SEQ ID NO: 68729 - DNA, 20 bp, Artificial Sequence
  Description of Artificial Sequence: Synthetic oligonucleotide
  Target: ATXN1; (-) strand; PAM type: NRG; PAM sequence: GAG
tccccctcttccttttgtgg

SEQ ID NO: 68730 - DNA, 20 bp, Artificial Sequence
  Description of Artificial Sequence: Synthetic oligonucleotide
  Target: ATXN1; (-) strand; PAM type: NRG; PAM sequence: GGG
gctccccctcttccttttgt

SEQ ID NO: 68731 - DNA, 20 bp, Artificial Sequence
  Description of Artificial Sequence: Synthetic oligonucleotide
  Target: ATXN1; (-) strand; PAM type: NRG; PAM sequence: TGG
agctccccctcttccttttg

SEQ ID NO: 68732 - DNA, 20 bp, Artificial Sequence
  Description of Artificial Sequence: Synthetic oligonucleotide
  Target: ATXN1; (-) strand; PAM type: NRG; PAM sequence: TAG
attttatgcccaacacatat

SEQ ID NO: 68733 - DNA, 20 bp, Artificial Sequence
  Description of Artificial Sequence: Synthetic oligonucleotide
  Target: ATXN1; (-) strand; PAM type: NRG; PAM sequence: CAG
gttctgggtgctggggcttg

SEQ ID NO: 68734 - DNA, 20 bp, Artificial Sequence
  Description of Artificial Sequence: Synthetic oligonucleotide
  Target: ATXN1; (-) strand; PAM type: NRG; PAM sequence: GGG
gaactaagttctgggtgctg

SEQ ID NO: 68735 - DNA, 20 bp, Artificial Sequence
  Description of Artificial Sequence: Synthetic oligonucleotide
  Target: ATXN1; (-) strand; PAM type: NRG; PAM sequence: GGG
ggaactaagttctgggtgct

SEQ ID NO: 68736 - DNA, 20 bp, Artificial Sequence
  Description of Artificial Sequence: Synthetic oligonucleotide
  Target: ATXN1; (-) strand; PAM type: NRG; PAM sequence: TGG
aggaactaagttctgggtgc

SEQ ID NO: 68737 - DNA, 20 bp, Artificial Sequence
  Description of Artificial Sequence: Synthetic oligonucleotide
  Target: ATXN1; (-) strand; PAM type: NRG; PAM sequence: GGG
ggtgttaggaactaagttct

SEQ ID NO: 68738 - DNA, 20 bp, Artificial Sequence
  Description of Artificial Sequence: Synthetic oligonucleotide
  Target: ATXN1; (-) strand; PAM type: NRG; PAM sequence: TGG
tggtgttaggaactaagttc

SEQ ID NO: 68739 - DNA, 20 bp, Artificial Sequence
  Description of Artificial Sequence: Synthetic oligonucleotide
  Target: ATXN1; (-) strand; PAM type: NRG; PAM sequence: AAG
ggagaatggtgttaggaact

SEQ ID NO: 68740 - DNA, 20 bp, Artificial Sequence
  Description of Artificial Sequence: Synthetic oligonucleotide
  Target: ATXN1; (-) strand; PAM type: NRG; PAM sequence: AGG
ttttattggagaatggtgtt

SEQ ID NO: 68741 - DNA, 20 bp, Artificial Sequence
  Description of Artificial Sequence: Synthetic oligonucleotide
  Target: ATXN1; (-) strand; PAM type: NRG; PAM sequence: TAG
gttttattggagaatggtgt

SEQ ID NO: 68742 - DNA, 20 bp, Artificial Sequence
  Description of Artificial Sequence: Synthetic oligonucleotide
  Target: ATXN1; (-) strand; PAM type: NRG; PAM sequence: TGG
tggtttgttttattggagaa

SEQ ID NO: 68743 - DNA, 20 bp, Artificial Sequence
  Description of Artificial Sequence: Synthetic oligonucleotide
  Target: ATXN1; (-) strand; PAM type: NRG; PAM sequence: GAG
acccctggtttgttttattg

SEQ ID NO: 68744 - DNA, 20 bp, Artificial Sequence
  Description of Artificial Sequence: Synthetic oligonucleotide
  Target: ATXN1; (-) strand; PAM type: NRG; PAM sequence: TGG
agacccctggtttgttttat

SEQ ID NO: 68745 - DNA, 20 bp, Artificial Sequence
  Description of Artificial Sequence: Synthetic oligonucleotide
  Target: ATXN1; (-) strand; PAM type: NRG; PAM sequence: TGG
gccatttctccaaagacccc

SEQ ID NO: 68746 - DNA, 20 bp, Artificial Sequence
  Description of Artificial Sequence: Synthetic oligonucleotide
  Target: ATXN1; (-) strand; PAM type: NRG; PAM sequence: AAG
tagaatcagccatttctcca

SEQ ID NO: 68747 - DNA, 20 bp, Artificial Sequence
  Description of Artificial Sequence: Synthetic oligonucleotide
  Target: ATXN1; (-) strand; PAM type: NRG; PAM sequence: CAG
ccctgtcacagtactagaat

SEQ ID NO: 68748 - DNA, 20 bp, Artificial Sequence
  Description of Artificial Sequence: Synthetic oligonucleotide
  Target: ATXN1; (-) strand; PAM type: NRG; PAM sequence: TAG
gatattccctgtcacagtac

SEQ ID NO: 68749 - DNA, 20 bp, Artificial Sequence
  Description of Artificial Sequence: Synthetic oligonucleotide
  Target: ATXN1; (-) strand; PAM type: NRG; PAM sequence: CAG
atcttggatattccctgtca

SEQ ID NO: 68750 - DNA, 20 bp, Artificial Sequence
  Description of Artificial Sequence: Synthetic oligonucleotide
  Target: ATXN1; (-) strand; PAM type: NRG; PAM sequence: TGG
aagatgctccatgctcatct

SEQ ID NO: 68751 - DNA, 20 bp, Artificial Sequence
  Description of Artificial Sequence: Synthetic oligonucleotide
  Target: ATXN1; (-) strand; PAM type: NRG; PAM sequence: AAG
ttcccactttctgatactac

SEQ ID NO: 68752 - DNA, 20 bp, Artificial Sequence
  Description of Artificial Sequence: Synthetic oligonucleotide
  Target: ATXN1; (-) strand; PAM type: NRG; PAM sequence: TAG
ggggtattgatttatctatt

SEQ ID NO: 68753 - DNA, 20 bp, Artificial Sequence
  Description of Artificial Sequence: Synthetic oligonucleotide
  Target: ATXN1; (-) strand; PAM type: NRG; PAM sequence: GGG
tatatgcccccatcactgtg

SEQ ID NO: 68754 - DNA, 20 bp, Artificial Sequence
  Description of Artificial Sequence: Synthetic oligonucleotide
  Target: ATXN1; (-) strand; PAM type: NRG; PAM sequence: GGG
ttatatgcccccatcactgt

SEQ ID NO: 68755 - DNA, 20 bp, Artificial Sequence
  Description of Artificial Sequence: Synthetic oligonucleotide
  Target: ATXN1; (-) strand; PAM type: NRG; PAM sequence: TGG
tttatatgcccccatcactg

SEQ ID NO: 68756 - DNA, 20 bp, Artificial Sequence
  Description of Artificial Sequence: Synthetic oligonucleotide
  Target: ATXN1; (-) strand; PAM type: NRG; PAM sequence: AGG
gcagctctttgagaaatatt

SEQ ID NO: 68757 - DNA, 20 bp, Artificial Sequence
  Description of Artificial Sequence: Synthetic oligonucleotide
  Target: ATXN1; (-) strand; PAM type: NRG; PAM sequence: TAG
ggcagctctttgagaaatat

SEQ ID NO: 68758 - DNA, 20 bp, Artificial Sequence
  Description of Artificial Sequence: Synthetic oligonucleotide
  Target: ATXN1; (-) strand; PAM type: NRG; PAM sequence: GAG
ctggccattggcagctcttt

SEQ ID NO: 68759 - DNA, 20 bp, Artificial Sequence
  Description of Artificial Sequence: Synthetic oligonucleotide
  Target: ATXN1; (-) strand; PAM type: NRG; PAM sequence: CAG
gttttagttctggccattgg

SEQ ID NO: 68760 - DNA, 20 bp, Artificial Sequence
  Description of Artificial Sequence: Synthetic oligonucleotide
  Target: ATXN1; (-) strand; PAM type: NRG; PAM sequence: TGG
gttgttttagttctggccat

SEQ ID NO: 68761 - DNA, 20 bp, Artificial Sequence
  Description of Artificial Sequence: Synthetic oligonucleotide
  Target: ATXN1; (-) strand; PAM type: NRG; PAM sequence: TGG
tgctctggttgttttagttc

SEQ ID NO: 68762 - DNA, 20 bp, Artificial Sequence
  Description of Artificial Sequence: Synthetic oligonucleotide
  Target: ATXN1; (-) strand; PAM type: NRG; PAM sequence: TAG
ttttgttgctctggttgttt

SEQ ID NO: 68763 - DNA, 20 bp, Artificial Sequence
  Description of Artificial Sequence: Synthetic oligonucleotide
  Target: ATXN1; (-) strand; PAM type: NRG; PAM sequence: TGG
tgttgtttattttgttgctc

SEQ ID NO: 68764 - DNA, 20 bp, Artificial Sequence
  Description of Artificial Sequence: Synthetic oligonucleotide
  Target: ATXN1; (-) strand; PAM type: NRG; PAM sequence: CAG
ttattctttaggttctaatc

SEQ ID NO: 68765 - DNA, 20 bp, Artificial Sequence
  Description of Artificial Sequence: Synthetic oligonucleotide
  Target: ATXN1; (-) strand; PAM type: NRG; PAM sequence: AGG
gggtgtttattttattcttt

SEQ ID NO: 68766 - DNA, 20 bp, Artificial Sequence
  Description of Artificial Sequence: Synthetic oligonucleotide
  Target: ATXN1; (-) strand; PAM type: NRG; PAM sequence: TAG
tgggtgtttattttattctt

SEQ ID NO: 68767 - DNA, 20 bp, Artificial Sequence
  Description of Artificial Sequence: Synthetic oligonucleotide
  Target: ATXN1; (-) strand; PAM type: NRG; PAM sequence: GGG
ttatatcaatatgaactcat

SEQ ID NO: 68768 - DNA, 20 bp, Artificial Sequence
  Description of Artificial Sequence: Synthetic oligonucleotide
  Target: ATXN1; (-) strand; PAM type: NRG; PAM sequence: TGG
tttatatcaatatgaactca

SEQ ID NO: 68769 - DNA, 20 bp, Artificial Sequence
  Description of Artificial Sequence: Synthetic oligonucleotide
  Target: ATXN1; (-) strand; PAM type: NRG; PAM sequence: GAG
tttagaactcctttgctcaa

SEQ ID NO: 68770 - DNA, 20 bp, Artificial Sequence
  Description of Artificial Sequence: Synthetic oligonucleotide
  Target: ATXN1; (-) strand; PAM type: NRG; PAM sequence: AAG
tatttagaactcctttgctc

SEQ ID NO: 68771 - DNA, 20 bp, Artificial Sequence
  Description of Artificial Sequence: Synthetic oligonucleotide
  Target: ATXN1; (-) strand; PAM type: NRG; PAM sequence: TAG
gaacatctgcatgaattatt

SEQ ID NO: 68772 - DNA, 20 bp, Artificial Sequence
  Description of Artificial Sequence: Synthetic oligonucleotide
  Target: ATXN1; (-) strand; PAM type: NRG; PAM sequence: CAG
acgctctacctttacaaggg

SEQ ID NO: 68773 - DNA, 20 bp, Artificial Sequence
  Description of Artificial Sequence: Synthetic oligonucleotide
  Target: ATXN1; (-) strand; PAM type: NRG; PAM sequence: GGG
gttacgctctacctttacaa

SEQ ID NO: 68774 - DNA, 20 bp, Artificial Sequence
  Description of Artificial Sequence: Synthetic oligonucleotide
  Target: ATXN1; (-) strand; PAM type: NRG; PAM sequence: AGG
agttacgctctacctttaca

SEQ ID NO: 68775 - DNA, 20 bp, Artificial Sequence
  Description of Artificial Sequence: Synthetic oligonucleotide
  Target: ATXN1; (-) strand; PAM type: NRG; PAM sequence: AAG
cagttacgctctacctttac

SEQ ID NO: 68776 - DNA, 20 bp, Artificial Sequence
  Description of Artificial Sequence: Synthetic oligonucleotide
  Target: ATXN1; (-) strand; PAM type: NRG; PAM sequence: CAG
gcccacacttaaggggtggg

SEQ ID NO: 68777 - DNA, 20 bp, Artificial Sequence
  Description of Artificial Sequence: Synthetic oligonucleotide
  Target: ATXN1; (-) strand; PAM type: NRG; PAM sequence: GGG
acagcccacacttaaggggt

SEQ ID NO: 68778 - DNA, 20 bp, Artificial Sequence
  Description of Artificial Sequence: Synthetic oligonucleotide
  Target: ATXN1; (-) strand; PAM type: NRG; PAM sequence: TGG
cacagcccacacttaagggg

SEQ ID NO: 68779 - DNA, 20 bp, Artificial Sequence
  Description of Artificial Sequence: Synthetic oligonucleotide
  Target: ATXN1; (-) strand; PAM type: NRG; PAM sequence: GGG
gtgcacagcccacacttaag

SEQ ID NO: 68780 - DNA, 20 bp, Artificial Sequence
  Description of Artificial Sequence: Synthetic oligonucleotide
  Target: ATXN1; (-) strand; PAM type: NRG; PAM sequence: GGG
tgtgcacagcccacacttaa

SEQ ID NO: 68781 - DNA, 20 bp, Artificial Sequence
  Description of Artificial Sequence: Synthetic oligonucleotide
  Target: ATXN1; (-) strand; PAM type: NRG; PAM sequence: AGG
ctgtgcacagcccacactta

SEQ ID NO: 68782 - DNA, 20 bp, Artificial Sequence
  Description of Artificial Sequence: Synthetic oligonucleotide
  Target: ATXN1; (-) strand; PAM type: NRG; PAM sequence: AAG
actgtgcacagcccacactt

SEQ ID NO: 68783 - DNA, 20 bp, Artificial Sequence
  Description of Artificial Sequence: Synthetic oligonucleotide
  Target: ATXN1; (-) strand; PAM type: NRG; PAM sequence: CAG
tggaaggaagtcactgtgca

SEQ ID NO: 68784 - DNA, 20 bp, Artificial Sequence
  Description of Artificial Sequence: Synthetic oligonucleotide
  Target: ATXN1; (-) strand; PAM type: NRG; PAM sequence: AAG
ctgtactactcgttggaagg

SEQ ID NO: 68785 - DNA, 20 bp, Artificial Sequence
  Description of Artificial Sequence: Synthetic oligonucleotide
  Target: ATXN1; (-) strand; PAM type: NRG; PAM sequence: AGG
atactgtactactcgttgga

SEQ ID NO: 68786 - DNA, 20 bp, Artificial Sequence
  Description of Artificial Sequence: Synthetic oligonucleotide
  Target: ATXN1; (-) strand; PAM type: NRG; PAM sequence: AAG
catactgtactactcgttgg

SEQ ID NO: 68787 - DNA, 20 bp, Artificial Sequence
  Description of Artificial Sequence: Synthetic oligonucleotide
  Target: ATXN1; (-) strand; PAM type: NRG; PAM sequence: TGG
ttccatactgtactactcgt

SEQ ID NO: 68788 - DNA, 20 bp, Artificial Sequence
  Description of Artificial Sequence: Synthetic oligonucleotide
  Target: ATXN1; (-) strand; PAM type: NRG; PAM sequence: CAG
ttaaagttactctttgtaca

SEQ ID NO: 68789 - DNA, 20 bp, Artificial Sequence
  Description of Artificial Sequence: Synthetic oligonucleotide
  Target: ATXN1; (-) strand; PAM type: NRG; PAM sequence: AAG
gtcagggtttgtcaacttta

SEQ ID NO: 68790 - DNA, 20 bp, Artificial Sequence
  Description of Artificial Sequence: Synthetic oligonucleotide
  Target: ATXN1; (-) strand; PAM type: NRG; PAM sequence: GGG
cctcagccgaggttgtgtca

SEQ ID NO: 68791 - DNA, 20 bp, Artificial Sequence
  Description of Artificial Sequence: Synthetic oligonucleotide
  Target: ATXN1; (-) strand; PAM type: NRG; PAM sequence: AGG
acctcagccgaggttgtgtc

SEQ ID NO: 68792 - DNA, 20 bp, Artificial Sequence
  Description of Artificial Sequence: Synthetic oligonucleotide
  Target: ATXN1; (-) strand; PAM type: NRG; PAM sequence: CAG
gacctcagccgaggttgtgt

SEQ ID NO: 68793 - DNA, 20 bp, Artificial Sequence
  Description of Artificial Sequence: Synthetic oligonucleotide
  Target: ATXN1; (-) strand; PAM type: NRG; PAM sequence: AGG
gatcttgatgacctcagccg

SEQ ID NO: 68794 - DNA, 20 bp, Artificial Sequence
  Description of Artificial Sequence: Synthetic oligonucleotide
  Target: ATXN1; (-) strand; PAM type: NRG; PAM sequence: GAG
tgatcttgatgacctcagcc

SEQ ID NO: 68795 - DNA, 20 bp, Artificial Sequence
  Description of Artificial Sequence: Synthetic oligonucleotide
  Target: ATXN1; (-) strand; PAM type: NRG; PAM sequence: CAG
gctgttgatcttgatgacct

SEQ ID NO: 68796 - DNA, 20 bp, Artificial Sequence
  Description of Artificial Sequence: Synthetic oligonucleotide
  Target: ATXN1; (-) strand; PAM type: NRG; PAM sequence: GGG
catcatatgtgacctatcat

SEQ ID NO: 68797 - DNA, 20 bp, Artificial Sequence
  Description of Artificial Sequence: Synthetic oligonucleotide
  Target: ATXN1; (-) strand; PAM type: NRG; PAM sequence: TGG
acatcatatgtgacctatca

SEQ ID NO: 68798 - DNA, 20 bp, Artificial Sequence
  Description of Artificial Sequence: Synthetic oligonucleotide
  Target: ATXN1; (-) strand; PAM type: NRG; PAM sequence: CAG
tctgtactccttaaaattgg

SEQ ID NO: 68799 - DNA, 20 bp, Artificial Sequence
  Description of Artificial Sequence: Synthetic oligonucleotide
  Target: ATXN1; (-) strand; PAM type: NRG; PAM sequence: TGG
tagtctgtactccttaaaat

SEQ ID NO: 68800 - DNA, 20 bp, Artificial Sequence
  Description of Artificial Sequence: Synthetic oligonucleotide
  Target: ATXN1; (-) strand; PAM type: NRG; PAM sequence: TAG
gggacagtccacaaaatgat

SEQ ID NO: 68801 - DNA, 20 bp, Artificial Sequence
  Description of Artificial Sequence: Synthetic oligonucleotide
  Target: ATXN1; (-) strand; PAM type: NRG; PAM sequence: CAG
gaaaaacccaaattgaggga

SEQ ID NO: 68802 - DNA, 20 bp, Artificial Sequence
  Description of Artificial Sequence: Synthetic oligonucleotide
  Target: ATXN1; (-) strand; PAM type: NRG; PAM sequence: GGG
gccagaaaaacccaaattga

SEQ ID NO: 68803 - DNA, 20 bp, Artificial Sequence
  Description of Artificial Sequence: Synthetic oligonucleotide
  Target: ATXN1; (-) strand; PAM type: NRG; PAM sequence: AGG
ggccagaaaaacccaaattg

SEQ ID NO: 68804 - DNA, 20 bp, Artificial Sequence
  Description of Artificial Sequence: Synthetic oligonucleotide
  Target: ATXN1; (-) strand; PAM type: NRG; PAM sequence: GAG
tggccagaaaaacccaaatt

SEQ ID NO: 68805 - DNA, 20 bp, Artificial Sequence
  Description of Artificial Sequence: Synthetic oligonucleotide
  Target: ATXN1; (-) strand; PAM type: NRG; PAM sequence: CAG
gtgagccaaccatgcctggc

SEQ ID NO: 68806 - DNA, 20 bp, Artificial Sequence
  Description of Artificial Sequence: Synthetic oligonucleotide
  Target: ATXN1; (-) strand; PAM type: NRG; PAM sequence: TGG
aggcgtgagccaaccatgcc

SEQ ID NO: 68807 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 68808 - DNA, 20 bp, Artificial Sequence
  Description of Artificial Sequence: Synthetic oligonucleotide
  Target: ATXN1; (-) strand; PAM type: NRG; PAM sequence: AGG
ccacaaagtgctgggattac

SEQ ID NO: 68809 - DNA, 20 bp, Artificial Sequence
  Description of Artificial Sequence: Synthetic oligonucleotide
  Target: ATXN1; (-) strand; PAM type: NRG; PAM sequence: CAG
cccacaaagtgctgggatta

SEQ ID NO: 68810 - DNA, 20 bp, Artificial Sequence
  Description of Artificial Sequence: Synthetic oligonucleotide
  Target: ATXN1; (-) strand; PAM type: NRG; PAM sequence: GGG
ctttggccccacaaagtgct

SEQ ID NO: 68811 - DNA, 20 bp, Artificial Sequence
  Description of Artificial Sequence: Synthetic oligonucleotide
  Target: ATXN1; (-) strand; PAM type: NRG; PAM sequence: TGG
tctttggccccacaaagtgc

SEQ ID NO: 68812 - DNA, 20 bp, Artificial Sequence
  Description of Artificial Sequence: Synthetic oligonucleotide
  Target: ATXN1; (-) strand; PAM type: NRG; PAM sequence: AAG
ccaccctctttggccccaca

SEQ ID NO: 68813 - DNA, 20 bp, Artificial Sequence
  Description of Artificial Sequence: Synthetic oligonucleotide
  Target: ATXN1; (-) strand; PAM type: NRG; PAM sequence: TGG
ctcaagtgatccaccctctt

SEQ ID NO: 68814 - DNA, 20 bp, Artificial Sequence
  Description of Artificial Sequence: Synthetic oligonucleotide
  Target: ATXN1; (-) strand; PAM type: NRG; PAM sequence: AAG
ggtgtcaaacttctgggctc

SEQ ID NO: 68815 - DNA, 20 bp, Artificial Sequence
  Description of Artificial Sequence: Synthetic oligonucleotide
  Target: ATXN1; (-) strand; PAM type: NRG; PAM sequence: GGG
caggctggtgtcaaacttct

SEQ ID NO: 68816 - DNA, 20 bp, Artificial Sequence
  Description of Artificial Sequence: Synthetic oligonucleotide
  Target: ATXN1; (-) strand; PAM type: NRG; PAM sequence: TGG
ccaggctggtgtcaaacttc

SEQ ID NO: 68817 - DNA, 20 bp, Artificial Sequence
  Description of Artificial Sequence: Synthetic oligonucleotide
  Target: ATXN1; (-) strand; PAM type: NRG; PAM sequence: TGG
gagtcagggttttgccaggc

SEQ ID NO: 68818 - DNA, 20 bp, Artificial Sequence
  Description of Artificial Sequence: Synthetic oligonucleotide
  Target: ATXN1; (-) strand; PAM type: NRG; PAM sequence: AGG
ggtagagtcagggttttgcc

SEQ ID NO: 68819 - DNA, 20 bp, Artificial Sequence
  Description of Artificial Sequence: Synthetic oligonucleotide
  Target: ATXN1; (-) strand; PAM type: NRG; PAM sequence: CAG
tggtagagtcagggttttgc

SEQ ID NO: 68820 - DNA, 20 bp, Artificial Sequence
  Description of Artificial Sequence: Synthetic oligonucleotide
  Target: ATXN1; (-) strand; PAM type: NRG; PAM sequence: GGG
gtttttttttggtagagtca

SEQ ID NO: 68821 - DNA, 20 bp, Artificial Sequence
  Description of Artificial Sequence: Synthetic oligonucleotide
  Target: ATXN1; (-) strand; PAM type: NRG; PAM sequence: AGG
ggtttttttttggtagagtc

SEQ ID NO: 68822 - DNA, 20 bp, Artificial Sequence
  Description of Artificial Sequence: Synthetic oligonucleotide
  Target: ATXN1; (-) strand; PAM type: NRG; PAM sequence: CAG
tggtttttttttggtagagt

SEQ ID NO: 68823 - DNA, 20 bp, Artificial Sequence
  Description of Artificial Sequence: Synthetic oligonucleotide
  Target: ATXN1; (-) strand; PAM type: NRG; PAM sequence: GAG
tttttggtttttttttggta

SEQ ID NO: 68824 - DNA, 20 bp, Artificial Sequence
  Description of Artificial Sequence: Synthetic oligonucleotide
  Target: ATXN1; (-) strand; PAM type: NRG; PAM sequence: TAG
ggtttttggtttttttttgg

SEQ ID NO: 68825 - DNA, 20 bp, Artificial Sequence
  Description of Artificial Sequence: Synthetic oligonucleotide
  Target: ATXN1; (-) strand; PAM type: NRG; PAM sequence: TGG
tttggtttttggtttttttt

SEQ ID NO: 68826 - DNA, 20 bp, Artificial Sequence
  Description of Artificial Sequence: Synthetic oligonucleotide
  Target: ATXN1; (-) strand; PAM type: NRG; PAM sequence: TGG
ctaatttggtttttggtttt

SEQ ID NO: 68827 - DNA, 20 bp, Artificial Sequence
  Description of Artificial Sequence: Synthetic oligonucleotide
  Target: ATXN1; (-) strand; PAM type: NRG; PAM sequence: TGG
catccagctaatttggtttt

SEQ ID NO: 68828 - DNA, 20 bp, Artificial Sequence
  Description of Artificial Sequence: Synthetic oligonucleotide
  Target: ATXN1; (-) strand; PAM type: NRG; PAM sequence: TGG
gctaccacatccagctaatt

SEQ ID NO: 68829 - DNA, 20 bp, Artificial Sequence
  Description of Artificial Sequence: Synthetic oligonucleotide
  Target: ATXN1; (-) strand; PAM type: NRG; PAM sequence: CAG
caggcataggctaccacatc

SEQ ID NO: 68830 - DNA, 20 bp, Artificial Sequence
  Description of Artificial Sequence: Synthetic oligonucleotide
  Target: ATXN1; (-) strand; PAM type: NRG; PAM sequence: AGG
gtagctgggactacaggcat

SEQ ID NO: 68831 - DNA, 20 bp, Artificial Sequence
  Description of Artificial Sequence: Synthetic oligonucleotide
  Target: ATXN1; (-) strand; PAM type: NRG; PAM sequence: TAG
agtagctgggactacaggca

SEQ ID NO: 68832 - DNA, 20 bp, Artificial Sequence
  Description of Artificial Sequence: Synthetic oligonucleotide
  Target: ATXN1; (-) strand; PAM type: NRG; PAM sequence: AGG
ccctgagtagctgggactac

SEQ ID NO: 68833 - DNA, 20 bp, Artificial Sequence
  Description of Artificial Sequence: Synthetic oligonucleotide
  Target: ATXN1; (-) strand; PAM type: NRG; PAM sequence: CAG
cccctgagtagctgggacta

SEQ ID NO: 68834 - DNA, 20 bp, Artificial Sequence
  Description of Artificial Sequence: Synthetic oligonucleotide
  Target: ATXN1; (-) strand; PAM type: NRG; PAM sequence: GGG
tcttagccccctgagtagct

SEQ ID NO: 68835 - DNA, 20 bp, Artificial Sequence
  Description of Artificial Sequence: Synthetic oligonucleotide
  Target: ATXN1; (-) strand; PAM type: NRG; PAM sequence: TGG
atcttagccccctgagtagc

SEQ ID NO: 68836 - DNA, 20 bp, Artificial Sequence
  Description of Artificial Sequence: Synthetic oligonucleotide
  Target: ATXN1; (-) strand; PAM type: NRG; PAM sequence: TAG
tcccatcttagccccctgag

SEQ ID NO: 68837 - DNA, 20 bp, Artificial Sequence
  Description of Artificial Sequence: Synthetic oligonucleotide
  Target: ATXN1; (-) strand; PAM type: NRG; PAM sequence: GAG
tcctcccatcttagccccct

SEQ ID NO: 68838 - DNA, 20 bp, Artificial Sequence
  Description of Artificial Sequence: Synthetic oligonucleotide
  Target: ATXN1; (-) strand; PAM type: NRG; PAM sequence: TAG
cttaagcaatcctcccatct

SEQ ID NO: 68839 - DNA, 20 bp, Artificial Sequence
  Description of Artificial Sequence: Synthetic oligonucleotide
  Target: ATXN1; (-) strand; PAM type: NRG; PAM sequence: AAG
agactggaccttcggggctt

SEQ ID NO: 68840 - DNA, 20 bp, Artificial Sequence
  Description of Artificial Sequence: Synthetic oligonucleotide
  Target: ATXN1; (-) strand; PAM type: NRG; PAM sequence: GGG
cactgcagactggaccttcg

SEQ ID NO: 68841 - DNA, 20 bp, Artificial Sequence
  Description of Artificial Sequence: Synthetic oligonucleotide
  Target: ATXN1; (-) strand; PAM type: NRG; PAM sequence: GGG
tcactgcagactggaccttc

SEQ ID NO: 68842 - DNA, 20 bp, Artificial Sequence
  Description of Artificial Sequence: Synthetic oligonucleotide
  Target: ATXN1; (-) strand; PAM type: NRG; PAM sequence: CGG
ctcactgcagactggacctt

SEQ ID NO: 68843 - DNA, 20 bp, Artificial Sequence
  Description of Artificial Sequence: Synthetic oligonucleotide
  Target: ATXN1; (-) strand; PAM type: NRG; PAM sequence: TGG
gatctcagctcactgcagac

SEQ ID NO: 68844 - DNA, 20 bp, Artificial Sequence
  Description of Artificial Sequence: Synthetic oligonucleotide
  Target: ATXN1; (-) strand; PAM type: NRG; PAM sequence: CAG
ggtacgatctcagctcactg

SEQ ID NO: 68845 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtacgatct

SEQ ID NO: 68846 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggttggagtgcag

SEQ ID NO: 68847 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggttggagtg

SEQ ID NO: 68848 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcgcccaggttg

SEQ ID NO: 68849 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtcgcccaggt

SEQ ID NO: 68850 - DNA, 20 bp, Artificial Sequence
  Description of Artificial Sequence: Synthetic oligonucleotide
  Target: ATXN1; (-) strand; PAM type: NRG; PAM sequence: AGG
agggtctcactctgtcgccc

SEQ ID NO: 68851 - DNA, 20 bp, Artificial Sequence
  Description of Artificial Sequence: Synthetic oligonucleotide
  Target: ATXN1; (-) strand; PAM type: NRG; PAM sequence: CAG
cagggtctcactctgtcgcc

SEQ ID NO: 68852 - DNA, 20 bp, Artificial Sequence
  Description of Artificial Sequence: Synthetic oligonucleotide
  Target: ATXN1; (-) strand; PAM type: NRG; PAM sequence: GGG
ttattattattgttgagaca

SEQ ID NO: 68853 - DNA, 20 bp, Artificial Sequence
  Description of Artificial Sequence: Synthetic oligonucleotide
  Target: ATXN1; (-) strand; PAM type: NRG; PAM sequence: AGG
attattattattgttgagac

SEQ ID NO: 68854 - DNA, 20 bp, Artificial Sequence
  Description of Artificial Sequence: Synthetic oligonucleotide
  Target: ATXN1; (-) strand; PAM type: NRG; PAM sequence: CAG
tattattattattgttgaga

SEQ ID NO: 68855 - DNA, 20 bp, Artificial Sequence
  Description of Artificial Sequence: Synthetic oligonucleotide
  Target: ATXN1; (-) strand; PAM type: NRG; PAM sequence: GAG
ctattattattattattgtt

SEQ ID NO: 68856 - DNA, 20 bp, Artificial Sequence
  Description of Artificial Sequence: Synthetic oligonucleotide
  Target: ATXN1; (-) strand; PAM type: NRG; PAM sequence: AGG
tggctttagttcttgctttt

SEQ ID NO: 68857 - DNA, 20 bp, Artificial Sequence
  Description of Artificial Sequence: Synthetic oligonucleotide
  Target: ATXN1; (-) strand; PAM type: NRG; PAM sequence: TAG
ttggctttagttcttgcttt

SEQ ID NO: 68858 - DNA, 20 bp, Artificial Sequence
  Description of Artificial Sequence: Synthetic oligonucleotide
  Target: ATXN1; (-) strand; PAM type: NRG; PAM sequence: TAG
tcaaaataaaatattggctt

SEQ ID NO: 68859 - DNA, 20 bp, Artificial Sequence
  Description of Artificial Sequence: Synthetic oligonucleotide
  Target: ATXN1; (-) strand; PAM type: NRG; PAM sequence: TGG
actcaatcaaaataaaatat

SEQ ID NO: 68860 - DNA, 20 bp, Artificial Sequence
  Description of Artificial Sequence: Synthetic oligonucleotide
  Target: ATXN1; (-) strand; PAM type: NRG; PAM sequence: TAG
tagttgatgcccttcaagac

SEQ ID NO: 68861 - DNA, 20 bp, Artificial Sequence
  Description of Artificial Sequence: Synthetic oligonucleotide
  Target: ATXN1; (-) strand; PAM type: NRG; PAM sequence: AAG
tgttttagttgatgcccttc

SEQ ID NO: 68862 - DNA, 20 bp, Artificial Sequence
  Description of Artificial Sequence: Synthetic oligonucleotide
  Target: ATXN1; (-) strand; PAM type: NRG; PAM sequence: TAG
tcctgcagtccatcatgttt

SEQ ID NO: 68863 - DNA, 20 bp, Artificial Sequence
  Description of Artificial Sequence: Synthetic oligonucleotide
  Target: ATXN1; (-) strand; PAM type: NRG; PAM sequence: CAG
caagccatctgtccatcctg

SEQ ID NO: 68864 - DNA, 20 bp, Artificial Sequence
  Description of Artificial Sequence: Synthetic oligonucleotide
  Target: ATXN1; (-) strand; PAM type: NRG; PAM sequence: AAG
tatttgctttgtcaggtatc

SEQ ID NO: 68865 - DNA, 20 bp, Artificial Sequence
  Description of Artificial Sequence: Synthetic oligonucleotide
  Target: ATXN1; (-) strand; PAM type: NRG; PAM sequence: AGG
tttgctatatttgctttgtc

SEQ ID NO: 68866 - DNA, 20 bp, Artificial Sequence
  Description of Artificial Sequence: Synthetic oligonucleotide
  Target: ATXN1; (-) strand; PAM type: NRG; PAM sequence: CAG
ttttgctatatttgctttgt

SEQ ID NO: 68867 - DNA, 20 bp, Artificial Sequence
  Description of Artificial Sequence: Synthetic oligonucleotide
  Target: ATXN1; (-) strand; PAM type: NRG; PAM sequence: TAG
acacccataaacttgccacc

SEQ ID NO: 68868 - DNA, 20 bp, Artificial Sequence
  Description of Artificial Sequence: Synthetic oligonucleotide
  Target: ATXN1; (-) strand; PAM type: NRG; PAM sequence: CAG
agtaaattgtaagaattgta

SEQ ID NO: 68869 - DNA, 20 bp, Artificial Sequence
  Description of Artificial Sequence: Synthetic oligonucleotide
  Target: ATXN1; (-) strand; PAM type: NRG; PAM sequence: AAG
caaacatacaagtaaattgt

SEQ ID NO: 68870 - DNA, 20 bp, Artificial Sequence
  Description of Artificial Sequence: Synthetic oligonucleotide
  Target: ATXN1; (-) strand; PAM type: NRG; PAM sequence: AAG
aggaaaaattgcaaacatac

SEQ ID NO: 68871 - DNA, 20 bp, Artificial Sequence
  Description of Artificial Sequence: Synthetic oligonucleotide
  Target: ATXN1; (-) strand; PAM type: NRG; PAM sequence: AGG
tttccccccaacattttatt

SEQ ID NO: 68872 - DNA, 20 bp, Artificial Sequence
  Description of Artificial Sequence: Synthetic oligonucleotide
  Target: ATXN1; (-) strand; PAM type: NRG; PAM sequence: TAG
ctttccccccaacattttat

SEQ ID NO: 68873 - DNA, 20 bp, Artificial Sequence
  Description of Artificial Sequence: Synthetic oligonucleotide
  Target: ATXN1; (-) strand; PAM type: NRG; PAM sequence: GAG
ctgggcagagttgttcacga

SEQ ID NO: 68874 - DNA, 20 bp, Artificial Sequence
  Description of Artificial Sequence: Synthetic oligonucleotide
  Target: ATXN1; (-) strand; PAM type: NRG; PAM sequence: GAG
gactgggcagagttgttcac

SEQ ID NO: 68875 - DNA, 20 bp, Artificial Sequence
  Description of Artificial Sequence: Synthetic oligonucleotide
  Target: ATXN1; (-) strand; PAM type: NRG; PAM sequence: GAG
aactcttctatgactgggca

SEQ ID NO: 68876 - DNA, 20 bp, Artificial Sequence
  Description of Artificial Sequence: Synthetic oligonucleotide
  Target: ATXN1; (-) strand; PAM type: NRG; PAM sequence: CAG
gaaactcttctatgactggg

SEQ ID NO: 68877 - DNA, 20 bp, Artificial Sequence
  Description of Artificial Sequence: Synthetic oligonucleotide
  Target: ATXN1; (-) strand; PAM type: NRG; PAM sequence: GGG
tgggaaactcttctatgact

SEQ ID NO: 68878 - DNA, 20 bp, Artificial Sequence
  Description of Artificial Sequence: Synthetic oligonucleotide
  Target: ATXN1; (-) strand; PAM type: NRG; PAM sequence: TGG
ctgggaaactcttctatgac

SEQ ID NO: 68879 - DNA, 20 bp, Artificial Sequence
  Description of Artificial Sequence: Synthetic oligonucleotide
  Target: ATXN1; (-) strand; PAM type: NRG; PAM sequence: GGG
gggctaaataaatctttcct

SEQ ID NO: 68880 - DNA, 20 bp, Artificial Sequence
  Description of Artificial Sequence: Synthetic oligonucleotide
  Target: ATXN1; (-) strand; PAM type: NRG; PAM sequence: TGG
tgggctaaataaatctttcc

SEQ ID NO: 68881 - DNA, 20 bp, Artificial Sequence
  Description of Artificial Sequence: Synthetic oligonucleotide
  Target: ATXN1; (-) strand; PAM type: NRG; PAM sequence: GGG
agtcagatacatgcatattt

SEQ ID NO: 68882 - DNA, 20 bp, Artificial Sequence
  Description of Artificial Sequence: Synthetic oligonucleotide
  Target: ATXN1; (-) strand; PAM type: NRG; PAM sequence: TGG
aagtcagatacatgcatatt

SEQ ID NO: 68883 - DNA, 20 bp, Artificial Sequence
  Description of Artificial Sequence: Synthetic oligonucleotide
  Target: ATXN1; (-) strand; PAM type: NRG; PAM sequence: CAG
atgagatgtcccccaaaagt

SEQ ID NO: 68884 - DNA, 20 bp, Artificial Sequence
  Description of Artificial Sequence: Synthetic oligonucleotide
  Target: ATXN1; (-) strand; PAM type: NRG; PAM sequence: AAG
ttaaatgagatgtcccccaa

SEQ ID NO: 68885 - DNA, 20 bp, Artificial Sequence
  Description of Artificial Sequence: Synthetic oligonucleotide
  Target: ATXN1; (-) strand; PAM type: NRG; PAM sequence: GAG
aagcctaatttttgttaaat

SEQ ID NO: 68886 - DNA, 20 bp, Artificial Sequence
  Description of Artificial Sequence: Synthetic oligonucleotide
  Target: ATXN1; (-) strand; PAM type: NRG; PAM sequence: AAG
aggttaaaaggagaaatcag

SEQ ID NO: 68887 - DNA, 20 bp, Artificial Sequence
  Description of Artificial Sequence: Synthetic oligonucleotide
  Target: ATXN1; (-) strand; PAM type: NRG; PAM sequence: CAG
aagaggttaaaaggagaaat

SEQ ID NO: 68888 - DNA, 20 bp, Artificial Sequence
  Description of Artificial Sequence: Synthetic oligonucleotide
  Target: ATXN1; (-) strand; PAM type: NRG; PAM sequence: GAG
tctgtaaaagaggttaaaag

SEQ ID NO: 68889 - DNA, 20 bp, Artificial Sequence
  Description of Artificial Sequence: Synthetic oligonucleotide
  Target: ATXN1; (-) strand; PAM type: NRG; PAM sequence: AGG
tttctgtaaaagaggttaaa

SEQ ID NO: 68890 - DNA, 20 bp, Artificial Sequence
  Description of Artificial Sequence: Synthetic oligonucleotide
  Target: ATXN1; (-) strand; PAM type: NRG; PAM sequence: AAG
ttttctgtaaaagaggttaa

SEQ ID NO: 68891 - DNA, 20 bp, Artificial Sequence
  Description of Artificial Sequence: Synthetic oligonucleotide
  Target: ATXN1; (-) strand; PAM type: NRG; PAM sequence: AGG
ggggcagttttctgtaaaag

SEQ ID NO: 68892 - DNA, 20 bp, Artificial Sequence
  Description of Artificial Sequence: Synthetic oligonucleotide
  Target: ATXN1; (-) strand; PAM type: NRG; PAM sequence: GAG
gggggcagttttctgtaaaa

SEQ ID NO: 68893 - DNA, 20 bp, Artificial Sequence
  Description of Artificial Sequence: Synthetic oligonucleotide
  Target: ATXN1; (-) strand; PAM type: NRG; PAM sequence: AAG
aggggggcagttttctgtaa

SEQ ID NO: 68894 - DNA, 20 bp, Artificial Sequence
  Description of Artificial Sequence: Synthetic oligonucleotide
  Target: ATXN1; (-) strand; PAM type: NRG; PAM sequence: CAG
cctttcactgctaagggggg

SEQ ID NO: 68895 - DNA, 20 bp, Artificial Sequence
  Description of Artificial Sequence: Synthetic oligonucleotide
  Target: ATXN1; (-) strand; PAM type: NRG; PAM sequence: GGG
ctgcctttcactgctaaggg

SEQ ID NO: 68896 - DNA, 20 bp, Artificial Sequence
  Description of Artificial Sequence: Synthetic oligonucleotide
  Target: ATXN1; (-) strand; PAM type: NRG; PAM sequence: GGG
gctgcctttcactgctaagg

SEQ ID NO: 68897 - DNA, 20 bp, Artificial Sequence
  Description of Artificial Sequence: Synthetic oligonucleotide
  Target: ATXN1; (-) strand; PAM type: NRG; PAM sequence: GGG
tgctgcctttcactgctaag

SEQ ID NO: 68898 - DNA, 20 bp, Artificial Sequence
  Description of Artificial Sequence: Synthetic oligonucleotide
  Target: ATXN1; (-) strand; PAM type: NRG; PAM sequence: GGG
gtgctgcctttcactgctaa

SEQ ID NO: 68899 - DNA, 20 bp, Artificial Sequence
  Description of Artificial Sequence: Synthetic oligonucleotide
  Target: ATXN1; (-) strand; PAM type: NRG; PAM sequence: AGG
agtgctgcctttcactgcta

SEQ ID NO: 68900 - DNA, 20 bp, Artificial Sequence
  Description of Artificial Sequence: Synthetic oligonucleotide
  Target: ATXN1; (-) strand; PAM type: NRG; PAM sequence: AAG
aagtgctgcctttcactgct

SEQ ID NO: 68901 - DNA, 20 bp, Artificial Sequence
  Description of Artificial Sequence: Synthetic oligonucleotide
  Target: ATXN1; (-) strand; PAM type: NRG; PAM sequence: AAG
ttgcaatagcacattggcaa

SEQ ID NO: 68902 - DNA, 20 bp, Artificial Sequence
  Description of Artificial Sequence: Synthetic oligonucleotide
  Target: ATXN1; (-) strand; PAM type: NRG; PAM sequence: TGG
agcacattgcaatagcacat

SEQ ID NO: 68903 - DNA, 20 bp, Artificial Sequence
  Description of Artificial Sequence: Synthetic oligonucleotide
  Target: ATXN1; (-) strand; PAM type: NRG; PAM sequence: TAG
attgcagtagcacattgcaa

SEQ ID NO: 68904 - DNA, 20 bp, Artificial Sequence
  Description of Artificial Sequence: Synthetic oligonucleotide
  Target: ATXN1; (-) strand; PAM type: NRG; PAM sequence: TAG
aattgcattgcacattgcag

SEQ ID NO: 68905 - DNA, 20 bp, Artificial Sequence
  Description of Artificial Sequence: Synthetic oligonucleotide
  Target: ATXN1; (-) strand; PAM type: NRG; PAM sequence: CAG
cctaattgcattgcacattg

SEQ ID NO: 68906 - DNA, 20 bp, Artificial Sequence
  Description of Artificial Sequence: Synthetic oligonucleotide
  Target: ATXN1; (-) strand; PAM type: NRG; PAM sequence: TAG
gccttttgtctattatttaa

SEQ ID NO: 68907 - DNA, 20 bp, Artificial Sequence
  Description of Artificial Sequence: Synthetic oligonucleotide
  Target: ATXN1; (-) strand; PAM type: NRG; PAM sequence: TGG
ttttgctaattaataaacat

SEQ ID NO: 68908 - DNA, 20 bp, Artificial Sequence
  Description of Artificial Sequence: Synthetic oligonucleotide
  Target: ATXN1; (-) strand; PAM type: NRG; PAM sequence: TGG
tctagagctcatatcctata

SEQ ID NO: 68909 - DNA, 20 bp, Artificial Sequence
  Description of Artificial Sequence: Synthetic oligonucleotide
  Target: ATXN1; (-) strand; PAM type: NRG; PAM sequence: GAG
ataaagctctgcagagtcta

SEQ ID NO: 68910 - DNA, 20 bp, Artificial Sequence
  Description of Artificial Sequence: Synthetic oligonucleotide
  Target: ATXN1; (-) strand; PAM type: NRG; PAM sequence: TAG
atataaagctctgcagagtc

SEQ ID NO: 68911 - DNA, 20 bp, Artificial Sequence
  Description of Artificial Sequence: Synthetic oligonucleotide
  Target: ATXN1; (-) strand; PAM type: NRG; PAM sequence: GAG
gtggaatataaagctctgca

SEQ ID NO: 68912 - DNA, 20 bp, Artificial Sequence
  Description of Artificial Sequence: Synthetic oligonucleotide
  Target: ATXN1; (-) strand; PAM type: NRG; PAM sequence: CAG
atgtggaatataaagctctg

SEQ ID NO: 68913 - DNA, 20 bp, Artificial Sequence
  Description of Artificial Sequence: Synthetic oligonucleotide
  Target: ATXN1; (-) strand; PAM type: NRG; PAM sequence: AAG
gagggtccatgtggaatata

SEQ ID NO: 68914 - DNA, 20 bp, Artificial Sequence
  Description of Artificial Sequence: Synthetic oligonucleotide
  Target: ATXN1; (-) strand; PAM type: NRG; PAM sequence: TGG
aaatgattggagggtccatg

SEQ ID NO: 68915 - DNA, 20 bp, Artificial Sequence
  Description of Artificial Sequence: Synthetic oligonucleotide
  Target: ATXN1; (-) strand; PAM type: NRG; PAM sequence: GGG
aagccacaaaaatgattgga

SEQ ID NO: 68916 - DNA, 20 bp, Artificial Sequence
  Description of Artificial Sequence: Synthetic oligonucleotide
  Target: ATXN1; (-) strand; PAM type: NRG; PAM sequence: AGG
caagccacaaaaatgattgg

SEQ ID NO: 68917 - DNA, 20 bp, Artificial Sequence
  Description of Artificial Sequence: Synthetic oligonucleotide
  Target: ATXN1; (-) strand; PAM type: NRG; PAM sequence: GAG
ccaagccacaaaaatgattg

SEQ ID NO: 68918 - DNA, 20 bp, Artificial Sequence
  Description of Artificial Sequence: Synthetic oligonucleotide
  Target: ATXN1; (-) strand; PAM type: NRG; PAM sequence: TGG
atccaagccacaaaaatgat

SEQ ID NO: 68919 - DNA, 20 bp, Artificial Sequence
  Description of Artificial Sequence: Synthetic oligonucleotide
  Target: ATXN1; (-) strand; PAM type: NRG; PAM sequence: AAG
accagtgctgaaatccatcc

SEQ ID NO: 68920 - DNA, 20 bp, Artificial Sequence
  Description of Artificial Sequence: Synthetic oligonucleotide
  Target: ATXN1; (-) strand; PAM type: NRG; PAM sequence: CAG
tctttgaccatgataagtac

SEQ ID NO: 68921 - DNA, 20 bp, Artificial Sequence
  Description of Artificial Sequence: Synthetic oligonucleotide
  Target: ATXN1; (-) strand; PAM type: NRG; PAM sequence: AAG
gatgtatctttgaccatgat

SEQ ID NO: 68922 - DNA, 20 bp, Artificial Sequence
  Description of Artificial Sequence: Synthetic oligonucleotide
  Target: ATXN1; (-) strand; PAM type: NRG; PAM sequence: GAG
atgaaaatgtgtattgacta

SEQ ID NO: 68923 - DNA, 20 bp, Artificial Sequence
  Description of Artificial Sequence: Synthetic oligonucleotide
  Target: ATXN1; (-) strand; PAM type: NRG; PAM sequence: TAG
taatgaaaatgtgtattgac

SEQ ID NO: 68924 - DNA, 20 bp, Artificial Sequence
  Description of Artificial Sequence: Synthetic oligonucleotide
  Target: ATXN1; (-) strand; PAM type: NRG; PAM sequence: TGG
tgagtaaataaccaagttta

SEQ ID NO: 68925 - DNA, 20 bp, Artificial Sequence
  Description of Artificial Sequence: Synthetic oligonucleotide
  Target: ATXN1; (-) strand; PAM type: NRG; PAM sequence: AAG
ggtagaatgagtaaataacc

SEQ ID NO: 68926 - DNA, 20 bp, Artificial Sequence
  Description of Artificial Sequence: Synthetic oligonucleotide
  Target: ATXN1; (-) strand; PAM type: NRG; PAM sequence: GAG
gtaagagttgaaggtagaat

SEQ ID NO: 68927 - DNA, 20 bp, Artificial Sequence
  Description of Artificial Sequence: Synthetic oligonucleotide
  Target: ATXN1; (-) strand; PAM type: NRG; PAM sequence: TAG
ggccaagtaagagttgaagg

SEQ ID NO: 68928 - DNA, 20 bp, Artificial Sequence
  Description of Artificial Sequence: Synthetic oligonucleotide
  Target: ATXN1; (-) strand; PAM type: NRG; PAM sequence: AGG
taaggccaagtaagagttga

SEQ ID NO: 68929 - DNA, 20 bp, Artificial Sequence
  Description of Artificial Sequence: Synthetic oligonucleotide
  Target: ATXN1; (-) strand; PAM type: NRG; PAM sequence: AAG
ctaaggccaagtaagagttg

SEQ ID NO: 68930 - DNA, 20 bp, Artificial Sequence
  Description of Artificial Sequence: Synthetic oligonucleotide
  Target: ATXN1; (-) strand; PAM type: NRG; PAM sequence: GAG
catttcctaaggccaagtaa

SEQ ID NO: 68931 - DNA, 20 bp, Artificial Sequence
  Description of Artificial Sequence: Synthetic oligonucleotide
  Target: ATXN1; (-) strand; PAM type: NRG; PAM sequence: AAG
tacatttcctaaggccaagt

SEQ ID NO: 68932 - DNA, 20 bp, Artificial Sequence
  Description of Artificial Sequence: Synthetic oligonucleotide
  Target: ATXN1; (-) strand; PAM type: NRG; PAM sequence: AAG
attttacatttcctaaggcc

SEQ ID NO: 68933 - DNA, 20 bp, Artificial Sequence
  Description of Artificial Sequence: Synthetic oligonucleotide
  Target: ATXN1; (-) strand; PAM type: NRG; PAM sequence: AGG
aaaagattttacatttccta

SEQ ID NO: 68934 - DNA, 20 bp, Artificial Sequence
  Description of Artificial Sequence: Synthetic oligonucleotide
  Target: ATXN1; (-) strand; PAM type: NRG; PAM sequence: AAG
aaaaagattttacatttcct

SEQ ID NO: 68935 - DNA, 20 bp, Artificial Sequence
  Description of Artificial Sequence: Synthetic oligonucleotide
  Target: ATXN1; (-) strand; PAM type: NRG; PAM sequence: AAG
ctcttatcaaaaaaaaaaaa

SEQ ID NO: 68936 - DNA, 20 bp, Artificial Sequence
  Description of Artificial Sequence: Synthetic oligonucleotide
  Target: ATXN1; (-) strand; PAM type: NRG; PAM sequence: AAG
ttttaattaactcctatttc

SEQ ID NO: 68937 - DNA, 20 bp, Artificial Sequence
  Description of Artificial Sequence: Synthetic oligonucleotide
  Target: ATXN1; (-) strand; PAM type: NRG; PAM sequence: AGG
tctcatgtttgaatcacaag

SEQ ID NO: 68938 - DNA, 20 bp, Artificial Sequence
  Description of Artificial Sequence: Synthetic oligonucleotide
  Target: ATXN1; (-) strand; PAM type: NRG; PAM sequence: GAG
atctcatgtttgaatcacaa

SEQ ID NO: 68939 - DNA, 20 bp, Artificial Sequence
  Description of Artificial Sequence: Synthetic oligonucleotide
  Target: ATXN1; (-) strand; PAM type: NRG; PAM sequence: AAG
taatctcatgtttgaatcac

SEQ ID NO: 68940 - DNA, 20 bp, Artificial Sequence
  Description of Artificial Sequence: Synthetic oligonucleotide
  Target: ATXN1; (-) strand; PAM type: NRG; PAM sequence: AAG
atagattttaccttttataa

SEQ ID NO: 68941 - DNA, 20 bp, Artificial Sequence
  Description of Artificial Sequence: Synthetic oligonucleotide
  Target: ATXN1; (-) strand; PAM type: NRG; PAM sequence: TAG
acacttaaaatgctctgaaa

SEQ ID NO: 68942 - DNA, 20 bp, Artificial Sequence
  Description of Artificial Sequence: Synthetic oligonucleotide
  Target: ATXN1; (-) strand; PAM type: NRG; PAM sequence: CGG
caagcatcggaattcaggga

SEQ ID NO: 68943 - DNA, 20 bp, Artificial Sequence
  Description of Artificial Sequence: Synthetic oligonucleotide
  Target: ATXN1; (-) strand; PAM type: NRG; PAM sequence: GGG
ttgtcaagcatcggaattca

SEQ ID NO: 68944 - DNA, 20 bp, Artificial Sequence
  Description of Artificial Sequence: Synthetic oligonucleotide
  Target: ATXN1; (-) strand; PAM type: NRG; PAM sequence: AGG
tttgtcaagcatcggaattc

SEQ ID NO: 68945 - DNA, 20 bp, Artificial Sequence
  Description of Artificial Sequence: Synthetic oligonucleotide
  Target: ATXN1; (-) strand; PAM type: NRG; PAM sequence: CAG
atttgtcaagcatcggaatt

SEQ ID NO: 68946 - DNA, 20 bp, Artificial Sequence
  Description of Artificial Sequence: Synthetic oligonucleotide
  Target: ATXN1; (-) strand; PAM type: NRG; PAM sequence: CGG
ctaatgaatttgtcaagcat

SEQ ID NO: 68947 - DNA, 20 bp, Artificial Sequence
  Description of Artificial Sequence: Synthetic oligonucleotide
  Target: ATXN1; (-) strand; PAM type: NRG; PAM sequence: AAG
ttattgctaatgaatttgtc

SEQ ID NO: 68948 - DNA, 20 bp, Artificial Sequence
  Description of Artificial Sequence: Synthetic oligonucleotide
  Target: ATXN1; (-) strand; PAM type: NRG; PAM sequence: AGG
agcaaggaaatactctagac

SEQ ID NO: 68949 - DNA, 20 bp, Artificial Sequence
  Description of Artificial Sequence: Synthetic oligonucleotide
  Target: ATXN1; (-) strand; PAM type: NRG; PAM sequence: CAG
tagcaaggaaatactctaga

SEQ ID NO: 68950 - DNA, 20 bp, Artificial Sequence
  Description of Artificial Sequence: Synthetic oligonucleotide
  Target: ATXN1; (-) strand; PAM type: NRG; PAM sequence: TAG
agaatagcaaggaaatactc

SEQ ID NO: 68951 - DNA, 20 bp, Artificial Sequence
  Description of Artificial Sequence: Synthetic oligonucleotide
  Target: ATXN1; (-) strand; PAM type: NRG; PAM sequence: AGG
atttgctgcgtagaatagca

SEQ ID NO: 68952 - DNA, 20 bp, Artificial Sequence
  Description of Artificial Sequence: Synthetic oligonucleotide
  Target: ATXN1; (-) strand; PAM type: NRG; PAM sequence: AAG
gatttgctgcgtagaatagc

SEQ ID NO: 68953 - DNA, 20 bp, Artificial Sequence
  Description of Artificial Sequence: Synthetic oligonucleotide
  Target: ATXN1; (-) strand; PAM type: NRG; PAM sequence: TAG
cattgatttgctgcgtagaa

SEQ ID NO: 68954 - DNA, 20 bp, Artificial Sequence
  Description of Artificial Sequence: Synthetic oligonucleotide
  Target: ATXN1; (-) strand; PAM type: NRG; PAM sequence: TAG
gaggccattgatttgctgcg

SEQ ID NO: 68955 - DNA, 20 bp, Artificial Sequence
  Description of Artificial Sequence: Synthetic oligonucleotide
  Target: ATXN1; (-) strand; PAM type: NRG; PAM sequence: AGG
ttatcctgtggcggttggcg

SEQ ID NO: 68956 - DNA, 20 bp, Artificial Sequence
  Description of Artificial Sequence: Synthetic oligonucleotide
  Target: ATXN1; (-) strand; PAM type: NRG; PAM sequence: GAG
tttatcctgtggcggttggc

SEQ ID NO: 68957 - DNA, 20 bp, Artificial Sequence
  Description of Artificial Sequence: Synthetic oligonucleotide
  Target: ATXN1; (-) strand; PAM type: NRG; PAM sequence: TGG
cacttttatcctgtggcggt

SEQ ID NO: 68958 - DNA, 20 bp, Artificial Sequence
  Description of Artificial Sequence: Synthetic oligonucleotide
  Target: ATXN1; (-) strand; PAM type: NRG; PAM sequence: CGG
cacacacttttatcctgtgg

SEQ ID NO: 68959 - DNA, 20 bp, Artificial Sequence
  Description of Artificial Sequence: Synthetic oligonucleotide
  Target: ATXN1; (-) strand; PAM type: NRG; PAM sequence: TGG
atacacacacttttatcctg

SEQ ID NO: 68960 - DNA, 20 bp, Artificial Sequence
  Description of Artificial Sequence: Synthetic oligonucleotide
  Target: ATXN1; (-) strand; PAM type: NRG; PAM sequence: CAG
tgtcggtggcatcacgttgg

SEQ ID NO: 68961 - DNA, 20 bp, Artificial Sequence
  Description of Artificial Sequence: Synthetic oligonucleotide
  Target: ATXN1; (-) strand; PAM type: NRG; PAM sequence: TGG
ccctgtcggtggcatcacgt

SEQ ID NO: 68962 - DNA, 20 bp, Artificial Sequence
  Description of Artificial Sequence: Synthetic oligonucleotide
  Target: ATXN1; (-) strand; PAM type: NRG; PAM sequence: TGG
gagttggctctccctgtcgg

SEQ ID NO: 68963 - DNA, 20 bp, Artificial Sequence
  Description of Artificial Sequence: Synthetic oligonucleotide
  Target: ATXN1; (-) strand; PAM type: NRG; PAM sequence: CGG
gcagagttggctctccctgt

SEQ ID NO: 68964 - DNA, 20 bp, Artificial Sequence
  Description of Artificial Sequence: Synthetic oligonucleotide
  Target: ATXN1; (-) strand; PAM type: NRG; PAM sequence: TGG
tctcggagggtgagcagagt

SEQ ID NO: 68965 - DNA, 20 bp, Artificial Sequence
  Description of Artificial Sequence: Synthetic oligonucleotide
  Target: ATXN1; (-) strand; PAM type: NRG; PAM sequence: GAG
tccttctcggagggtgagca

SEQ ID NO: 68966 - DNA, 20 bp, Artificial Sequence
  Description of Artificial Sequence: Synthetic oligonucleotide
  Target: ATXN1; (-) strand; PAM type: NRG; PAM sequence: CAG
agtccttctcggagggtgag

SEQ ID NO: 68967 - DNA, 20 bp, Artificial Sequence
  Description of Artificial Sequence: Synthetic oligonucleotide
  Target: ATXN1; (-) strand; PAM type: NRG; PAM sequence: GAG
tagagtccttctcggagggt

SEQ ID NO: 68968 - DNA, 20 bp, Artificial Sequence
  Description of Artificial Sequence: Synthetic oligonucleotide
  Target: ATXN1; (-) strand; PAM type: NRG; PAM sequence: GGG
gcactagagtccttctcgga

SEQ ID NO: 68969 - DNA, 20 bp, Artificial Sequence
  Description of Artificial Sequence: Synthetic oligonucleotide
  Target: ATXN1; (-) strand; PAM type: NRG; PAM sequence: AGG
tgcactagagtccttctcgg

SEQ ID NO: 68970 - DNA, 20 bp, Artificial Sequence
  Description of Artificial Sequence: Synthetic oligonucleotide
  Target: ATXN1; (-) strand; PAM type: NRG; PAM sequence: GAG
atgcactagagtccttctcg

SEQ ID NO: 68971 - DNA, 20 bp, Artificial Sequence
  Description of Artificial Sequence: Synthetic oligonucleotide
  Target: ATXN1; (-) strand; PAM type: NRG; PAM sequence: CGG
ttatgcactagagtccttct

SEQ ID NO: 68972 - DNA, 20 bp, Artificial Sequence
  Description of Artificial Sequence: Synthetic oligonucleotide
  Target: ATXN1; (-) strand; PAM type: NRG; PAM sequence: GAG
aggcagccacttatgcacta

SEQ ID NO: 68973 - DNA, 20 bp, Artificial Sequence
  Description of Artificial Sequence: Synthetic oligonucleotide
  Target: ATXN1; (-) strand; PAM type: NRG; PAM sequence: TAG
ataggcagccacttatgcac

SEQ ID NO: 68974 - DNA, 20 bp, Artificial Sequence
  Description of Artificial Sequence: Synthetic oligonucleotide
  Target: ATXN1; (-) strand; PAM type: NRG; PAM sequence: CAG
agaacatcccaatacatagg

SEQ ID NO: 68975 - DNA, 20 bp, Artificial Sequence
  Description of Artificial Sequence: Synthetic oligonucleotide
  Target: ATXN1; (-) strand; PAM type: NRG; PAM sequence: AGG
gccagaacatcccaatacat

SEQ ID NO: 68976 - DNA, 20 bp, Artificial Sequence
  Description of Artificial Sequence: Synthetic oligonucleotide
  Target: ATXN1; (-) strand; PAM type: NRG; PAM sequence: TAG
ggccagaacatcccaataca

SEQ ID NO: 68977 - DNA, 20 bp, Artificial Sequence
  Description of Artificial Sequence: Synthetic oligonucleotide
  Target: ATXN1; (-) strand; PAM type: NRG; PAM sequence: CAG
cgtgagccaccgcgcccggc

SEQ ID NO: 68978 - DNA, 20 bp, Artificial Sequence
  Description of Artificial Sequence: Synthetic oligonucleotide
  Target: ATXN1; (-) strand; PAM type: NRG; PAM sequence: CGG
catgcgtgagccaccgcgcc

SEQ ID NO: 68979 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacatgcgt

SEQ ID NO: 68980 - DNA, 20 bp, Artificial Sequence
  Description of Artificial Sequence: Synthetic oligonucleotide
  Target: ATXN1; (-) strand; PAM type: NRG; PAM sequence: GGG
ccccagcctcccaaagtgct

SEQ ID NO: 68981 - DNA, 20 bp, Artificial Sequence
  Description of Artificial Sequence: Synthetic oligonucleotide
  Target: ATXN1; (-) strand; PAM type: NRG; PAM sequence: TGG
gccccagcctcccaaagtgc

SEQ ID NO: 68982 - DNA, 20 bp, Artificial Sequence
  Description of Artificial Sequence: Synthetic oligonucleotide
  Target: ATXN1; (-) strand; PAM type: NRG; PAM sequence: AAG
ccatctgccccagcctccca

SEQ ID NO: 68983 - DNA, 20 bp, Artificial Sequence
  Description of Artificial Sequence: Synthetic oligonucleotide
  Target: ATXN1; (-) strand; PAM type: NRG; PAM sequence: CAG
ctcaggtgatccatctgccc

SEQ ID NO: 68984 - DNA, 20 bp, Artificial Sequence
  Description of Artificial Sequence: Synthetic oligonucleotide
  Target: ATXN1; (-) strand; PAM type: NRG; PAM sequence: AGG
catcttgaactcttgacctc

SEQ ID NO: 68985 - DNA, 20 bp, Artificial Sequence
  Description of Artificial Sequence: Synthetic oligonucleotide
  Target: ATXN1; (-) strand; PAM type: NRG; PAM sequence: CAG
ccatcttgaactcttgacct

SEQ ID NO: 68986 - DNA, 20 bp, Artificial Sequence
  Description of Artificial Sequence: Synthetic oligonucleotide
  Target: ATXN1; (-) strand; PAM type: NRG; PAM sequence: AAG
agtgtttcactgtgctgacc

SEQ ID NO: 68987 - DNA, 20 bp, Artificial Sequence
  Description of Artificial Sequence: Synthetic oligonucleotide
  Target: ATXN1; (-) strand; PAM type: NRG; PAM sequence: CAG
ttgcgtctttttagtagtga

SEQ ID NO: 68988 - DNA, 20 bp, Artificial Sequence
  Description of Artificial Sequence: Synthetic oligonucleotide
  Target: ATXN1; (-) strand; PAM type: NRG; PAM sequence: TAG
ctaattttgcgtctttttag

SEQ ID NO: 68989 - DNA, 20 bp, Artificial Sequence
  Description of Artificial Sequence: Synthetic oligonucleotide
  Target: ATXN1; (-) strand; PAM type: NRG; PAM sequence: TAG
cagctaattttgcgtctttt

SEQ ID NO: 68990 - DNA, 20 bp, Artificial Sequence
  Description of Artificial Sequence: Synthetic oligonucleotide
  Target: ATXN1; (-) strand; PAM type: NRG; PAM sequence: CAG
caggcacctgccaccacgtc

SEQ ID NO: 68991 - DNA, 20 bp, Artificial Sequence
  Description of Artificial Sequence: Synthetic oligonucleotide
  Target: ATXN1; (-) strand; PAM type: NRG; PAM sequence: AGG
tgccgactagcagggattac

SEQ ID NO: 68992 - DNA, 20 bp, Artificial Sequence
  Description of Artificial Sequence: Synthetic oligonucleotide
  Target: ATXN1; (-) strand; PAM type: NRG; PAM sequence: CAG
ctgccgactagcagggatta

SEQ ID NO: 68993 - DNA, 20 bp, Artificial Sequence
  Description of Artificial Sequence: Synthetic oligonucleotide
  Target: ATXN1; (-) strand; PAM type: NRG; PAM sequence: GGG
ccccagcctgccgactagca

SEQ ID NO: 68994 - DNA, 20 bp, Artificial Sequence
  Description of Artificial Sequence: Synthetic oligonucleotide
  Target: ATXN1; (-) strand; PAM type: NRG; PAM sequence: AGG
gccccagcctgccgactagc

SEQ ID NO: 68995 - DNA, 20 bp, Artificial Sequence
  Description of Artificial Sequence: Synthetic oligonucleotide
  Target: ATXN1; (-) strand; PAM type: NRG; PAM sequence: CAG
tgccccagcctgccgactag

SEQ ID NO: 68996 - DNA, 20 bp, Artificial Sequence
  Description of Artificial Sequence: Synthetic oligonucleotide
  Target: ATXN1; (-) strand; PAM type: NRG; PAM sequence: TAG
tcctgccccagcctgccgac

SEQ ID NO: 68997 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgccc

SEQ ID NO: 68998 - DNA, 20 bp, Artificial Sequence
  Description of Artificial Sequence: Synthetic oligonucleotide
  Target: ATXN1; (-) strand; PAM type: NRG; PAM sequence: AAG
aacctctacctcctgggttc

SEQ ID NO: 68999 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctacctcct

SEQ ID NO: 69000 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctctacctcc

SEQ ID NO: 69001 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggtgcagtct

SEQ ID NO: 69002 - DNA, 20 bp, Artificial Sequence
  Description of Artificial Sequence: Synthetic oligonucleotide
  Target: ATXN1; (-) strand; PAM type: NRG; PAM sequence: CAG
cagactggagtgcagtggtg

SEQ ID NO: 69003 - DNA, 20 bp, Artificial Sequence
  Description of Artificial Sequence: Synthetic oligonucleotide
  Target: ATXN1; (-) strand; PAM type: NRG; PAM sequence: TGG
ttgcccagactggagtgcag

SEQ ID NO: 69004 - DNA, 20 bp, Artificial Sequence
  Description of Artificial Sequence: Synthetic oligonucleotide
  Target: ATXN1; (-) strand; PAM type: NRG; PAM sequence: CAG
ttgttgcccagactggagtg

SEQ ID NO: 69005 - DNA, 20 bp, Artificial Sequence
  Description of Artificial Sequence: Synthetic oligonucleotide
  Target: ATXN1; (-) strand; PAM type: NRG; PAM sequence: GAG
cactcttgttgcccagactg

SEQ ID NO: 69006 - DNA, 20 bp, Artificial Sequence
  Description of Artificial Sequence: Synthetic oligonucleotide
  Target: ATXN1; (-) strand; PAM type: NRG; PAM sequence: TGG
ttcactcttgttgcccagac

SEQ ID NO: 69007 - DNA, 20 bp, Artificial Sequence
  Description of Artificial Sequence: Synthetic oligonucleotide
  Target: ATXN1; (-) strand; PAM type: NRG; PAM sequence: CAG
agagtttcactcttgttgcc

SEQ ID NO: 69008 - DNA, 20 bp, Artificial Sequence
  Description of Artificial Sequence: Synthetic oligonucleotide
  Target: ATXN1; (-) strand; PAM type: NRG; PAM sequence: GAG
tttttcttttttttgagaca

SEQ ID NO: 69009 - DNA, 20 bp, Artificial Sequence
  Description of Artificial Sequence: Synthetic oligonucleotide
  Target: ATXN1; (-) strand; PAM type: NRG; PAM sequence: CAG
tttttttcttttttttgaga

SEQ ID NO: 69010 - DNA, 20 bp, Artificial Sequence
  Description of Artificial Sequence: Synthetic oligonucleotide
  Target: ATXN1; (-) strand; PAM type: NRG; PAM sequence: GAG
tttctttttttctttttttt

SEQ ID NO: 69011 - DNA, 20 bp, Artificial Sequence
  Description of Artificial Sequence: Synthetic oligonucleotide
  Target: ATXN1; (-) strand; PAM type: NRG; PAM sequence: TAG
tatcatggttgtatttcagt

SEQ ID NO: 69012 - DNA, 20 bp, Artificial Sequence
  Description of Artificial Sequence: Synthetic oligonucleotide
  Target: ATXN1; (-) strand; PAM type: NRG; PAM sequence: CAG
cctgtatcatggttgtattt

SEQ ID NO: 69013 - DNA, 20 bp, Artificial Sequence
  Description of Artificial Sequence: Synthetic oligonucleotide
  Target: ATXN1; (-) strand; PAM type: NRG; PAM sequence: TGG
gtctgtttttgcctgtatca

SEQ ID NO: 69014 - DNA, 20 bp, Artificial Sequence
  Description of Artificial Sequence: Synthetic oligonucleotide
  Target: ATXN1; (-) strand; PAM type: NRG; PAM sequence: AAG
cttttttagcttccaaatcg

SEQ ID NO: 69015 - DNA, 20 bp, Artificial Sequence
  Description of Artificial Sequence: Synthetic oligonucleotide
  Target: ATXN1; (-) strand; PAM type: NRG; PAM sequence: TAG
cctggccaagacaccttttt

SEQ ID NO: 69016 - DNA, 20 bp, Artificial Sequence
  Description of Artificial Sequence: Synthetic oligonucleotide
  Target: ATXN1; (-) strand; PAM type: NRG; PAM sequence: AAG
gtgagccaccgcacctggcc

SEQ ID NO: 69017 - DNA, 20 bp, Artificial Sequence
  Description of Artificial Sequence: Synthetic oligonucleotide
  Target: ATXN1; (-) strand; PAM type: NRG; PAM sequence: TGG
caggtgtgagccaccgcacc

SEQ ID NO: 69018 - DNA, 20 bp, Artificial Sequence
  Description of Artificial Sequence: Synthetic oligonucleotide
  Target: ATXN1; (-) strand; PAM type: NRG; PAM sequence: GAG
agtgctggtattacaggtgt

SEQ ID NO: 69019 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctggtattac

SEQ ID NO: 69020 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctggtatta

SEQ ID NO: 69021 - DNA, 20 bp, Artificial Sequence
  Description of Artificial Sequence: Synthetic oligonucleotide
  Target: ATXN1; (-) strand; PAM type: NRG; PAM sequence: TGG
accttggcctcccaaagtgc

SEQ ID NO: 69022 - DNA, 20 bp, Artificial Sequence
  Description of Artificial Sequence: Synthetic oligonucleotide
  Target: ATXN1; (-) strand; PAM type: NRG; PAM sequence: AAG
ccgcccaccttggcctccca

SEQ ID NO: 69023 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgatccgcccacct

SEQ ID NO: 69024 - DNA, 20 bp, Artificial Sequence
  Description of Artificial Sequence: Synthetic oligonucleotide
  Target: ATXN1; (-) strand; PAM type: NRG; PAM sequence: AGG
ggtctcaaactcctgacctc

SEQ ID NO: 69025 - DNA, 20 bp, Artificial Sequence
  Description of Artificial Sequence: Synthetic oligonucleotide
  Target: ATXN1; (-) strand; PAM type: NRG; PAM sequence: CAG
tggtctcaaactcctgacct

SEQ ID NO: 69026 - DNA, 20 bp, Artificial Sequence
  Description of Artificial Sequence: Synthetic oligonucleotide
  Target: ATXN1; (-) strand; PAM type: NRG; PAM sequence: TGG
tatcaccatgatggccaggc

SEQ ID NO: 69027 - DNA, 20 bp, Artificial Sequence
  Description of Artificial Sequence: Synthetic oligonucleotide
  Target: ATXN1; (-) strand; PAM type: NRG; PAM sequence: AGG
ggggtatcaccatgatggcc

SEQ ID NO: 69028 - DNA, 20 bp, Artificial Sequence
  Description of Artificial Sequence: Synthetic oligonucleotide
  Target: ATXN1; (-) strand; PAM type: NRG; PAM sequence: CAG
tggggtatcaccatgatggc

SEQ ID NO: 69029 - DNA, 20 bp, Artificial Sequence
  Description of Artificial Sequence: Synthetic oligonucleotide
  Target: ATXN1; (-) strand; PAM type: NRG; PAM sequence: TGG
gagatggggtatcaccatga

SEQ ID NO: 69030 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 69031 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 69032 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 69033 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 69034 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 69035 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtatttt

SEQ ID NO: 69036 - DNA, 20 bp, Artificial Sequence
  Description of Artificial Sequence: Synthetic oligonucleotide
  Target: ATXN1; (-) strand; PAM type: NRG; PAM sequence: TGG
caggcatctgccaccatgcc

SEQ ID NO: 69037 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgagattac

SEQ ID NO: 69038 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgagatta

SEQ ID NO: 69039 - DNA, 20 bp, Artificial Sequence
  Description of Artificial Sequence: Synthetic oligonucleotide
  Target: ATXN1; (-) strand; PAM type: NRG; PAM sequence: GAG
ctttgacctcccaagtagct

SEQ ID NO: 69040 - DNA, 20 bp, Artificial Sequence
  Description of Artificial Sequence: Synthetic oligonucleotide
  Target: ATXN1; (-) strand; PAM type: NRG; PAM sequence: TAG
tcctgctttgacctcccaag

SEQ ID NO: 69041 - DNA, 20 bp, Artificial Sequence
  Description of Artificial Sequence: Synthetic oligonucleotide
  Target: ATXN1; (-) strand; PAM type: NRG; PAM sequence: AAG
ttctcctgctttgacctccc

SEQ ID NO: 69042 - DNA, 20 bp, Artificial Sequence
  Description of Artificial Sequence: Synthetic oligonucleotide
  Target: ATXN1; (-) strand; PAM type: NRG; PAM sequence: AAG
cagcaagctgacctgggttt

SEQ ID NO: 69043 - DNA, 20 bp, Artificial Sequence
  Description of Artificial Sequence: Synthetic oligonucleotide
  Target: ATXN1; (-) strand; PAM type: NRG; PAM sequence: GGG
agttgccagcaagctgacct

SEQ ID NO: 69044 - DNA, 20 bp, Artificial Sequence
  Description of Artificial Sequence: Synthetic oligonucleotide
  Target: ATXN1; (-) strand; PAM type: NRG; PAM sequence: TGG
aagttgccagcaagctgacc

SEQ ID NO: 69045 - DNA, 20 bp, Artificial Sequence
  Description of Artificial Sequence: Synthetic oligonucleotide
  Target: ATXN1; (-) strand; PAM type: NRG; PAM sequence: AAG
taatctgggaagttgccagc

SEQ ID NO: 69046 - DNA, 20 bp, Artificial Sequence
  Description of Artificial Sequence: Synthetic oligonucleotide
  Target: ATXN1; (-) strand; PAM type: NRG; PAM sequence: CAG
gcactaatctgggaagttgc

SEQ ID NO: 69047 - DNA, 20 bp, Artificial Sequence
  Description of Artificial Sequence: Synthetic oligonucleotide
  Target: ATXN1; (-) strand; PAM type: NRG; PAM sequence: AAG
atcaagtgcactaatctggg

SEQ ID NO: 69048 - DNA, 20 bp, Artificial Sequence
  Description of Artificial Sequence: Synthetic oligonucleotide
  Target: ATXN1; (-) strand; PAM type: NRG; PAM sequence: GGG
ttcatcaagtgcactaatct

SEQ ID NO: 69049 - DNA, 20 bp, Artificial Sequence
  Description of Artificial Sequence: Synthetic oligonucleotide
  Target: ATXN1; (-) strand; PAM type: NRG; PAM sequence: TGG
tttcatcaagtgcactaatc

SEQ ID NO: 69050 - DNA, 20 bp, Artificial Sequence
  Description of Artificial Sequence: Synthetic oligonucleotide
  Target: ATXN1; (-) strand; PAM type: NRG; PAM sequence: AAG
ttattacaaggggtttcatc

SEQ ID NO: 69051 - DNA, 20 bp, Artificial Sequence
  Description of Artificial Sequence: Synthetic oligonucleotide
  Target: ATXN1; (-) strand; PAM type: NRG; PAM sequence: GGG
aggaatttaattattacaag

SEQ ID NO: 69052 - DNA, 20 bp, Artificial Sequence
  Description of Artificial Sequence: Synthetic oligonucleotide
  Target: ATXN1; (-) strand; PAM type: NRG; PAM sequence: GGG
aaggaatttaattattacaa

SEQ ID NO: 69053 - DNA, 20 bp, Artificial Sequence
  Description of Artificial Sequence: Synthetic oligonucleotide
  Target: ATXN1; (-) strand; PAM type: NRG; PAM sequence: AGG
gaaggaatttaattattaca

SEQ ID NO: 69054 - DNA, 20 bp, Artificial Sequence
  Description of Artificial Sequence: Synthetic oligonucleotide
  Target: ATXN1; (-) strand; PAM type: NRG; PAM sequence: AAG
ggaaggaatttaattattac

SEQ ID NO: 69055 - DNA, 20 bp, Artificial Sequence
  Description of Artificial Sequence: Synthetic oligonucleotide
  Target: ATXN1; (-) strand; PAM type: NRG; PAM sequence: AGG
atatttcttgtgccggtgga

SEQ ID NO: 69056 - DNA, 20 bp, Artificial Sequence
  Description of Artificial Sequence: Synthetic oligonucleotide
  Target: ATXN1; (-) strand; PAM type: NRG; PAM sequence: AAG
catatttcttgtgccggtgg

SEQ ID NO: 69057 - DNA, 20 bp, Artificial Sequence
  Description of Artificial Sequence: Synthetic oligonucleotide
  Target: ATXN1; (-) strand; PAM type: NRG; PAM sequence: TGG
ggacatatttcttgtgccgg

SEQ ID NO: 69058 - DNA, 20 bp, Artificial Sequence
  Description of Artificial Sequence: Synthetic oligonucleotide
  Target: ATXN1; (-) strand; PAM type: NRG; PAM sequence: CGG
agtggacatatttcttgtgc

SEQ ID NO: 69059 - DNA, 20 bp, Artificial Sequence
  Description of Artificial Sequence: Synthetic oligonucleotide
  Target: ATXN1; (-) strand; PAM type: NRG; PAM sequence: TGG
aaggaaattcctattttcag

SEQ ID NO: 69060 - DNA, 20 bp, Artificial Sequence
  Description of Artificial Sequence: Synthetic oligonucleotide
  Target: ATXN1; (-) strand; PAM type: NRG; PAM sequence: CAG
agaaaggaaattcctatttt

SEQ ID NO: 69061 - DNA, 20 bp, Artificial Sequence
  Description of Artificial Sequence: Synthetic oligonucleotide
  Target: ATXN1; (-) strand; PAM type: NRG; PAM sequence: AGG
tcttgagggcaaagagagaa

SEQ ID NO: 69062 - DNA, 20 bp, Artificial Sequence
  Description of Artificial Sequence: Synthetic oligonucleotide
  Target: ATXN1; (-) strand; PAM type: NRG; PAM sequence: AAG
gtcttgagggcaaagagaga

SEQ ID NO: 69063 - DNA, 20 bp, Artificial Sequence
  Description of Artificial Sequence: Synthetic oligonucleotide
  Target: ATXN1; (-) strand; PAM type: NRG; PAM sequence: GAG
gaaggtcttgagggcaaaga

SEQ ID NO: 69064 - DNA, 20 bp, Artificial Sequence
  Description of Artificial Sequence: Synthetic oligonucleotide
  Target: ATXN1; (-) strand; PAM type: NRG; PAM sequence: GAG
gtgaaggtcttgagggcaaa

SEQ ID NO: 69065 - DNA, 20 bp, Artificial Sequence
  Description of Artificial Sequence: Synthetic oligonucleotide
  Target: ATXN1; (-) strand; PAM type: NRG; PAM sequence: AAG
tggtgaaggtcttgagggca

SEQ ID NO: 69066 - DNA, 20 bp, Artificial Sequence
  Description of Artificial Sequence: Synthetic oligonucleotide
  Target: ATXN1; (-) strand; PAM type: NRG; PAM sequence: GGG
ctgggtggtgaaggtcttga

SEQ ID NO: 69067 - DNA, 20 bp, Artificial Sequence
  Description of Artificial Sequence: Synthetic oligonucleotide
  Target: ATXN1; (-) strand; PAM type: NRG; PAM sequence: AGG
cctgggtggtgaaggtcttg

SEQ ID NO: 69068 - DNA, 20 bp, Artificial Sequence
  Description of Artificial Sequence: Synthetic oligonucleotide
  Target: ATXN1; (-) strand; PAM type: NRG; PAM sequence: GAG
tcctgggtggtgaaggtctt

SEQ ID NO: 69069 - DNA, 20 bp, Artificial Sequence
  Description of Artificial Sequence: Synthetic oligonucleotide
  Target: ATXN1; (-) strand; PAM type: NRG; PAM sequence: AGG
ctcactgtcctgggtggtga

SEQ ID NO: 69070 - DNA, 20 bp, Artificial Sequence
  Description of Artificial Sequence: Synthetic oligonucleotide
  Target: ATXN1; (-) strand; PAM type: NRG; PAM sequence: AAG
tctcactgtcctgggtggtg

SEQ ID NO: 69071 - DNA, 20 bp, Artificial Sequence
  Description of Artificial Sequence: Synthetic oligonucleotide
  Target: ATXN1; (-) strand; PAM type: NRG; PAM sequence: TGG
tagcctctcactgtcctggg

SEQ ID NO: 69072 - DNA, 20 bp, Artificial Sequence
  Description of Artificial Sequence: Synthetic oligonucleotide
  Target: ATXN1; (-) strand; PAM type: NRG; PAM sequence: GGG
ttatagcctctcactgtcct

SEQ ID NO: 69073 - DNA, 20 bp, Artificial Sequence
  Description of Artificial Sequence: Synthetic oligonucleotide
  Target: ATXN1; (-) strand; PAM type: NRG; PAM sequence: TGG
cttatagcctctcactgtcc

SEQ ID NO: 69074 - DNA, 20 bp, Artificial Sequence
  Description of Artificial Sequence: Synthetic oligonucleotide
  Target: ATXN1; (-) strand; PAM type: NRG; PAM sequence: TAG
cccggtgcccttaacactta

SEQ ID NO: 69075 - DNA, 20 bp, Artificial Sequence
  Description of Artificial Sequence: Synthetic oligonucleotide
  Target: ATXN1; (-) strand; PAM type: NRG; PAM sequence: CGG
cccagatattggctctgccc

SEQ ID NO: 69076 - DNA, 20 bp, Artificial Sequence
  Description of Artificial Sequence: Synthetic oligonucleotide
  Target: ATXN1; (-) strand; PAM type: NRG; PAM sequence: TGG
ggtcatttaaacccagatat

SEQ ID NO: 69077 - DNA, 20 bp, Artificial Sequence
  Description of Artificial Sequence: Synthetic oligonucleotide
  Target: ATXN1; (-) strand; PAM type: NRG; PAM sequence: CAG
tgcccaaggtcatttaaacc

SEQ ID NO: 69078 - DNA, 20 bp, Artificial Sequence
  Description of Artificial Sequence: Synthetic oligonucleotide
  Target: ATXN1; (-) strand; PAM type: NRG; PAM sequence: AGG
gaggttaagtgatttgccca

SEQ ID NO: 69079 - DNA, 20 bp, Artificial Sequence
  Description of Artificial Sequence: Synthetic oligonucleotide
  Target: ATXN1; (-) strand; PAM type: NRG; PAM sequence: AAG
tgaggttaagtgatttgccc

SEQ ID NO: 69080 - DNA, 20 bp, Artificial Sequence
  Description of Artificial Sequence: Synthetic oligonucleotide
  Target: ATXN1; (-) strand; PAM type: NRG; PAM sequence: AAG
tatctgaaaacagtgaggtt

SEQ ID NO: 69081 - DNA, 20 bp, Artificial Sequence
  Description of Artificial Sequence: Synthetic oligonucleotide
  Target: ATXN1; (-) strand; PAM type: NRG; PAM sequence: AGG
ttttatatctgaaaacagtg

SEQ ID NO: 69082 - DNA, 20 bp, Artificial Sequence
  Description of Artificial Sequence: Synthetic oligonucleotide
  Target: ATXN1; (-) strand; PAM type: NRG; PAM sequence: GAG
attttatatctgaaaacagt

SEQ ID NO: 69083 - DNA, 20 bp, Artificial Sequence
  Description of Artificial Sequence: Synthetic oligonucleotide
  Target: ATXN1; (-) strand; PAM type: NRG; PAM sequence: CAG
gtaaattttatatctgaaaa

SEQ ID NO: 69084 - DNA, 20 bp, Artificial Sequence
  Description of Artificial Sequence: Synthetic oligonucleotide
  Target: ATXN1; (-) strand; PAM type: NRG; PAM sequence: AAG
aacacctataatactgctct

SEQ ID NO: 69085 - DNA, 20 bp, Artificial Sequence
  Description of Artificial Sequence: Synthetic oligonucleotide
  Target: ATXN1; (-) strand; PAM type: NRG; PAM sequence: AAG
ctttgtatgttggtcaataa

SEQ ID NO: 69086 - DNA, 20 bp, Artificial Sequence
  Description of Artificial Sequence: Synthetic oligonucleotide
  Target: ATXN1; (-) strand; PAM type: NRG; PAM sequence: TGG
acagtcagctctttgtatgt

SEQ ID NO: 69087 - DNA, 20 bp, Artificial Sequence
  Description of Artificial Sequence: Synthetic oligonucleotide
  Target: ATXN1; (-) strand; PAM type: NRG; PAM sequence: CAG
tggaatcattgaataacagt

SEQ ID NO: 69088 - DNA, 20 bp, Artificial Sequence
  Description of Artificial Sequence: Synthetic oligonucleotide
  Target: ATXN1; (-) strand; PAM type: NRG; PAM sequence: CAG
attttggaatcattgaataa

SEQ ID NO: 69089 - DNA, 20 bp, Artificial Sequence
  Description of Artificial Sequence: Synthetic oligonucleotide
  Target: ATXN1; (-) strand; PAM type: NRG; PAM sequence: TGG
aataaaaagaacaattattt

SEQ ID NO: 69090 - DNA, 20 bp, Artificial Sequence
  Description of Artificial Sequence: Synthetic oligonucleotide
  Target: ATXN1; (-) strand; PAM type: NRG; PAM sequence: AAG
aaaaagattaaaaaaataaa

SEQ ID NO: 69091 - DNA, 20 bp, Artificial Sequence
  Description of Artificial Sequence: Synthetic oligonucleotide
  Target: ATXN1; (-) strand; PAM type: NRG; PAM sequence: AAG
gtataattaaaaacaaaaaa

SEQ ID NO: 69092 - DNA, 20 bp, Artificial Sequence
  Description of Artificial Sequence: Synthetic oligonucleotide
  Target: ATXN1; (-) strand; PAM type: NRG; PAM sequence: AAG
cacatgtaccctaaaactta

SEQ ID NO: 69093 - DNA, 20 bp, Artificial Sequence
  Description of Artificial Sequence: Synthetic oligonucleotide
  Target: ATXN1; (-) strand; PAM type: NRG; PAM sequence: TGG
atgggtgcagcacgccaacc

SEQ ID NO: 69094 - DNA, 20 bp, Artificial Sequence
  Description of Artificial Sequence: Synthetic oligonucleotide
  Target: ATXN1; (-) strand; PAM type: NRG; PAM sequence: CAG
aaatgacaagttaatgggtg

SEQ ID NO: 69095 - DNA, 20 bp, Artificial Sequence
  Description of Artificial Sequence: Synthetic oligonucleotide
  Target: ATXN1; (-) strand; PAM type: NRG; PAM sequence: GGG
atgttaaatgacaagttaat

SEQ ID NO: 69096 - DNA, 20 bp, Artificial Sequence
  Description of Artificial Sequence: Synthetic oligonucleotide
  Target: ATXN1; (-) strand; PAM type: NRG; PAM sequence: TGG
aatgttaaatgacaagttaa

SEQ ID NO: 69097 - DNA, 20 bp, Artificial Sequence
  Description of Artificial Sequence: Synthetic oligonucleotide
  Target: ATXN1; (-) strand; PAM type: NRG; PAM sequence: AAG
tatacctaatgttaaatgac

SEQ ID NO: 69098 - DNA, 20 bp, Artificial Sequence
  Description of Artificial Sequence: Synthetic oligonucleotide
  Target: ATXN1; (-) strand; PAM type: NRG; PAM sequence: GAG
ggggggaaggatagcattag

SEQ ID NO: 69099 - DNA, 20 bp, Artificial Sequence
  Description of Artificial Sequence: Synthetic oligonucleotide
  Target: ATXN1; (-) strand; PAM type: NRG; PAM sequence: AGG
gaggggggaaggatagcatt

SEQ ID NO: 69100 - DNA, 20 bp, Artificial Sequence
  Description of Artificial Sequence: Synthetic oligonucleotide
  Target: ATXN1; (-) strand; PAM type: NRG; PAM sequence: TAG
ggaggggggaaggatagcat

SEQ ID NO: 69101 - DNA, 20 bp, Artificial Sequence
  Description of Artificial Sequence: Synthetic oligonucleotide
  Target: ATXN1; (-) strand; PAM type: NRG; PAM sequence: TAG
gtggggggaggggggaagga

SEQ ID NO: 69102 - DNA, 20 bp, Artificial Sequence
  Description of Artificial Sequence: Synthetic oligonucleotide
  Target: ATXN1; (-) strand; PAM type: NRG; PAM sequence: AGG
tggggtggggggagggggga

SEQ ID NO: 69103 - DNA, 20 bp, Artificial Sequence
  Description of Artificial Sequence: Synthetic oligonucleotide
  Target: ATXN1; (-) strand; PAM type: NRG; PAM sequence: AAG
gtggggtggggggagggggg

SEQ ID NO: 69104 - DNA, 20 bp, Artificial Sequence
  Description of Artificial Sequence: Synthetic oligonucleotide
  Target: ATXN1; (-) strand; PAM type: NRG; PAM sequence: GGG
gttgtggggtggggggaggg

SEQ ID NO: 69105 - DNA, 20 bp, Artificial Sequence
  Description of Artificial Sequence: Synthetic oligonucleotide
  Target: ATXN1; (-) strand; PAM type: NRG; PAM sequence: GGG
tgttgtggggtggggggagg

SEQ ID NO: 69106 - DNA, 20 bp, Artificial Sequence
  Description of Artificial Sequence: Synthetic oligonucleotide
  Target: ATXN1; (-) strand; PAM type: NRG; PAM sequence: GGG
ctgttgtggggtggggggag

SEQ ID NO: 69107 - DNA, 20 bp, Artificial Sequence
  Description of Artificial Sequence: Synthetic oligonucleotide
  Target: ATXN1; (-) strand; PAM type: NRG; PAM sequence: GGG
cctgttgtggggtgggggga

SEQ ID NO: 69108 - DNA, 20 bp, Artificial Sequence
  Description of Artificial Sequence: Synthetic oligonucleotide
  Target: ATXN1; (-) strand; PAM type: NRG; PAM sequence: AGG
gcctgttgtggggtgggggg

SEQ ID NO: 69109 - DNA, 20 bp, Artificial Sequence
  Description of Artificial Sequence: Synthetic oligonucleotide
  Target: ATXN1; (-) strand; PAM type: NRG; PAM sequence: GAG
ggcctgttgtggggtggggg

SEQ ID NO: 69110 - DNA, 20 bp, Artificial Sequence
  Description of Artificial Sequence: Synthetic oligonucleotide
  Target: ATXN1; (-) strand; PAM type: NRG; PAM sequence: GGG
ggggcctgttgtggggtggg

SEQ ID NO: 69111 - DNA, 20 bp, Artificial Sequence
  Description of Artificial Sequence: Synthetic oligonucleotide
  Target: ATXN1; (-) strand; PAM type: NRG; PAM sequence: GGG
cggggcctgttgtggggtgg

SEQ ID NO: 69112 - DNA, 20 bp, Artificial Sequence
  Description of Artificial Sequence: Synthetic oligonucleotide
  Target: ATXN1; (-) strand; PAM type: NRG; PAM sequence: GGG
ccggggcctgttgtggggtg

SEQ ID NO: 69113 - DNA, 20 bp, Artificial Sequence
  Description of Artificial Sequence: Synthetic oligonucleotide
  Target: ATXN1; (-) strand; PAM type: NRG; PAM sequence: GGG
accggggcctgttgtggggt

SEQ ID NO: 69114 - DNA, 20 bp, Artificial Sequence
  Description of Artificial Sequence: Synthetic oligonucleotide
  Target: ATXN1; (-) strand; PAM type: NRG; PAM sequence: TGG
caccggggcctgttgtgggg

SEQ ID NO: 69115 - DNA, 20 bp, Artificial Sequence
  Description of Artificial Sequence: Synthetic oligonucleotide
  Target: ATXN1; (-) strand; PAM type: NRG; PAM sequence: GGG
acacaccggggcctgttgtg

SEQ ID NO: 69116 - DNA, 20 bp, Artificial Sequence
  Description of Artificial Sequence: Synthetic oligonucleotide
  Target: ATXN1; (-) strand; PAM type: NRG; PAM sequence: GGG
cacacaccggggcctgttgt

SEQ ID NO: 69117 - DNA, 20 bp, Artificial Sequence
  Description of Artificial Sequence: Synthetic oligonucleotide
  Target: ATXN1; (-) strand; PAM type: NRG; PAM sequence: TGG
tcacacaccggggcctgttg

SEQ ID NO: 69118 - DNA, 20 bp, Artificial Sequence
  Description of Artificial Sequence: Synthetic oligonucleotide
  Target: ATXN1; (-) strand; PAM type: NRG; PAM sequence: GGG
aaggggaacatcacacaccg

SEQ ID NO: 69119 - DNA, 20 bp, Artificial Sequence
  Description of Artificial Sequence: Synthetic oligonucleotide
  Target: ATXN1; (-) strand; PAM type: NRG; PAM sequence: GGG
gaaggggaacatcacacacc

SEQ ID NO: 69120 - DNA, 20 bp, Artificial Sequence
  Description of Artificial Sequence: Synthetic oligonucleotide
  Target: ATXN1; (-) strand; PAM type: NRG; PAM sequence: CGG
ggaaggggaacatcacacac

SEQ ID NO: 69121 - DNA, 20 bp, Artificial Sequence
  Description of Artificial Sequence: Synthetic oligonucleotide
  Target: ATXN1; (-) strand; PAM type: NRG; PAM sequence: GGG
gaacacatggacacaggaag

SEQ ID NO: 69122 - DNA, 20 bp, Artificial Sequence
  Description of Artificial Sequence: Synthetic oligonucleotide
  Target: ATXN1; (-) strand; PAM type: NRG; PAM sequence: GGG
agaacacatggacacaggaa

SEQ ID NO: 69123 - DNA, 20 bp, Artificial Sequence
  Description of Artificial Sequence: Synthetic oligonucleotide
  Target: ATXN1; (-) strand; PAM type: NRG; PAM sequence: AGG
gagaacacatggacacagga

SEQ ID NO: 69124 - DNA, 20 bp, Artificial Sequence
  Description of Artificial Sequence: Synthetic oligonucleotide
  Target: ATXN1; (-) strand; PAM type: NRG; PAM sequence: AAG
tgagaacacatggacacagg

SEQ ID NO: 69125 - DNA, 20 bp, Artificial Sequence
  Description of Artificial Sequence: Synthetic oligonucleotide
  Target: ATXN1; (-) strand; PAM type: NRG; PAM sequence: AGG
caatgagaacacatggacac

SEQ ID NO: 69126 - DNA, 20 bp, Artificial Sequence
  Description of Artificial Sequence: Synthetic oligonucleotide
  Target: ATXN1; (-) strand; PAM type: NRG; PAM sequence: CAG
acaatgagaacacatggaca

SEQ ID NO: 69127 - DNA, 20 bp, Artificial Sequence
  Description of Artificial Sequence: Synthetic oligonucleotide
  Target: ATXN1; (-) strand; PAM type: NRG; PAM sequence: TGG
aattgaacaatgagaacaca

SEQ ID NO: 69128 - DNA, 20 bp, Artificial Sequence
  Description of Artificial Sequence: Synthetic oligonucleotide
  Target: ATXN1; (-) strand; PAM type: NRG; PAM sequence: GAG
ataggtgggaattgaacaat

SEQ ID NO: 69129 - DNA, 20 bp, Artificial Sequence
  Description of Artificial Sequence: Synthetic oligonucleotide
  Target: ATXN1; (-) strand; PAM type: NRG; PAM sequence: GGG
ccatgttctcactcataggt

SEQ ID NO: 69130 - DNA, 20 bp, Artificial Sequence
  Description of Artificial Sequence: Synthetic oligonucleotide
  Target: ATXN1; (-) strand; PAM type: NRG; PAM sequence: TGG
cccatgttctcactcatagg

SEQ ID NO: 69131 - DNA, 20 bp, Artificial Sequence
  Description of Artificial Sequence: Synthetic oligonucleotide
  Target: ATXN1; (-) strand; PAM type: NRG; PAM sequence: AGG
caccccatgttctcactcat

SEQ ID NO: 69132 - DNA, 20 bp, Artificial Sequence
  Description of Artificial Sequence: Synthetic oligonucleotide
  Target: ATXN1; (-) strand; PAM type: NRG; PAM sequence: TAG
acaccccatgttctcactca

SEQ ID NO: 69133 - DNA, 20 bp, Artificial Sequence
  Description of Artificial Sequence: Synthetic oligonucleotide
  Target: ATXN1; (-) strand; PAM type: NRG; PAM sequence: AGG
gcgagactatctcaatcgca

SEQ ID NO: 69134 - DNA, 20 bp, Artificial Sequence
  Description of Artificial Sequence: Synthetic oligonucleotide
  Target: ATXN1; (-) strand; PAM type: NRG; PAM sequence: AAG
agcgagactatctcaatcgc

SEQ ID NO: 69135 - DNA, 20 bp, Artificial Sequence
  Description of Artificial Sequence: Synthetic oligonucleotide
  Target: ATXN1; (-) strand; PAM type: NRG; PAM sequence: GAG
tccatcctgggtgacagagc

SEQ ID NO: 69136 - DNA, 20 bp, Artificial Sequence
  Description of Artificial Sequence: Synthetic oligonucleotide
  Target: ATXN1; (-) strand; PAM type: NRG; PAM sequence: GAG
gcactccatcctgggtgaca

SEQ ID NO: 69137 - DNA, 20 bp, Artificial Sequence
  Description of Artificial Sequence: Synthetic oligonucleotide
  Target: ATXN1; (-) strand; PAM type: NRG; PAM sequence: CAG
ttgcactccatcctgggtga

SEQ ID NO: 69138 - DNA, 20 bp, Artificial Sequence
  Description of Artificial Sequence: Synthetic oligonucleotide
  Target: ATXN1; (-) strand; PAM type: NRG; PAM sequence: GGG
gtgccattgcactccatcct

SEQ ID NO: 69139 - DNA, 20 bp, Artificial Sequence
  Description of Artificial Sequence: Synthetic oligonucleotide
  Target: ATXN1; (-) strand; PAM type: NRG; PAM sequence: TGG
agtgccattgcactccatcc

SEQ ID NO: 69140 - DNA, 20 bp, Artificial Sequence
  Description of Artificial Sequence: Synthetic oligonucleotide
  Target: ATXN1; (-) strand; PAM type: NRG; PAM sequence: TAG
taggttgcagtgagccgaga

SEQ ID NO: 69141 - DNA, 20 bp, Artificial Sequence
  Description of Artificial Sequence: Synthetic oligonucleotide
  Target: ATXN1; (-) strand; PAM type: NRG; PAM sequence: GAG
ggcgtaggttgcagtgagcc

SEQ ID NO: 69142 - DNA, 20 bp, Artificial Sequence
  Description of Artificial Sequence: Synthetic oligonucleotide
  Target: ATXN1; (-) strand; PAM type: NRG; PAM sequence: GAG
tgggaggcgtaggttgcagt

SEQ ID NO: 69143 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcgtaggttg

SEQ ID NO: 69144 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctgggaggcgt

SEQ ID NO: 69145 - DNA, 20 bp, Artificial Sequence
  Description of Artificial Sequence: Synthetic oligonucleotide
  Target: ATXN1; (-) strand; PAM type: NRG; PAM sequence: TAG
ttgcttgaacctgggaggcg

SEQ ID NO: 69146 - DNA, 20 bp, Artificial Sequence
  Description of Artificial Sequence: Synthetic oligonucleotide
  Target: ATXN1; (-) strand; PAM type: NRG; PAM sequence: AGG
gaggattgcttgaacctggg

SEQ ID NO: 69147 - DNA, 20 bp, Artificial Sequence
  Description of Artificial Sequence: Synthetic oligonucleotide
  Target: ATXN1; (-) strand; PAM type: NRG; PAM sequence: GAG
agaggattgcttgaacctgg

SEQ ID NO: 69148 - DNA, 20 bp, Artificial Sequence
  Description of Artificial Sequence: Synthetic oligonucleotide
  Target: ATXN1; (-) strand; PAM type: NRG; PAM sequence: GGG
cgagaggattgcttgaacct

SEQ ID NO: 69149 - DNA, 20 bp, Artificial Sequence
  Description of Artificial Sequence: Synthetic oligonucleotide
  Target: ATXN1; (-) strand; PAM type: NRG; PAM sequence: TGG
gcgagaggattgcttgaacc

SEQ ID NO: 69150 - DNA, 20 bp, Artificial Sequence
  Description of Artificial Sequence: Synthetic oligonucleotide
  Target: ATXN1; (-) strand; PAM type: NRG; PAM sequence: AGG
acttgggaggctgaggcgag

SEQ ID NO: 69151 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcga

SEQ ID NO: 69152 - DNA, 20 bp, Artificial Sequence
  Description of Artificial Sequence: Synthetic oligonucleotide
  Target: ATXN1; (-) strand; PAM type: NRG; PAM sequence: GAG
gctacttgggaggctgaggc

SEQ ID NO: 69153 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 69154 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 69155 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctacttggg

SEQ ID NO: 69156 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacttgg

SEQ ID NO: 69157 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagctactt

SEQ ID NO: 69158 - DNA, 20 bp, Artificial Sequence
  Description of Artificial Sequence: Synthetic oligonucleotide
  Target: ATXN1; (-) strand; PAM type: NRG; PAM sequence: TGG
tgcctgtagtcccagctact

SEQ ID NO: 69159 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctgtagtcc

SEQ ID NO: 69160 - DNA, 20 bp, Artificial Sequence
  Description of Artificial Sequence: Synthetic oligonucleotide
  Target: ATXN1; (-) strand; PAM type: NRG; PAM sequence: TAG
ggtgtggtggctcatgcctg

SEQ ID NO: 69161 - DNA, 20 bp, Artificial Sequence
  Description of Artificial Sequence: Synthetic oligonucleotide
  Target: ATXN1; (-) strand; PAM type: NRG; PAM sequence: TGG
caagaattagccaggtgtgg

SEQ ID NO: 69162 - DNA, 20 bp, Artificial Sequence
  Description of Artificial Sequence: Synthetic oligonucleotide
  Target: ATXN1; (-) strand; PAM type: NRG; PAM sequence: TGG
aaacaagaattagccaggtg

SEQ ID NO: 69163 - DNA, 20 bp, Artificial Sequence
  Description of Artificial Sequence: Synthetic oligonucleotide
  Target: ATXN1; (-) strand; PAM type: NRG; PAM sequence: AGG
tgaaaaaacaagaattagcc

SEQ ID NO: 69164 - DNA, 20 bp, Artificial Sequence
  Description of Artificial Sequence: Synthetic oligonucleotide
  Target: ATXN1; (-) strand; PAM type: NRG; PAM sequence: CAG
ctgaaaaaacaagaattagc

SEQ ID NO: 69165 - DNA, 20 bp, Artificial Sequence
  Description of Artificial Sequence: Synthetic oligonucleotide
  Target: ATXN1; (-) strand; PAM type: NRG; PAM sequence: TAG
tctactgaaaaaacaagaat

SEQ ID NO: 69166 - DNA, 20 bp, Artificial Sequence
  Description of Artificial Sequence: Synthetic oligonucleotide
  Target: ATXN1; (-) strand; PAM type: NRG; PAM sequence: AAG
cctgtctctactgaaaaaac

SEQ ID NO: 69167 - DNA, 20 bp, Artificial Sequence
  Description of Artificial Sequence: Synthetic oligonucleotide
  Target: ATXN1; (-) strand; PAM type: NRG; PAM sequence: TGG
cgagaccatcctggacaaca

SEQ ID NO: 69168 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagaccatcc

SEQ ID NO: 69169 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttc

SEQ ID NO: 69170 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcag

SEQ ID NO: 69171 - DNA, 20 bp, Artificial Sequence
  Description of Artificial Sequence: Synthetic oligonucleotide
  Target: ATXN1; (-) strand; PAM type: NRG; PAM sequence: AGG
caggtggatcacctgaggtc

SEQ ID NO: 69172 - DNA, 20 bp, Artificial Sequence
  Description of Artificial Sequence: Synthetic oligonucleotide
  Target: ATXN1; (-) strand; PAM type: NRG; PAM sequence: CAG
gcaggtggatcacctgaggt

SEQ ID NO: 69173 - DNA, 20 bp, Artificial Sequence
  Description of Artificial Sequence: Synthetic oligonucleotide
  Target: ATXN1; (-) strand; PAM type: NRG; PAM sequence: AGG
cgaggcaggtggatcacctg

SEQ ID NO: 69174 - DNA, 20 bp, Artificial Sequence
  Description of Artificial Sequence: Synthetic oligonucleotide
  Target: ATXN1; (-) strand; PAM type: NRG; PAM sequence: GAG
ccgaggcaggtggatcacct

SEQ ID NO: 69175 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccgaggcagg

SEQ ID NO: 69176 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggccgaggc

SEQ ID NO: 69177 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggccgagg

SEQ ID NO: 69178 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 69179 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 69180 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 69181 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 69182 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 69183 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagcactt

SEQ ID NO: 69184 - DNA, 20 bp, Artificial Sequence
  Description of Artificial Sequence: Synthetic oligonucleotide
  Target: ATXN1; (-) strand; PAM type: NRG; PAM sequence: CAG
gtgactcatgcctgtaatcc

SEQ ID NO: 69185 - DNA, 20 bp, Artificial Sequence
  Description of Artificial Sequence: Synthetic oligonucleotide
  Target: ATXN1; (-) strand; PAM type: NRG; PAM sequence: CAG
tagttattttgggctgggcg

SEQ ID NO: 69186 - DNA, 20 bp, Artificial Sequence
  Description of Artificial Sequence: Synthetic oligonucleotide
  Target: ATXN1; (-) strand; PAM type: NRG; PAM sequence: GGG
tagaatagttattttgggct

SEQ ID NO: 69187 - DNA, 20 bp, Artificial Sequence
  Description of Artificial Sequence: Synthetic oligonucleotide
  Target: ATXN1; (-) strand; PAM type: NRG; PAM sequence: TGG
ttagaatagttattttgggc

SEQ ID NO: 69188 - DNA, 20 bp, Artificial Sequence
  Description of Artificial Sequence: Synthetic oligonucleotide
  Target: ATXN1; (-) strand; PAM type: NRG; PAM sequence: GGG
taggttagaatagttatttt

SEQ ID NO: 69189 - DNA, 20 bp, Artificial Sequence
  Description of Artificial Sequence: Synthetic oligonucleotide
  Target: ATXN1; (-) strand; PAM type: NRG; PAM sequence: TGG
ataggttagaatagttattt

SEQ ID NO: 69190 - DNA, 20 bp, Artificial Sequence
  Description of Artificial Sequence: Synthetic oligonucleotide
  Target: ATXN1; (-) strand; PAM type: NRG; PAM sequence: TAG
gaggagaggataggttagaa

SEQ ID NO: 69191 - DNA, 20 bp, Artificial Sequence
  Description of Artificial Sequence: Synthetic oligonucleotide
  Target: ATXN1; (-) strand; PAM type: NRG; PAM sequence: TAG
gtagtgaggagaggataggt

SEQ ID NO: 69192 - DNA, 20 bp, Artificial Sequence
  Description of Artificial Sequence: Synthetic oligonucleotide
  Target: ATXN1; (-) strand; PAM type: NRG; PAM sequence: AGG
gtaagtagtgaggagaggat

SEQ ID NO: 69193 - DNA, 20 bp, Artificial Sequence
  Description of Artificial Sequence: Synthetic oligonucleotide
  Target: ATXN1; (-) strand; PAM type: NRG; PAM sequence: TAG
ggtaagtagtgaggagagga

SEQ ID NO: 69194 - DNA, 20 bp, Artificial Sequence
  Description of Artificial Sequence: Synthetic oligonucleotide
  Target: ATXN1; (-) strand; PAM type: NRG; PAM sequence: AGG
tgggggtaagtagtgaggag

SEQ ID NO: 69195 - DNA, 20 bp, Artificial Sequence
  Description of Artificial Sequence: Synthetic oligonucleotide
  Target: ATXN1; (-) strand; PAM type: NRG; PAM sequence: GAG
gtgggggtaagtagtgagga

SEQ ID NO: 69196 - DNA, 20 bp, Artificial Sequence
  Description of Artificial Sequence: Synthetic oligonucleotide
  Target: ATXN1; (-) strand; PAM type: NRG; PAM sequence: GAG
tagtgggggtaagtagtgag

SEQ ID NO: 69197 - DNA, 20 bp, Artificial Sequence
  Description of Artificial Sequence: Synthetic oligonucleotide
  Target: ATXN1; (-) strand; PAM type: NRG; PAM sequence: AGG
gatagtgggggtaagtagtg

SEQ ID NO: 69198 - DNA, 20 bp, Artificial Sequence
  Description of Artificial Sequence: Synthetic oligonucleotide
  Target: ATXN1; (-) strand; PAM type: NRG; PAM sequence: GAG
ggatagtgggggtaagtagt

SEQ ID NO: 69199 - DNA, 20 bp, Artificial Sequence
  Description of Artificial Sequence: Synthetic oligonucleotide
  Target: ATXN1; (-) strand; PAM type: NRG; PAM sequence: TAG
tgaaggatagtgggggtaag

SEQ ID NO: 69200 - DNA, 20 bp, Artificial Sequence
  Description of Artificial Sequence: Synthetic oligonucleotide
  Target: ATXN1; (-) strand; PAM type: NRG; PAM sequence: AAG
aggtgaaggatagtgggggt

SEQ ID NO: 69201 - DNA, 20 bp, Artificial Sequence
  Description of Artificial Sequence: Synthetic oligonucleotide
  Target: ATXN1; (-) strand; PAM type: NRG; PAM sequence: GGG
tggcaggtgaaggatagtgg

SEQ ID NO: 69202 - DNA, 20 bp, Artificial Sequence
  Description of Artificial Sequence: Synthetic oligonucleotide
  Target: ATXN1; (-) strand; PAM type: NRG; PAM sequence: GGG
ttggcaggtgaaggatagtg

SEQ ID NO: 69203 - DNA, 20 bp, Artificial Sequence
  Description of Artificial Sequence: Synthetic oligonucleotide
  Target: ATXN1; (-) strand; PAM type: NRG; PAM sequence: GGG
gttggcaggtgaaggatagt

SEQ ID NO: 69204 - DNA, 20 bp, Artificial Sequence
  Description of Artificial Sequence: Synthetic oligonucleotide
  Target: ATXN1; (-) strand; PAM type: NRG; PAM sequence: TGG
ggttggcaggtgaaggatag

SEQ ID NO: 69205 - DNA, 20 bp, Artificial Sequence
  Description of Artificial Sequence: Synthetic oligonucleotide
  Target: ATXN1; (-) strand; PAM type: NRG; PAM sequence: TAG
gtgggttggcaggtgaagga

SEQ ID NO: 69206 - DNA, 20 bp, Artificial Sequence
  Description of Artificial Sequence: Synthetic oligonucleotide
  Target: ATXN1; (-) strand; PAM type: NRG; PAM sequence: AGG
tagagtgggttggcaggtga

SEQ ID NO: 69207 - DNA, 20 bp, Artificial Sequence
  Description of Artificial Sequence: Synthetic oligonucleotide
  Target: ATXN1; (-) strand; PAM type: NRG; PAM sequence: AAG
ttagagtgggttggcaggtg

SEQ ID NO: 69208 - DNA, 20 bp, Artificial Sequence
  Description of Artificial Sequence: Synthetic oligonucleotide
  Target: ATXN1; (-) strand; PAM type: NRG; PAM sequence: AGG
cagacttagagtgggttggc

SEQ ID NO: 69209 - DNA, 20 bp, Artificial Sequence
  Description of Artificial Sequence: Synthetic oligonucleotide
  Target: ATXN1; (-) strand; PAM type: NRG; PAM sequence: CAG
acagacttagagtgggttgg

SEQ ID NO: 69210 - DNA, 20 bp, Artificial Sequence
  Description of Artificial Sequence: Synthetic oligonucleotide
  Target: ATXN1; (-) strand; PAM type: NRG; PAM sequence: TGG
tgaacagacttagagtgggt

SEQ ID NO: 69211 - DNA, 20 bp, Artificial Sequence
  Description of Artificial Sequence: Synthetic oligonucleotide
  Target: ATXN1; (-) strand; PAM type: NRG; PAM sequence: GGG
taaatgaacagacttagagt

SEQ ID NO: 69212 - DNA, 20 bp, Artificial Sequence
  Description of Artificial Sequence: Synthetic oligonucleotide
  Target: ATXN1; (-) strand; PAM type: NRG; PAM sequence: TGG
ctaaatgaacagacttagag

SEQ ID NO: 69213 - DNA, 20 bp, Artificial Sequence
  Description of Artificial Sequence: Synthetic oligonucleotide
  Target: ATXN1; (-) strand; PAM type: NRG; PAM sequence: GAG
agtctaaatgaacagactta

SEQ ID NO: 69214 - DNA, 20 bp, Artificial Sequence
  Description of Artificial Sequence: Synthetic oligonucleotide
  Target: ATXN1; (-) strand; PAM type: NRG; PAM sequence: TAG
gaagtctaaatgaacagact

SEQ ID NO: 69215 - DNA, 20 bp, Artificial Sequence
  Description of Artificial Sequence: Synthetic oligonucleotide
  Target: ATXN1; (-) strand; PAM type: NRG; PAM sequence: CAG
tgggtagaagtctaaatgaa

SEQ ID NO: 69216 - DNA, 20 bp, Artificial Sequence
  Description of Artificial Sequence: Synthetic oligonucleotide
  Target: ATXN1; (-) strand; PAM type: NRG; PAM sequence: AAG
ttctgcatgggaatgggtag

SEQ ID NO: 69217 - DNA, 20 bp, Artificial Sequence
  Description of Artificial Sequence: Synthetic oligonucleotide
  Target: ATXN1; (-) strand; PAM type: NRG; PAM sequence: TAG
cctttctgcatgggaatggg

SEQ ID NO: 69218 - DNA, 20 bp, Artificial Sequence
  Description of Artificial Sequence: Synthetic oligonucleotide
  Target: ATXN1; (-) strand; PAM type: NRG; PAM sequence: GGG
ggtcctttctgcatgggaat

SEQ ID NO: 69219 - DNA, 20 bp, Artificial Sequence
  Description of Artificial Sequence: Synthetic oligonucleotide
  Target: ATXN1; (-) strand; PAM type: NRG; PAM sequence: TGG
tggtcctttctgcatgggaa

SEQ ID NO: 69220 - DNA, 20 bp, Artificial Sequence
  Description of Artificial Sequence: Synthetic oligonucleotide
  Target: ATXN1; (-) strand; PAM type: NRG; PAM sequence: GGG
tgaactggtcctttctgcat

SEQ ID NO: 69221 - DNA, 20 bp, Artificial Sequence
  Description of Artificial Sequence: Synthetic oligonucleotide
  Target: ATXN1; (-) strand; PAM type: NRG; PAM sequence: TGG
ctgaactggtcctttctgca

SEQ ID NO: 69222 - DNA, 20 bp, Artificial Sequence
  Description of Artificial Sequence: Synthetic oligonucleotide
  Target: ATXN1; (-) strand; PAM type: NRG; PAM sequence: TGG
catccctgctgttgctgaac

SEQ ID NO: 69223 - DNA, 20 bp, Artificial Sequence
  Description of Artificial Sequence: Synthetic oligonucleotide
  Target: ATXN1; (-) strand; PAM type: NRG; PAM sequence: CAG
agtttctaaaacctacctgc

SEQ ID NO: 69224 - DNA, 20 bp, Artificial Sequence
  Description of Artificial Sequence: Synthetic oligonucleotide
  Target: ATXN1; (-) strand; PAM type: NRG; PAM sequence: GAG
cacattagccctgtgattaa

SEQ ID NO: 69225 - DNA, 20 bp, Artificial Sequence
  Description of Artificial Sequence: Synthetic oligonucleotide
  Target: ATXN1; (-) strand; PAM type: NRG; PAM sequence: AAG
aacacattagccctgtgatt

SEQ ID NO: 69226 - DNA, 20 bp, Artificial Sequence
  Description of Artificial Sequence: Synthetic oligonucleotide
  Target: ATXN1; (-) strand; PAM type: NRG; PAM sequence: TAG
tttaagctggatcaacacat

SEQ ID NO: 69227 - DNA, 20 bp, Artificial Sequence
  Description of Artificial Sequence: Synthetic oligonucleotide
  Target: ATXN1; (-) strand; PAM type: NRG; PAM sequence: TGG
cattagctatacatttaagc

SEQ ID NO: 69228 - DNA, 20 bp, Artificial Sequence
  Description of Artificial Sequence: Synthetic oligonucleotide
  Target: ATXN1; (-) strand; PAM type: NRG; PAM sequence: AAG
gaatcattagctatacattt

SEQ ID NO: 69229 - DNA, 20 bp, Artificial Sequence
  Description of Artificial Sequence: Synthetic oligonucleotide
  Target: ATXN1; (-) strand; PAM type: NRG; PAM sequence: TAG
tgaaaagtggaatgaatcat

SEQ ID NO: 69230 - DNA, 20 bp, Artificial Sequence
  Description of Artificial Sequence: Synthetic oligonucleotide
  Target: ATXN1; (-) strand; PAM type: NRG; PAM sequence: TGG
ccttgttataaaatgaaaag

SEQ ID NO: 69231 - DNA, 20 bp, Artificial Sequence
  Description of Artificial Sequence: Synthetic oligonucleotide
  Target: ATXN1; (-) strand; PAM type: NRG; PAM sequence: AAG
aacccttgttataaaatgaa

SEQ ID NO: 69232 - DNA, 20 bp, Artificial Sequence
  Description of Artificial Sequence: Synthetic oligonucleotide
  Target: ATXN1; (-) strand; PAM type: NRG; PAM sequence: AAG
tacaagagaagagagaaagc

SEQ ID NO: 69233 - DNA, 20 bp, Artificial Sequence
  Description of Artificial Sequence: Synthetic oligonucleotide
  Target: ATXN1; (-) strand; PAM type: NRG; PAM sequence: AAG
ttgatacaagagaagagaga

SEQ ID NO: 69234 - DNA, 20 bp, Artificial Sequence
  Description of Artificial Sequence: Synthetic oligonucleotide
  Target: ATXN1; (-) strand; PAM type: NRG; PAM sequence: GAG
atgcttgatacaagagaaga

SEQ ID NO: 69235 - DNA, 20 bp, Artificial Sequence
  Description of Artificial Sequence: Synthetic oligonucleotide
  Target: ATXN1; (-) strand; PAM type: NRG; PAM sequence: GAG
agatgcttgatacaagagaa

SEQ ID NO: 69236 - DNA, 20 bp, Artificial Sequence
  Description of Artificial Sequence: Synthetic oligonucleotide
  Target: ATXN1; (-) strand; PAM type: NRG; PAM sequence: AAG
aaagatgcttgatacaagag

SEQ ID NO: 69237 - DNA, 20 bp, Artificial Sequence
  Description of Artificial Sequence: Synthetic oligonucleotide
  Target: ATXN1; (-) strand; PAM type: NRG; PAM sequence: GAG
tgaaaagatgcttgatacaa

SEQ ID NO: 69238 - DNA, 20 bp, Artificial Sequence
  Description of Artificial Sequence: Synthetic oligonucleotide
  Target: ATXN1; (-) strand; PAM type: NRG; PAM sequence: AAG
gatgaaaagatgcttgatac

SEQ ID NO: 69239 - DNA, 20 bp, Artificial Sequence
  Description of Artificial Sequence: Synthetic oligonucleotide
  Target: ATXN1; (-) strand; PAM type: NRG; PAM sequence: AAG
gggacagagctgaagatgaa

SEQ ID NO: 69240 - DNA, 20 bp, Artificial Sequence
  Description of Artificial Sequence: Synthetic oligonucleotide
  Target: ATXN1; (-) strand; PAM type: NRG; PAM sequence: AAG
agtggggtgggacagagctg

SEQ ID NO: 69241 - DNA, 20 bp, Artificial Sequence
  Description of Artificial Sequence: Synthetic oligonucleotide
  Target: ATXN1; (-) strand; PAM type: NRG; PAM sequence: GAG
ttcagcagtggggtgggaca

SEQ ID NO: 69242 - DNA, 20 bp, Artificial Sequence
  Description of Artificial Sequence: Synthetic oligonucleotide
  Target: ATXN1; (-) strand; PAM type: NRG; PAM sequence: CAG
aattcagcagtggggtggga

SEQ ID NO: 69243 - DNA, 20 bp, Artificial Sequence
  Description of Artificial Sequence: Synthetic oligonucleotide
  Target: ATXN1; (-) strand; PAM type: NRG; PAM sequence: GGG
aaaaaattcagcagtggggt

SEQ ID NO: 69244 - DNA, 20 bp, Artificial Sequence
  Description of Artificial Sequence: Synthetic oligonucleotide
  Target: ATXN1; (-) strand; PAM type: NRG; PAM sequence: TGG
taaaaaattcagcagtgggg

SEQ ID NO: 69245 - DNA, 20 bp, Artificial Sequence
  Description of Artificial Sequence: Synthetic oligonucleotide
  Target: ATXN1; (-) strand; PAM type: NRG; PAM sequence: GGG
ttttaaaaaattcagcagtg

SEQ ID NO: 69246 - DNA, 20 bp, Artificial Sequence
  Description of Artificial Sequence: Synthetic oligonucleotide
  Target: ATXN1; (-) strand; PAM type: NRG; PAM sequence: GGG
tttttaaaaaattcagcagt

SEQ ID NO: 69247 - DNA, 20 bp, Artificial Sequence
  Description of Artificial Sequence: Synthetic oligonucleotide
  Target: ATXN1; (-) strand; PAM type: NRG; PAM sequence: TGG
ttttttaaaaaattcagcag

SEQ ID NO: 69248 - DNA, 20 bp, Artificial Sequence
  Description of Artificial Sequence: Synthetic oligonucleotide
  Target: ATXN1; (-) strand; PAM type: NRG; PAM sequence: CAG
ttcttttttaaaaaattcag

SEQ ID NO: 69249 - DNA, 20 bp, Artificial Sequence
  Description of Artificial Sequence: Synthetic oligonucleotide
  Target: ATXN1; (-) strand; PAM type: NRG; PAM sequence: CAG
tttttcttttttaaaaaatt

SEQ ID NO: 69250 - DNA, 20 bp, Artificial Sequence
  Description of Artificial Sequence: Synthetic oligonucleotide
  Target: ATXN1; (-) strand; PAM type: NRG; PAM sequence: GGG
ggcctctgagctagttggct

SEQ ID NO: 69251 - DNA, 20 bp, Artificial Sequence
  Description of Artificial Sequence: Synthetic oligonucleotide
  Target: ATXN1; (-) strand; PAM type: NRG; PAM sequence: TGG
aggcctctgagctagttggc

SEQ ID NO: 69252 - DNA, 20 bp, Artificial Sequence
  Description of Artificial Sequence: Synthetic oligonucleotide
  Target: ATXN1; (-) strand; PAM type: NRG; PAM sequence: TGG
acataggcctctgagctagt

SEQ ID NO: 69253 - DNA, 20 bp, Artificial Sequence
  Description of Artificial Sequence: Synthetic oligonucleotide
  Target: ATXN1; (-) strand; PAM type: NRG; PAM sequence: TAG
aaatacataggcctctgagc

SEQ ID NO: 69254 - DNA, 20 bp, Artificial Sequence
  Description of Artificial Sequence: Synthetic oligonucleotide
  Target: ATXN1; (-) strand; PAM type: NRG; PAM sequence: GAG
agcaaaatacataggcctct

SEQ ID NO: 69255 - DNA, 20 bp, Artificial Sequence
  Description of Artificial Sequence: Synthetic oligonucleotide
  Target: ATXN1; (-) strand; PAM type: NRG; PAM sequence: AGG
aagttcagagcaaaatacat

SEQ ID NO: 69256 - DNA, 20 bp, Artificial Sequence
  Description of Artificial Sequence: Synthetic oligonucleotide
  Target: ATXN1; (-) strand; PAM type: NRG; PAM sequence: TAG
gaagttcagagcaaaataca

SEQ ID NO: 69257 - DNA, 20 bp, Artificial Sequence
  Description of Artificial Sequence: Synthetic oligonucleotide
  Target: ATXN1; (-) strand; PAM type: NRG; PAM sequence: GAG
tatcgtcagtgtgaagttca

SEQ ID NO: 69258 - DNA, 20 bp, Artificial Sequence
  Description of Artificial Sequence: Synthetic oligonucleotide
  Target: ATXN1; (-) strand; PAM type: NRG; PAM sequence: CAG
aatatcgtcagtgtgaagtt

SEQ ID NO: 69259 - DNA, 20 bp, Artificial Sequence
  Description of Artificial Sequence: Synthetic oligonucleotide
  Target: ATXN1; (-) strand; PAM type: NRG; PAM sequence: AAG
tgtataatatcgtcagtgtg

SEQ ID NO: 69260 - DNA, 20 bp, Artificial Sequence
  Description of Artificial Sequence: Synthetic oligonucleotide
  Target: ATXN1; (-) strand; PAM type: NRG; PAM sequence: CAG
atgactgtgtataatatcgt

SEQ ID NO: 69261 - DNA, 20 bp, Artificial Sequence
  Description of Artificial Sequence: Synthetic oligonucleotide
  Target: ATXN1; (-) strand; PAM type: NRG; PAM sequence: CAG
ttccatgaccgtgtataata

SEQ ID NO: 69262 - DNA, 20 bp, Artificial Sequence
  Description of Artificial Sequence: Synthetic oligonucleotide
  Target: ATXN1; (-) strand; PAM type: NRG; PAM sequence: TAG
cctctcttatctcttttcat

SEQ ID NO: 69263 - DNA, 20 bp, Artificial Sequence
  Description of Artificial Sequence: Synthetic oligonucleotide
  Target: ATXN1; (-) strand; PAM type: NRG; PAM sequence: GGG
atattggggctgattttcaa

SEQ ID NO: 69264 - DNA, 20 bp, Artificial Sequence
  Description of Artificial Sequence: Synthetic oligonucleotide
  Target: ATXN1; (-) strand; PAM type: NRG; PAM sequence: AGG
gatattggggctgattttca

SEQ ID NO: 69265 - DNA, 20 bp, Artificial Sequence
  Description of Artificial Sequence: Synthetic oligonucleotide
  Target: ATXN1; (-) strand; PAM type: NRG; PAM sequence: AAG
agatattggggctgattttc

SEQ ID NO: 69266 - DNA, 20 bp, Artificial Sequence
  Description of Artificial Sequence: Synthetic oligonucleotide
  Target: ATXN1; (-) strand; PAM type: NRG; PAM sequence: GGG
catatctgggtgagatattg

SEQ ID NO: 69267 - DNA, 20 bp, Artificial Sequence
  Description of Artificial Sequence: Synthetic oligonucleotide
  Target: ATXN1; (-) strand; PAM type: NRG; PAM sequence: GGG
ccatatctgggtgagatatt

SEQ ID NO: 69268 - DNA, 20 bp, Artificial Sequence
  Description of Artificial Sequence: Synthetic oligonucleotide
  Target: ATXN1; (-) strand; PAM type: NRG; PAM sequence: TGG
cccatatctgggtgagatat

SEQ ID NO: 69269 - DNA, 20 bp, Artificial Sequence
  Description of Artificial Sequence: Synthetic oligonucleotide
  Target: ATXN1; (-) strand; PAM type: NRG; PAM sequence: GAG
gaggccacccatatctgggt

SEQ ID NO: 69270 - DNA, 20 bp, Artificial Sequence
  Description of Artificial Sequence: Synthetic oligonucleotide
  Target: ATXN1; (-) strand; PAM type: NRG; PAM sequence: GGG
ctctgaggccacccatatct

SEQ ID NO: 69271 - DNA, 20 bp, Artificial Sequence
  Description of Artificial Sequence: Synthetic oligonucleotide
  Target: ATXN1; (-) strand; PAM type: NRG; PAM sequence: TGG
gctctgaggccacccatatc

SEQ ID NO: 69272 - DNA, 20 bp, Artificial Sequence
  Description of Artificial Sequence: Synthetic oligonucleotide
  Target: ATXN1; (-) strand; PAM type: NRG; PAM sequence: AGG
gtctatatcaataagctctg

SEQ ID NO: 69273 - DNA, 20 bp, Artificial Sequence
  Description of Artificial Sequence: Synthetic oligonucleotide
  Target: ATXN1; (-) strand; PAM type: NRG; PAM sequence: GAG
agtctatatcaataagctct

SEQ ID NO: 69274 - DNA, 20 bp, Artificial Sequence
  Description of Artificial Sequence: Synthetic oligonucleotide
  Target: ATXN1; (-) strand; PAM type: NRG; PAM sequence: AAG
gagacacagtctatatcaat

SEQ ID NO: 69275 - DNA, 20 bp, Artificial Sequence
  Description of Artificial Sequence: Synthetic oligonucleotide
  Target: ATXN1; (-) strand; PAM type: NRG; PAM sequence: CAG
atgccctttggtgagagaca

SEQ ID NO: 69276 - DNA, 20 bp, Artificial Sequence
  Description of Artificial Sequence: Synthetic oligonucleotide
  Target: ATXN1; (-) strand; PAM type: NRG; PAM sequence: GAG
aatggcatgccctttggtga

SEQ ID NO: 69277 - DNA, 20 bp, Artificial Sequence
  Description of Artificial Sequence: Synthetic oligonucleotide
  Target: ATXN1; (-) strand; PAM type: NRG; PAM sequence: GAG
caaatggcatgccctttggt

SEQ ID NO: 69278 - DNA, 20 bp, Artificial Sequence
  Description of Artificial Sequence: Synthetic oligonucleotide
  Target: ATXN1; (-) strand; PAM type: NRG; PAM sequence: TGG
caagcaaatggcatgccctt

SEQ ID NO: 69279 - DNA, 20 bp, Artificial Sequence
  Description of Artificial Sequence: Synthetic oligonucleotide
  Target: ATXN1; (-) strand; PAM type: NRG; PAM sequence: TGG
aagaaatgatggcaagcaaa

SEQ ID NO: 69280 - DNA, 20 bp, Artificial Sequence
  Description of Artificial Sequence: Synthetic oligonucleotide
  Target: ATXN1; (-) strand; PAM type: NRG; PAM sequence: AAG
agttttaaagaaatgatggc

SEQ ID NO: 69281 - DNA, 20 bp, Artificial Sequence
  Description of Artificial Sequence: Synthetic oligonucleotide
  Target: ATXN1; (-) strand; PAM type: NRG; PAM sequence: TGG
taatagttttaaagaaatga

SEQ ID NO: 69282 - DNA, 20 bp, Artificial Sequence
  Description of Artificial Sequence: Synthetic oligonucleotide
  Target: ATXN1; (-) strand; PAM type: NRG; PAM sequence: AAG
gagagtgactaatagtttta

SEQ ID NO: 69283 - DNA, 20 bp, Artificial Sequence
  Description of Artificial Sequence: Synthetic oligonucleotide
  Target: ATXN1; (-) strand; PAM type: NRG; PAM sequence: TAG
atcggtgtgagagtgactaa

SEQ ID NO: 69284 - DNA, 20 bp, Artificial Sequence
  Description of Artificial Sequence: Synthetic oligonucleotide
  Target: ATXN1; (-) strand; PAM type: NRG; PAM sequence: GAG
ttaaaggtaaatcggtgtga

SEQ ID NO: 69285 - DNA, 20 bp, Artificial Sequence
  Description of Artificial Sequence: Synthetic oligonucleotide
  Target: ATXN1; (-) strand; PAM type: NRG; PAM sequence: GAG
gtttaaaggtaaatcggtgt

SEQ ID NO: 69286 - DNA, 20 bp, Artificial Sequence
  Description of Artificial Sequence: Synthetic oligonucleotide
  Target: ATXN1; (-) strand; PAM type: NRG; PAM sequence: CGG
gtccttgtttaaaggtaaat

SEQ ID NO: 69287 - DNA, 20 bp, Artificial Sequence
  Description of Artificial Sequence: Synthetic oligonucleotide
  Target: ATXN1; (-) strand; PAM type: NRG; PAM sequence: AGG
tatagaatgtccttgtttaa

SEQ ID NO: 69288 - DNA, 20 bp, Artificial Sequence
  Description of Artificial Sequence: Synthetic oligonucleotide
  Target: ATXN1; (-) strand; PAM type: NRG; PAM sequence: AAG
ttatagaatgtccttgttta

SEQ ID NO: 69289 - DNA, 20 bp, Artificial Sequence
  Description of Artificial Sequence: Synthetic oligonucleotide
  Target: ATXN1; (-) strand; PAM type: NRG; PAM sequence: TAG
cagaggtggatccctggtta

SEQ ID NO: 69290 - DNA, 20 bp, Artificial Sequence
  Description of Artificial Sequence: Synthetic oligonucleotide
  Target: ATXN1; (-) strand; PAM type: NRG; PAM sequence: TGG
aagccacagaggtggatccc

SEQ ID NO: 69291 - DNA, 20 bp, Artificial Sequence
  Description of Artificial Sequence: Synthetic oligonucleotide
  Target: ATXN1; (-) strand; PAM type: NRG; PAM sequence: TGG
cgatgactaagccacagagg

SEQ ID NO: 69292 - DNA, 20 bp, Artificial Sequence
  Description of Artificial Sequence: Synthetic oligonucleotide
  Target: ATXN1; (-) strand; PAM type: NRG; PAM sequence: AGG
atccgatgactaagccacag

SEQ ID NO: 69293 - DNA, 20 bp, Artificial Sequence
  Description of Artificial Sequence: Synthetic oligonucleotide
  Target: ATXN1; (-) strand; PAM type: NRG; PAM sequence: GAG
gatccgatgactaagccaca

SEQ ID NO: 69294 - DNA, 20 bp, Artificial Sequence
  Description of Artificial Sequence: Synthetic oligonucleotide
  Target: ATXN1; (-) strand; PAM type: NRG; PAM sequence: CAG
ctgatccgatgactaagcca

SEQ ID NO: 69295 - DNA, 20 bp, Artificial Sequence
  Description of Artificial Sequence: Synthetic oligonucleotide
  Target: ATXN1; (-) strand; PAM type: NRG; PAM sequence: AAG
ttgaggctgatccgatgact

SEQ ID NO: 69296 - DNA, 20 bp, Artificial Sequence
  Description of Artificial Sequence: Synthetic oligonucleotide
  Target: ATXN1; (-) strand; PAM type: NRG; PAM sequence: AGG
tactctagtcggtgaccttg

SEQ ID NO: 69297 - DNA, 20 bp, Artificial Sequence
  Description of Artificial Sequence: Synthetic oligonucleotide
  Target: ATXN1; (-) strand; PAM type: NRG; PAM sequence: GAG
ttactctagtcggtgacctt

SEQ ID NO: 69298 - DNA, 20 bp, Artificial Sequence
  Description of Artificial Sequence: Synthetic oligonucleotide
  Target: ATXN1; (-) strand; PAM type: NRG; PAM sequence: CGG
tgtcatcaggttactctagt

SEQ ID NO: 69299 - DNA, 20 bp, Artificial Sequence
  Description of Artificial Sequence: Synthetic oligonucleotide
  Target: ATXN1; (-) strand; PAM type: NRG; PAM sequence: TAG
taattgtcatcaggttactc

SEQ ID NO: 69300 - DNA, 20 bp, Artificial Sequence
  Description of Artificial Sequence: Synthetic oligonucleotide
  Target: ATXN1; (-) strand; PAM type: NRG; PAM sequence: AGG
tgaatgaggtaattgtcatc

SEQ ID NO: 69301 - DNA, 20 bp, Artificial Sequence
  Description of Artificial Sequence: Synthetic oligonucleotide
  Target: ATXN1; (-) strand; PAM type: NRG; PAM sequence: CAG
gtgaatgaggtaattgtcat

SEQ ID NO: 69302 - DNA, 20 bp, Artificial Sequence
  Description of Artificial Sequence: Synthetic oligonucleotide
  Target: ATXN1; (-) strand; PAM type: NRG; PAM sequence: AGG
tgttctatagtgggtgaatg

SEQ ID NO: 69303 - DNA, 20 bp, Artificial Sequence
  Description of Artificial Sequence: Synthetic oligonucleotide
  Target: ATXN1; (-) strand; PAM type: NRG; PAM sequence: GAG
ctgttctatagtgggtgaat

SEQ ID NO: 69304 - DNA, 20 bp, Artificial Sequence
  Description of Artificial Sequence: Synthetic oligonucleotide
  Target: ATXN1; (-) strand; PAM type: NRG; PAM sequence: GGG
tgatagaactgttctatagt

SEQ ID NO: 69305 - DNA, 20 bp, Artificial Sequence
  Description of Artificial Sequence: Synthetic oligonucleotide
  Target: ATXN1; (-) strand; PAM type: NRG; PAM sequence: TGG
gtgatagaactgttctatag

SEQ ID NO: 69306 - DNA, 20 bp, Artificial Sequence
  Description of Artificial Sequence: Synthetic oligonucleotide
  Target: ATXN1; (-) strand; PAM type: NRG; PAM sequence: TAG
tcggtgatagaactgttcta

SEQ ID NO: 69307 - DNA, 20 bp, Artificial Sequence
  Description of Artificial Sequence: Synthetic oligonucleotide
  Target: ATXN1; (-) strand; PAM type: NRG; PAM sequence: TAG
tgtcctgtattgatcggtga

SEQ ID NO: 69308 - DNA, 20 bp, Artificial Sequence
  Description of Artificial Sequence: Synthetic oligonucleotide
  Target: ATXN1; (-) strand; PAM type: NRG; PAM sequence: CGG
cagaggtgtcctgtattgat

SEQ ID NO: 69309 - DNA, 20 bp, Artificial Sequence
  Description of Artificial Sequence: Synthetic oligonucleotide
  Target: ATXN1; (-) strand; PAM type: NRG; PAM sequence: AGG
gctttgttgatgttgtgcag

SEQ ID NO: 69310 - DNA, 20 bp, Artificial Sequence
  Description of Artificial Sequence: Synthetic oligonucleotide
  Target: ATXN1; (-) strand; PAM type: NRG; PAM sequence: GAG
ggctttgttgatgttgtgca

SEQ ID NO: 69311 - DNA, 20 bp, Artificial Sequence
  Description of Artificial Sequence: Synthetic oligonucleotide
  Target: ATXN1; (-) strand; PAM type: NRG; PAM sequence: CAG
aaggctttgttgatgttgtg

SEQ ID NO: 69312 - DNA, 20 bp, Artificial Sequence
  Description of Artificial Sequence: Synthetic oligonucleotide
  Target: ATXN1; (-) strand; PAM type: NRG; PAM sequence: AGG
tgcagggtgcccccttgaga

SEQ ID NO: 69313 - DNA, 20 bp, Artificial Sequence
  Description of Artificial Sequence: Synthetic oligonucleotide
  Target: ATXN1; (-) strand; PAM type: NRG; PAM sequence: AAG
atgcagggtgcccccttgag

SEQ ID NO: 69314 - DNA, 20 bp, Artificial Sequence
  Description of Artificial Sequence: Synthetic oligonucleotide
  Target: ATXN1; (-) strand; PAM type: NRG; PAM sequence: GAG
tgcatgcagggtgccccctt

SEQ ID NO: 69315 - DNA, 20 bp, Artificial Sequence
  Description of Artificial Sequence: Synthetic oligonucleotide
  Target: ATXN1; (-) strand; PAM type: NRG; PAM sequence: GGG
atttgtttctgatgcatgca

SEQ ID NO: 69316 - DNA, 20 bp, Artificial Sequence
  Description of Artificial Sequence: Synthetic oligonucleotide
  Target: ATXN1; (-) strand; PAM type: NRG; PAM sequence: AGG
aatttgtttctgatgcatgc

SEQ ID NO: 69317 - DNA, 20 bp, Artificial Sequence
  Description of Artificial Sequence: Synthetic oligonucleotide
  Target: ATXN1; (-) strand; PAM type: NRG; PAM sequence: CAG
taatttgtttctgatgcatg

SEQ ID NO: 69318 - DNA, 20 bp, Artificial Sequence
  Description of Artificial Sequence: Synthetic oligonucleotide
  Target: ATXN1; (-) strand; PAM type: NRG; PAM sequence: GGG
ggtgtgtcatctgcctctaa

SEQ ID NO: 69319 - DNA, 20 bp, Artificial Sequence
  Description of Artificial Sequence: Synthetic oligonucleotide
  Target: ATXN1; (-) strand; PAM type: NRG; PAM sequence: AGG
cggtgtgtcatctgcctcta

SEQ ID NO: 69320 - DNA, 20 bp, Artificial Sequence
  Description of Artificial Sequence: Synthetic oligonucleotide
  Target: ATXN1; (-) strand; PAM type: NRG; PAM sequence: AAG
tcggtgtgtcatctgcctct

SEQ ID NO: 69321 - DNA, 20 bp, Artificial Sequence
  Description of Artificial Sequence: Synthetic oligonucleotide
  Target: ATXN1; (-) strand; PAM type: NRG; PAM sequence: CGG
agagaggatctttctgcctt

SEQ ID NO: 69322 - DNA, 20 bp, Artificial Sequence
  Description of Artificial Sequence: Synthetic oligonucleotide
  Target: ATXN1; (-) strand; PAM type: NRG; PAM sequence: AGG
aaaggctttgctttgcagag

SEQ ID NO: 69323 - DNA, 20 bp, Artificial Sequence
  Description of Artificial Sequence: Synthetic oligonucleotide
  Target: ATXN1; (-) strand; PAM type: NRG; PAM sequence: GAG
caaaggctttgctttgcaga

SEQ ID NO: 69324 - DNA, 20 bp, Artificial Sequence
  Description of Artificial Sequence: Synthetic oligonucleotide
  Target: ATXN1; (-) strand; PAM type: NRG; PAM sequence: GAG
aacaaaggctttgctttgca

SEQ ID NO: 69325 - DNA, 20 bp, Artificial Sequence
  Description of Artificial Sequence: Synthetic oligonucleotide
  Target: ATXN1; (-) strand; PAM type: NRG; PAM sequence: CAG
taaacaaaggctttgctttg

SEQ ID NO: 69326 - DNA, 20 bp, Artificial Sequence
  Description of Artificial Sequence: Synthetic oligonucleotide
  Target: ATXN1; (-) strand; PAM type: NRG; PAM sequence: AGG
ctcctctcagacttaaacaa

SEQ ID NO: 69327 - DNA, 20 bp, Artificial Sequence
  Description of Artificial Sequence: Synthetic oligonucleotide
  Target: ATXN1; (-) strand; PAM type: NRG; PAM sequence: AAG
actcctctcagacttaaaca

SEQ ID NO: 69328 - DNA, 20 bp, Artificial Sequence
  Description of Artificial Sequence: Synthetic oligonucleotide
  Target: ATXN1; (-) strand; PAM type: NRG; PAM sequence: CAG
ggttggattggcactcctct

SEQ ID NO: 69329 - DNA, 20 bp, Artificial Sequence
  Description of Artificial Sequence: Synthetic oligonucleotide
  Target: ATXN1; (-) strand; PAM type: NRG; PAM sequence: TGG
tcctttttttgaggttggat

SEQ ID NO: 69330 - DNA, 20 bp, Artificial Sequence
  Description of Artificial Sequence: Synthetic oligonucleotide
  Target: ATXN1; (-) strand; PAM type: NRG; PAM sequence: TGG
ttttctcctttttttgaggt

SEQ ID NO: 69331 - DNA, 20 bp, Artificial Sequence
  Description of Artificial Sequence: Synthetic oligonucleotide
  Target: ATXN1; (-) strand; PAM type: NRG; PAM sequence: AGG
ctccttttctcctttttttg

SEQ ID NO: 69332 - DNA, 20 bp, Artificial Sequence
  Description of Artificial Sequence: Synthetic oligonucleotide
  Target: ATXN1; (-) strand; PAM type: NRG; PAM sequence: GAG
tctccttttctccttttttt

SEQ ID NO: 69333 - DNA, 20 bp, Artificial Sequence
  Description of Artificial Sequence: Synthetic oligonucleotide
  Target: ATXN1; (-) strand; PAM type: NRG; PAM sequence: TGG
agtactctgtttctgtggca

SEQ ID NO: 69334 - DNA, 20 bp, Artificial Sequence
  Description of Artificial Sequence: Synthetic oligonucleotide
  Target: ATXN1; (-) strand; PAM type: NRG; PAM sequence: TGG
cgaacagtactctgtttctg

SEQ ID NO: 69335 - DNA, 20 bp, Artificial Sequence
  Description of Artificial Sequence: Synthetic oligonucleotide
  Target: ATXN1; (-) strand; PAM type: NRG; PAM sequence: CAG
gtcaagaaaagagttccgaa

SEQ ID NO: 69336 - DNA, 20 bp, Artificial Sequence
  Description of Artificial Sequence: Synthetic oligonucleotide
  Target: ATXN1; (-) strand; PAM type: NRG; PAM sequence: GAG
gaaacatcatgtcaagaaaa

SEQ ID NO: 69337 - DNA, 20 bp, Artificial Sequence
  Description of Artificial Sequence: Synthetic oligonucleotide
  Target: ATXN1; (-) strand; PAM type: NRG; PAM sequence: AAG
gggaaacatcatgtcaagaa

SEQ ID NO: 69338 - DNA, 20 bp, Artificial Sequence
  Description of Artificial Sequence: Synthetic oligonucleotide
  Target: ATXN1; (-) strand; PAM type: NRG; PAM sequence: AAG
ggcaagggaaacatcatgtc

SEQ ID NO: 69339 - DNA, 20 bp, Artificial Sequence
  Description of Artificial Sequence: Synthetic oligonucleotide
  Target: ATXN1; (-) strand; PAM type: NRG; PAM sequence: GGG
gtgttcgagcggaaaggcaa

SEQ ID NO: 69340 - DNA, 20 bp, Artificial Sequence
  Description of Artificial Sequence: Synthetic oligonucleotide
  Target: ATXN1; (-) strand; PAM type: NRG; PAM sequence: AGG
cgtgttcgagcggaaaggca

SEQ ID NO: 69341 - DNA, 20 bp, Artificial Sequence
  Description of Artificial Sequence: Synthetic oligonucleotide
  Target: ATXN1; (-) strand; PAM type: NRG; PAM sequence: AAG
ccgtgttcgagcggaaaggc

SEQ ID NO: 69342 - DNA, 20 bp, Artificial Sequence
  Description of Artificial Sequence: Synthetic oligonucleotide
  Target: ATXN1; (-) strand; PAM type: NRG; PAM sequence: AGG
catcccgtgttcgagcggaa

SEQ ID NO: 69343 - DNA, 20 bp, Artificial Sequence
  Description of Artificial Sequence: Synthetic oligonucleotide
  Target: ATXN1; (-) strand; PAM type: NRG; PAM sequence: AAG
gcatcccgtgttcgagcgga

SEQ ID NO: 69344 - DNA, 20 bp, Artificial Sequence
  Description of Artificial Sequence: Synthetic oligonucleotide
  Target: ATXN1; (-) strand; PAM type: NRG; PAM sequence: CGG
agatgcatcccgtgttcgag

SEQ ID NO: 69345 - DNA, 20 bp, Artificial Sequence
  Description of Artificial Sequence: Synthetic oligonucleotide
  Target: ATXN1; (-) strand; PAM type: NRG; PAM sequence: GAG
agaagatgcatcccgtgttc

SEQ ID NO: 69346 - DNA, 20 bp, Artificial Sequence
  Description of Artificial Sequence: Synthetic oligonucleotide
  Target: ATXN1; (-) strand; PAM type: NRG; PAM sequence: AAG
tccagttttctcttccccag

SEQ ID NO: 69347 - DNA, 20 bp, Artificial Sequence
  Description of Artificial Sequence: Synthetic oligonucleotide
  Target: ATXN1; (-) strand; PAM type: NRG; PAM sequence: CAG
acttccagttttctcttccc

SEQ ID NO: 69348 - DNA, 20 bp, Artificial Sequence
  Description of Artificial Sequence: Synthetic oligonucleotide
  Target: ATXN1; (-) strand; PAM type: NRG; PAM sequence: CAG
gtcccctgtcattgcacttc

SEQ ID NO: 69349 - DNA, 20 bp, Artificial Sequence
  Description of Artificial Sequence: Synthetic oligonucleotide
  Target: ATXN1; (-) strand; PAM type: NRG; PAM sequence: CAG
tttcttgattctcagcattg

SEQ ID NO: 69350 - DNA, 20 bp, Artificial Sequence
  Description of Artificial Sequence: Synthetic oligonucleotide
  Target: ATXN1; (-) strand; PAM type: NRG; PAM sequence: CAG
aaattctgtttcttgattct

SEQ ID NO: 69351 - DNA, 20 bp, Artificial Sequence
  Description of Artificial Sequence: Synthetic oligonucleotide
  Target: ATXN1; (-) strand; PAM type: NRG; PAM sequence: TGG
cactctataatgtttattat

SEQ ID NO: 69352 - DNA, 20 bp, Artificial Sequence
  Description of Artificial Sequence: Synthetic oligonucleotide
  Target: ATXN1; (-) strand; PAM type: NRG; PAM sequence: AAG
ttaagagactgacacagagt

SEQ ID NO: 69353 - DNA, 20 bp, Artificial Sequence
  Description of Artificial Sequence: Synthetic oligonucleotide
  Target: ATXN1; (-) strand; PAM type: NRG; PAM sequence: GAG
ataattaagagactgacaca

SEQ ID NO: 69354 - DNA, 20 bp, Artificial Sequence
  Description of Artificial Sequence: Synthetic oligonucleotide
  Target: ATXN1; (-) strand; PAM type: NRG; PAM sequence: CAG
taataattaagagactgaca

SEQ ID NO: 69355 - DNA, 20 bp, Artificial Sequence
  Description of Artificial Sequence: Synthetic oligonucleotide
  Target: ATXN1; (-) strand; PAM type: NRG; PAM sequence: GAG
ataattataataataattaa

SEQ ID NO: 69356 - DNA, 20 bp, Artificial Sequence
  Description of Artificial Sequence: Synthetic oligonucleotide
  Target: ATXN1; (-) strand; PAM type: NRG; PAM sequence: AAG
aaataattataataataatt

SEQ ID NO: 69357 - DNA, 20 bp, Artificial Sequence
  Description of Artificial Sequence: Synthetic oligonucleotide
  Target: ATXN1; (-) strand; PAM type: NRG; PAM sequence: AAG
ctccagcctggtgacagaac

SEQ ID NO: 69358 - DNA, 20 bp, Artificial Sequence
  Description of Artificial Sequence: Synthetic oligonucleotide
  Target: ATXN1; (-) strand; PAM type: NRG; PAM sequence: CAG
actgcactccagcctggtga

SEQ ID NO: 69359 - DNA, 20 bp, Artificial Sequence
  Description of Artificial Sequence: Synthetic oligonucleotide
  Target: ATXN1; (-) strand; PAM type: NRG; PAM sequence: TGG
catgctactgcactccagcc

SEQ ID NO: 69360 - DNA, 20 bp, Artificial Sequence
  Description of Artificial Sequence: Synthetic oligonucleotide
  Target: ATXN1; (-) strand; PAM type: NRG; PAM sequence: CAG
gagatcatgctactgcactc

SEQ ID NO: 69361 - DNA, 20 bp, Artificial Sequence
  Description of Artificial Sequence: Synthetic oligonucleotide
  Target: ATXN1; (-) strand; PAM type: NRG; PAM sequence: GAG
ggcggaggttgcattgagcc

SEQ ID NO: 69362 - DNA, 20 bp, Artificial Sequence
  Description of Artificial Sequence: Synthetic oligonucleotide
  Target: ATXN1; (-) strand; PAM type: NRG; PAM sequence: GAG
caggaggcggaggttgcatt

SEQ ID NO: 69363 - DNA, 20 bp, Artificial Sequence
  Description of Artificial Sequence: Synthetic oligonucleotide
  Target: ATXN1; (-) strand; PAM type: NRG; PAM sequence: AGG
cacttgaacccaggaggcgg

SEQ ID NO: 69364 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacccaggaggcg

SEQ ID NO: 69365 - DNA, 20 bp, Artificial Sequence
  Description of Artificial Sequence: Synthetic oligonucleotide
  Target: ATXN1; (-) strand; PAM type: NRG; PAM sequence: CGG
aatcacttgaacccaggagg

SEQ ID NO: 69366 - DNA, 20 bp, Artificial Sequence
  Description of Artificial Sequence: Synthetic oligonucleotide
  Target: ATXN1; (-) strand; PAM type: NRG; PAM sequence: AGG
gggaatcacttgaacccagg

SEQ ID NO: 69367 - DNA, 20 bp, Artificial Sequence
  Description of Artificial Sequence: Synthetic oligonucleotide
  Target: ATXN1; (-) strand; PAM type: NRG; PAM sequence: GAG
ggggaatcacttgaacccag

SEQ ID NO: 69368 - DNA, 20 bp, Artificial Sequence
  Description of Artificial Sequence: Synthetic oligonucleotide
  Target: ATXN1; (-) strand; PAM type: NRG; PAM sequence: AGG
caggggaatcacttgaaccc

SEQ ID NO: 69369 - DNA, 20 bp, Artificial Sequence
  Description of Artificial Sequence: Synthetic oligonucleotide
  Target: ATXN1; (-) strand; PAM type: NRG; PAM sequence: CAG
gcaggggaatcacttgaacc

SEQ ID NO: 69370 - DNA, 20 bp, Artificial Sequence
  Description of Artificial Sequence: Synthetic oligonucleotide
  Target: ATXN1; (-) strand; PAM type: NRG; PAM sequence: GGG
tacttgggaggctgaggcag

SEQ ID NO: 69371 - DNA, 20 bp, Artificial Sequence
  Description of Artificial Sequence: Synthetic oligonucleotide
  Target: ATXN1; (-) strand; PAM type: NRG; PAM sequence: GGG
ctacttgggaggctgaggca

SEQ ID NO: 69372 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 69373 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 69374 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 69375 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 69376 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctacttggg

SEQ ID NO: 69377 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacttgg

SEQ ID NO: 69378 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagctactt

SEQ ID NO: 69379 - DNA, 20 bp, Artificial Sequence
  Description of Artificial Sequence: Synthetic oligonucleotide
  Target: ATXN1; (-) strand; PAM type: NRG; PAM sequence: TGG
cgcctgtagtcccagctact

SEQ ID NO: 69380 - DNA, 20 bp, Artificial Sequence
  Description of Artificial Sequence: Synthetic oligonucleotide
  Target: ATXN1; (-) strand; PAM type: NRG; PAM sequence: CAG
gtggcacgcgcctgtagtcc

SEQ ID NO: 69381 - DNA, 20 bp, Artificial Sequence
  Description of Artificial Sequence: Synthetic oligonucleotide
  Target: ATXN1; (-) strand; PAM type: NRG; PAM sequence: TAG
ggcgtggtggcacgcgcctg

SEQ ID NO: 69382 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggcgtgg

SEQ ID NO: 69383 - DNA, 20 bp, Artificial Sequence
  Description of Artificial Sequence: Synthetic oligonucleotide
  Target: ATXN1; (-) strand; PAM type: NRG; PAM sequence: TGG
tataaaaaattagccaggcg

SEQ ID NO: 69384 - DNA, 20 bp, Artificial Sequence
  Description of Artificial Sequence: Synthetic oligonucleotide
  Target: ATXN1; (-) strand; PAM type: NRG; PAM sequence: AGG
aaaaatataaaaaattagcc

SEQ ID NO: 69385 - DNA, 20 bp, Artificial Sequence
  Description of Artificial Sequence: Synthetic oligonucleotide
  Target: ATXN1; (-) strand; PAM type: NRG; PAM sequence: CAG
taaaaatataaaaaattagc

SEQ ID NO: 69386 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatataaaaaat

SEQ ID NO: 69387 - DNA, 20 bp, Artificial Sequence
  Description of Artificial Sequence: Synthetic oligonucleotide
  Target: ATXN1; (-) strand; PAM type: NRG; PAM sequence: TGG
cgagaccatcctggccaaca

SEQ ID NO: 69388 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagaccatcc

SEQ ID NO: 69389 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttc

SEQ ID NO: 69390 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcag

SEQ ID NO: 69391 - DNA, 20 bp, Artificial Sequence
  Description of Artificial Sequence: Synthetic oligonucleotide
  Target: ATXN1; (-) strand; PAM type: NRG; PAM sequence: AGG
tgggtggatcacctgaggtc

SEQ ID NO: 69392 - DNA, 20 bp, Artificial Sequence
  Description of Artificial Sequence: Synthetic oligonucleotide
  Target: ATXN1; (-) strand; PAM type: NRG; PAM sequence: CAG
gtgggtggatcacctgaggt

SEQ ID NO: 69393 - DNA, 20 bp, Artificial Sequence
  Description of Artificial Sequence: Synthetic oligonucleotide
  Target: ATXN1; (-) strand; PAM type: NRG; PAM sequence: AGG
tgaggtgggtggatcacctg

SEQ ID NO: 69394 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggtggatcacct

SEQ ID NO: 69395 - DNA, 20 bp, Artificial Sequence
  Description of Artificial Sequence: Synthetic oligonucleotide
  Target: ATXN1; (-) strand; PAM type: NRG; PAM sequence: TGG
ctctgggaggctgaggtggg

SEQ ID NO: 69396 - DNA, 20 bp, Artificial Sequence
  Description of Artificial Sequence: Synthetic oligonucleotide
  Target: ATXN1; (-) strand; PAM type: NRG; PAM sequence: GGG
gcactctgggaggctgaggt

SEQ ID NO: 69397 - DNA, 20 bp, Artificial Sequence
  Description of Artificial Sequence: Synthetic oligonucleotide
  Target: ATXN1; (-) strand; PAM type: NRG; PAM sequence: TGG
agcactctgggaggctgagg

SEQ ID NO: 69398 - DNA, 20 bp, Artificial Sequence
  Description of Artificial Sequence: Synthetic oligonucleotide
  Target: ATXN1; (-) strand; PAM type: NRG; PAM sequence: AGG
cccagcactctgggaggctg

SEQ ID NO: 69399 - DNA, 20 bp, Artificial Sequence
  Description of Artificial Sequence: Synthetic oligonucleotide
  Target: ATXN1; (-) strand; PAM type: NRG; PAM sequence: GAG
tcccagcactctgggaggct

SEQ ID NO: 69400 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactctggg

SEQ ID NO: 69401 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactctgg

SEQ ID NO: 69402 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcactct

SEQ ID NO: 69403 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagcactc

SEQ ID NO: 69404 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctgtaatcc

SEQ ID NO: 69405 - DNA, 20 bp, Artificial Sequence
  Description of Artificial Sequence: Synthetic oligonucleotide
  Target: ATXN1; (-) strand; PAM type: NRG; PAM sequence: TGG
tgaatcagttccgggcgcag

SEQ ID NO: 69406 - DNA, 20 bp, Artificial Sequence
  Description of Artificial Sequence: Synthetic oligonucleotide
  Target: ATXN1; (-) strand; PAM type: NRG; PAM sequence: CAG
agctgaatcagttccgggcg

SEQ ID NO: 69407 - DNA, 20 bp, Artificial Sequence
  Description of Artificial Sequence: Synthetic oligonucleotide
  Target: ATXN1; (-) strand; PAM type: NRG; PAM sequence: GGG
gggagagctgaatcagttcc

SEQ ID NO: 69408 - DNA, 20 bp, Artificial Sequence
  Description of Artificial Sequence: Synthetic oligonucleotide
  Target: ATXN1; (-) strand; PAM type: NRG; PAM sequence: CGG
tgggagagctgaatcagttc

SEQ ID NO: 69409 - DNA, 20 bp, Artificial Sequence
  Description of Artificial Sequence: Synthetic oligonucleotide
  Target: ATXN1; (-) strand; PAM type: NRG; PAM sequence: CAG
ggctgttgggagagctgaat

SEQ ID NO: 69410 - DNA, 20 bp, Artificial Sequence
  Description of Artificial Sequence: Synthetic oligonucleotide
  Target: ATXN1; (-) strand; PAM type: NRG; PAM sequence: GAG
atctcactgggctgttggga

SEQ ID NO: 69411 - DNA, 20 bp, Artificial Sequence
  Description of Artificial Sequence: Synthetic oligonucleotide
  Target: ATXN1; (-) strand; PAM type: NRG; PAM sequence: GAG
tcatctcactgggctgttgg

SEQ ID NO: 69412 - DNA, 20 bp, Artificial Sequence
  Description of Artificial Sequence: Synthetic oligonucleotide
  Target: ATXN1; (-) strand; PAM type: NRG; PAM sequence: GGG
actcatctcactgggctgtt

SEQ ID NO: 69413 - DNA, 20 bp, Artificial Sequence
  Description of Artificial Sequence: Synthetic oligonucleotide
  Target: ATXN1; (-) strand; PAM type: NRG; PAM sequence: TGG
aactcatctcactgggctgt

SEQ ID NO: 69414 - DNA, 20 bp, Artificial Sequence
  Description of Artificial Sequence: Synthetic oligonucleotide
  Target: ATXN1; (-) strand; PAM type: NRG; PAM sequence: GGG
ataatagaactcatctcact

SEQ ID NO: 69415 - DNA, 20 bp, Artificial Sequence
  Description of Artificial Sequence: Synthetic oligonucleotide
  Target: ATXN1; (-) strand; PAM type: NRG; PAM sequence: TGG
aataatagaactcatctcac

SEQ ID NO: 69416 - DNA, 20 bp, Artificial Sequence
  Description of Artificial Sequence: Synthetic oligonucleotide
  Target: ATXN1; (-) strand; PAM type: NRG; PAM sequence: TAG
ctgtacaatgggaataataa

SEQ ID NO: 69417 - DNA, 20 bp, Artificial Sequence
  Description of Artificial Sequence: Synthetic oligonucleotide
  Target: ATXN1; (-) strand; PAM type: NRG; PAM sequence: GGG
agtactccaatctgtacaat

SEQ ID NO: 69418 - DNA, 20 bp, Artificial Sequence
  Description of Artificial Sequence: Synthetic oligonucleotide
  Target: ATXN1; (-) strand; PAM type: NRG; PAM sequence: TGG
cagtactccaatctgtacaa

SEQ ID NO: 69419 - DNA, 20 bp, Artificial Sequence
  Description of Artificial Sequence: Synthetic oligonucleotide
  Target: ATXN1; (-) strand; PAM type: NRG; PAM sequence: CAG
ttacctaccctcttgtgcct

SEQ ID NO: 69420 - DNA, 20 bp, Artificial Sequence
  Description of Artificial Sequence: Synthetic oligonucleotide
  Target: ATXN1; (-) strand; PAM type: NRG; PAM sequence: AGG
ccatttatcagtgtgacttc

SEQ ID NO: 69421 - DNA, 20 bp, Artificial Sequence
  Description of Artificial Sequence: Synthetic oligonucleotide
  Target: ATXN1; (-) strand; PAM type: NRG; PAM sequence: CAG
gccatttatcagtgtgactt

SEQ ID NO: 69422 - DNA, 20 bp, Artificial Sequence
  Description of Artificial Sequence: Synthetic oligonucleotide
  Target: ATXN1; (-) strand; PAM type: NRG; PAM sequence: CAG
tcccaactgcagccatttat

SEQ ID NO: 69423 - DNA, 20 bp, Artificial Sequence
  Description of Artificial Sequence: Synthetic oligonucleotide
  Target: ATXN1; (-) strand; PAM type: NRG; PAM sequence: CAG
ttggctttgaatcccaactg

SEQ ID NO: 69424 - DNA, 20 bp, Artificial Sequence
  Description of Artificial Sequence: Synthetic oligonucleotide
  Target: ATXN1; (-) strand; PAM type: NRG; PAM sequence: TGG
gactctagagcctaactcct

SEQ ID NO: 69425 - DNA, 20 bp, Artificial Sequence
  Description of Artificial Sequence: Synthetic oligonucleotide
  Target: ATXN1; (-) strand; PAM type: NRG; PAM sequence: GAG
agtttaatatagtgactcta

SEQ ID NO: 69426 - DNA, 20 bp, Artificial Sequence
  Description of Artificial Sequence: Synthetic oligonucleotide
  Target: ATXN1; (-) strand; PAM type: NRG; PAM sequence: TAG
gcagtttaatatagtgactc

SEQ ID NO: 69427 - DNA, 20 bp, Artificial Sequence
  Description of Artificial Sequence: Synthetic oligonucleotide
  Target: ATXN1; (-) strand; PAM type: NRG; PAM sequence: TAG
cttaaccaggcagtttaata

SEQ ID NO: 69428 - DNA, 20 bp, Artificial Sequence
  Description of Artificial Sequence: Synthetic oligonucleotide
  Target: ATXN1; (-) strand; PAM type: NRG; PAM sequence: CAG
tattgctgttcttaaccagg

SEQ ID NO: 69429 - DNA, 20 bp, Artificial Sequence
  Description of Artificial Sequence: Synthetic oligonucleotide
  Target: ATXN1; (-) strand; PAM type: NRG; PAM sequence: AGG
taatattgctgttcttaacc

SEQ ID NO: 69430 - DNA, 20 bp, Artificial Sequence
  Description of Artificial Sequence: Synthetic oligonucleotide
  Target: ATXN1; (-) strand; PAM type: NRG; PAM sequence: CAG
gtaatattgctgttcttaac

SEQ ID NO: 69431 - DNA, 20 bp, Artificial Sequence
  Description of Artificial Sequence: Synthetic oligonucleotide
  Target: ATXN1; (-) strand; PAM type: NRG; PAM sequence: AAG
ccattccaagcagagggaaa

SEQ ID NO: 69432 - DNA, 20 bp, Artificial Sequence
  Description of Artificial Sequence: Synthetic oligonucleotide
  Target: ATXN1; (-) strand; PAM type: NRG; PAM sequence: GGG
agacagccattccaagcaga

SEQ ID NO: 69433 - DNA, 20 bp, Artificial Sequence
  Description of Artificial Sequence: Synthetic oligonucleotide
  Target: ATXN1; (-) strand; PAM type: NRG; PAM sequence: AGG
gagacagccattccaagcag

SEQ ID NO: 69434 - DNA, 20 bp, Artificial Sequence
  Description of Artificial Sequence: Synthetic oligonucleotide
  Target: ATXN1; (-) strand; PAM type: NRG; PAM sequence: GAG
tgagacagccattccaagca

SEQ ID NO: 69435 - DNA, 20 bp, Artificial Sequence
  Description of Artificial Sequence: Synthetic oligonucleotide
  Target: ATXN1; (-) strand; PAM type: NRG; PAM sequence: CAG
catgagacagccattccaag

SEQ ID NO: 69436 - DNA, 20 bp, Artificial Sequence
  Description of Artificial Sequence: Synthetic oligonucleotide
  Target: ATXN1; (-) strand; PAM type: NRG; PAM sequence: AAG
atacatgagacagccattcc

SEQ ID NO: 69437 - DNA, 20 bp, Artificial Sequence
  Description of Artificial Sequence: Synthetic oligonucleotide
  Target: ATXN1; (-) strand; PAM type: NRG; PAM sequence: CAG
tcataagtaaatacatgaga

SEQ ID NO: 69438 - DNA, 20 bp, Artificial Sequence
  Description of Artificial Sequence: Synthetic oligonucleotide
  Target: ATXN1; (-) strand; PAM type: NRG; PAM sequence: GAG
gaactcataagtaaatacat

SEQ ID NO: 69439 - DNA, 20 bp, Artificial Sequence
  Description of Artificial Sequence: Synthetic oligonucleotide
  Target: ATXN1; (-) strand; PAM type: NRG; PAM sequence: AAG
ctgttgggagaggaactcat

SEQ ID NO: 69440 - DNA, 20 bp, Artificial Sequence
  Description of Artificial Sequence: Synthetic oligonucleotide
  Target: ATXN1; (-) strand; PAM type: NRG; PAM sequence: AGG
gtagaaggctctgttgggag

SEQ ID NO: 69441 - DNA, 20 bp, Artificial Sequence
  Description of Artificial Sequence: Synthetic oligonucleotide
  Target: ATXN1; (-) strand; PAM type: NRG; PAM sequence: GAG
agtagaaggctctgttggga

SEQ ID NO: 69442 - DNA, 20 bp, Artificial Sequence
  Description of Artificial Sequence: Synthetic oligonucleotide
  Target: ATXN1; (-) strand; PAM type: NRG; PAM sequence: GAG
tcagtagaaggctctgttgg

SEQ ID NO: 69443 - DNA, 20 bp, Artificial Sequence
  Description of Artificial Sequence: Synthetic oligonucleotide
  Target: ATXN1; (-) strand; PAM type: NRG; PAM sequence: GGG
tttcagtagaaggctctgtt

SEQ ID NO: 69444 - DNA, 20 bp, Artificial Sequence
  Description of Artificial Sequence: Synthetic oligonucleotide
  Target: ATXN1; (-) strand; PAM type: NRG; PAM sequence: TGG
ctttcagtagaaggctctgt

SEQ ID NO: 69445 - DNA, 20 bp, Artificial Sequence
  Description of Artificial Sequence: Synthetic oligonucleotide
  Target: ATXN1; (-) strand; PAM type: NRG; PAM sequence: AGG
attgaacacctttcagtaga

SEQ ID NO: 69446 - DNA, 20 bp, Artificial Sequence
  Description of Artificial Sequence: Synthetic oligonucleotide
  Target: ATXN1; (-) strand; PAM type: NRG; PAM sequence: AAG
tattgaacacctttcagtag

SEQ ID NO: 69447 - DNA, 20 bp, Artificial Sequence
  Description of Artificial Sequence: Synthetic oligonucleotide
  Target: ATXN1; (-) strand; PAM type: NRG; PAM sequence: TAG
cggtattgaacacctttcag

SEQ ID NO: 69448 - DNA, 20 bp, Artificial Sequence
  Description of Artificial Sequence: Synthetic oligonucleotide
  Target: ATXN1; (-) strand; PAM type: NRG; PAM sequence: CAG
acacggtattgaacaccttt

SEQ ID NO: 69449 - DNA, 20 bp, Artificial Sequence
  Description of Artificial Sequence: Synthetic oligonucleotide
  Target: ATXN1; (-) strand; PAM type: NRG; PAM sequence: CGG
ataccttcactctatgaaca

SEQ ID NO: 69450 - DNA, 20 bp, Artificial Sequence
  Description of Artificial Sequence: Synthetic oligonucleotide
  Target: ATXN1; (-) strand; PAM type: NRG; PAM sequence: CAG
atttaaggattaattagagt

SEQ ID NO: 69451 - DNA, 20 bp, Artificial Sequence
  Description of Artificial Sequence: Synthetic oligonucleotide
  Target: ATXN1; (-) strand; PAM type: NRG; PAM sequence: GAG
agcaatttaaggattaatta

SEQ ID NO: 69452 - DNA, 20 bp, Artificial Sequence
  Description of Artificial Sequence: Synthetic oligonucleotide
  Target: ATXN1; (-) strand; PAM type: NRG; PAM sequence: TAG
acagcaatttaaggattaat

SEQ ID NO: 69453 - DNA, 20 bp, Artificial Sequence
  Description of Artificial Sequence: Synthetic oligonucleotide
  Target: ATXN1; (-) strand; PAM type: NRG; PAM sequence: AGG
ctgtctcccacagcaattta

SEQ ID NO: 69454 - DNA, 20 bp, Artificial Sequence
  Description of Artificial Sequence: Synthetic oligonucleotide
  Target: ATXN1; (-) strand; PAM type: NRG; PAM sequence: AAG
cctgtctcccacagcaattt

SEQ ID NO: 69455 - DNA, 20 bp, Artificial Sequence
  Description of Artificial Sequence: Synthetic oligonucleotide
  Target: ATXN1; (-) strand; PAM type: NRG; PAM sequence: CAG
tattctcagcctgtctccca

SEQ ID NO: 69456 - DNA, 20 bp, Artificial Sequence
  Description of Artificial Sequence: Synthetic oligonucleotide
  Target: ATXN1; (-) strand; PAM type: NRG; PAM sequence: CAG
caagtttagtcatatattct

SEQ ID NO: 69457 - DNA, 20 bp, Artificial Sequence
  Description of Artificial Sequence: Synthetic oligonucleotide
  Target: ATXN1; (-) strand; PAM type: NRG; PAM sequence: TAG
tccttatttcaaaacaagtt

SEQ ID NO: 69458 - DNA, 20 bp, Artificial Sequence
  Description of Artificial Sequence: Synthetic oligonucleotide
  Target: ATXN1; (-) strand; PAM type: NRG; PAM sequence: AAG
cattttccttatttcaaaac

SEQ ID NO: 69459 - DNA, 20 bp, Artificial Sequence
  Description of Artificial Sequence: Synthetic oligonucleotide
  Target: ATXN1; (-) strand; PAM type: NRG; PAM sequence: AAG
aaagcaatatgaccttagac

SEQ ID NO: 69460 - DNA, 20 bp, Artificial Sequence
  Description of Artificial Sequence: Synthetic oligonucleotide
  Target: ATXN1; (-) strand; PAM type: NRG; PAM sequence: TAG
tattcaaagcaatatgacct

SEQ ID NO: 69461 - DNA, 20 bp, Artificial Sequence
  Description of Artificial Sequence: Synthetic oligonucleotide
  Target: ATXN1; (-) strand; PAM type: NRG; PAM sequence: AAG
ttacgatgagctcatattca

SEQ ID NO: 69462 - DNA, 20 bp, Artificial Sequence
  Description of Artificial Sequence: Synthetic oligonucleotide
  Target: ATXN1; (-) strand; PAM type: NRG; PAM sequence: GAG
accactggtttagttacgat

SEQ ID NO: 69463 - DNA, 20 bp, Artificial Sequence
  Description of Artificial Sequence: Synthetic oligonucleotide
  Target: ATXN1; (-) strand; PAM type: NRG; PAM sequence: TAG
ttttttttaaaccactggtt

SEQ ID NO: 69464 - DNA, 20 bp, Artificial Sequence
  Description of Artificial Sequence: Synthetic oligonucleotide
  Target: ATXN1; (-) strand; PAM type: NRG; PAM sequence: TGG
aaaaattttttttaaaccac

SEQ ID NO: 69465 - DNA, 20 bp, Artificial Sequence
  Description of Artificial Sequence: Synthetic oligonucleotide
  Target: ATXN1; (-) strand; PAM type: NRG; PAM sequence: TGG
gttttcttagaaaggtcctg

SEQ ID NO: 69466 - DNA, 20 bp, Artificial Sequence
  Description of Artificial Sequence: Synthetic oligonucleotide
  Target: ATXN1; (-) strand; PAM type: NRG; PAM sequence: AGG
gtaaaatagttttcttagaa

SEQ ID NO: 69467 - DNA, 20 bp, Artificial Sequence
  Description of Artificial Sequence: Synthetic oligonucleotide
  Target: ATXN1; (-) strand; PAM type: NRG; PAM sequence: AAG
tgtaaaatagttttcttaga

SEQ ID NO: 69468 - DNA, 20 bp, Artificial Sequence
  Description of Artificial Sequence: Synthetic oligonucleotide
  Target: ATXN1; (-) strand; PAM type: NRG; PAM sequence: TAG
gctatgtaaaatagttttct

SEQ ID NO: 69469 - DNA, 20 bp, Artificial Sequence
  Description of Artificial Sequence: Synthetic oligonucleotide
  Target: ATXN1; (-) strand; PAM type: NRG; PAM sequence: TAG
tattctgaggctatgtaaaa

SEQ ID NO: 69470 - DNA, 20 bp, Artificial Sequence
  Description of Artificial Sequence: Synthetic oligonucleotide
  Target: ATXN1; (-) strand; PAM type: NRG; PAM sequence: AGG
ttcagctctgtgatattctg

SEQ ID NO: 69471 - DNA, 20 bp, Artificial Sequence
  Description of Artificial Sequence: Synthetic oligonucleotide
  Target: ATXN1; (-) strand; PAM type: NRG; PAM sequence: GAG
cttcagctctgtgatattct

SEQ ID NO: 69472 - DNA, 20 bp, Artificial Sequence
  Description of Artificial Sequence: Synthetic oligonucleotide
  Target: ATXN1; (-) strand; PAM type: NRG; PAM sequence: CAG
cagcggggcagcttctcctt

SEQ ID NO: 69473 - DNA, 20 bp, Artificial Sequence
  Description of Artificial Sequence: Synthetic oligonucleotide
  Target: ATXN1; (-) strand; PAM type: NRG; PAM sequence: CAG
tattgaccggggcagcgggg

SEQ ID NO: 69474 - DNA, 20 bp, Artificial Sequence
  Description of Artificial Sequence: Synthetic oligonucleotide
  Target: ATXN1; (-) strand; PAM type: NRG; PAM sequence: GGG
ctctattgaccggggcagcg

SEQ ID NO: 69475 - DNA, 20 bp, Artificial Sequence
  Description of Artificial Sequence: Synthetic oligonucleotide
  Target: ATXN1; (-) strand; PAM type: NRG; PAM sequence: GGG
cctctattgaccggggcagc

SEQ ID NO: 69476 - DNA, 20 bp, Artificial Sequence
  Description of Artificial Sequence: Synthetic oligonucleotide
  Target: ATXN1; (-) strand; PAM type: NRG; PAM sequence: CGG
gcctctattgaccggggcag

SEQ ID NO: 69477 - DNA, 20 bp, Artificial Sequence
  Description of Artificial Sequence: Synthetic oligonucleotide
  Target: ATXN1; (-) strand; PAM type: NRG; PAM sequence: CAG
tcagcctctattgaccgggg

SEQ ID NO: 69478 - DNA, 20 bp, Artificial Sequence
  Description of Artificial Sequence: Synthetic oligonucleotide
  Target: ATXN1; (-) strand; PAM type: NRG; PAM sequence: GGG
ccctcagcctctattgaccg

SEQ ID NO: 69479 - DNA, 20 bp, Artificial Sequence
  Description of Artificial Sequence: Synthetic oligonucleotide
  Target: ATXN1; (-) strand; PAM type: NRG; PAM sequence: GGG
gccctcagcctctattgacc

SEQ ID NO: 69480 - DNA, 20 bp, Artificial Sequence
  Description of Artificial Sequence: Synthetic oligonucleotide
  Target: ATXN1; (-) strand; PAM type: NRG; PAM sequence: CGG
tgccctcagcctctattgac

SEQ ID NO: 69481 - DNA, 20 bp, Artificial Sequence
  Description of Artificial Sequence: Synthetic oligonucleotide
  Target: ATXN1; (-) strand; PAM type: NRG; PAM sequence: CAG
ttgaggctgtgggctgccct

SEQ ID NO: 69482 - DNA, 20 bp, Artificial Sequence
  Description of Artificial Sequence: Synthetic oligonucleotide
  Target: ATXN1; (-) strand; PAM type: NRG; PAM sequence: GGG
cccataaactttgaggctgt

SEQ ID NO: 69483 - DNA, 20 bp, Artificial Sequence
  Description of Artificial Sequence: Synthetic oligonucleotide
  Target: ATXN1; (-) strand; PAM type: NRG; PAM sequence: TGG
ccccataaactttgaggctg

SEQ ID NO: 69484 - DNA, 20 bp, Artificial Sequence
  Description of Artificial Sequence: Synthetic oligonucleotide
  Target: ATXN1; (-) strand; PAM type: NRG; PAM sequence: AGG
gaggctccccataaactttg

SEQ ID NO: 69485 - DNA, 20 bp, Artificial Sequence
  Description of Artificial Sequence: Synthetic oligonucleotide
  Target: ATXN1; (-) strand; PAM type: NRG; PAM sequence: GAG
agaggctccccataaacttt

SEQ ID NO: 69486 - DNA, 20 bp, Artificial Sequence
  Description of Artificial Sequence: Synthetic oligonucleotide
  Target: ATXN1; (-) strand; PAM type: NRG; PAM sequence: AGG
tgcattctgcaaagccccag

SEQ ID NO: 69487 - DNA, 20 bp, Artificial Sequence
  Description of Artificial Sequence: Synthetic oligonucleotide
  Target: ATXN1; (-) strand; PAM type: NRG; PAM sequence: GAG
ctgcattctgcaaagcccca

SEQ ID NO: 69488 - DNA, 20 bp, Artificial Sequence
  Description of Artificial Sequence: Synthetic oligonucleotide
  Target: ATXN1; (-) strand; PAM type: NRG; PAM sequence: CAG
gcctgcattctgcaaagccc

SEQ ID NO: 69489 - DNA, 20 bp, Artificial Sequence
  Description of Artificial Sequence: Synthetic oligonucleotide
  Target: ATXN1; (-) strand; PAM type: NRG; PAM sequence: AAG
tccccagcctgcattctgca

SEQ ID NO: 69490 - DNA, 20 bp, Artificial Sequence
  Description of Artificial Sequence: Synthetic oligonucleotide
  Target: ATXN1; (-) strand; PAM type: NRG; PAM sequence: CAG
gtggtgcagtagtgagtccc

SEQ ID NO: 69491 - DNA, 20 bp, Artificial Sequence
  Description of Artificial Sequence: Synthetic oligonucleotide
  Target: ATXN1; (-) strand; PAM type: NRG; PAM sequence: GAG
gtgttgcgtggtgcagtagt

SEQ ID NO: 69492 - DNA, 20 bp, Artificial Sequence
  Description of Artificial Sequence: Synthetic oligonucleotide
  Target: ATXN1; (-) strand; PAM type: NRG; PAM sequence: TAG
agtagtgttgcgtggtgcag

SEQ ID NO: 69493 - DNA, 20 bp, Artificial Sequence
  Description of Artificial Sequence: Synthetic oligonucleotide
  Target: ATXN1; (-) strand; PAM type: NRG; PAM sequence: CAG
cctagtagtgttgcgtggtg

SEQ ID NO: 69494 - DNA, 20 bp, Artificial Sequence
  Description of Artificial Sequence: Synthetic oligonucleotide
  Target: ATXN1; (-) strand; PAM type: NRG; PAM sequence: TGG
ggtgtcctagtagtgttgcg

SEQ ID NO: 69495 - DNA, 20 bp, Artificial Sequence
  Description of Artificial Sequence: Synthetic oligonucleotide
  Target: ATXN1; (-) strand; PAM type: NRG; PAM sequence: TAG
ggctgggtcaggtgtcctag

SEQ ID NO: 69496 - DNA, 20 bp, Artificial Sequence
  Description of Artificial Sequence: Synthetic oligonucleotide
  Target: ATXN1; (-) strand; PAM type: NRG; PAM sequence: TAG
cagggctgggtcaggtgtcc

SEQ ID NO: 69497 - DNA, 20 bp, Artificial Sequence
  Description of Artificial Sequence: Synthetic oligonucleotide
  Target: ATXN1; (-) strand; PAM type: NRG; PAM sequence: AGG
caaagtttcagggctgggtc

SEQ ID NO: 69498 - DNA, 20 bp, Artificial Sequence
  Description of Artificial Sequence: Synthetic oligonucleotide
  Target: ATXN1; (-) strand; PAM type: NRG; PAM sequence: CAG
tcaaagtttcagggctgggt

SEQ ID NO: 69499 - DNA, 20 bp, Artificial Sequence
  Description of Artificial Sequence: Synthetic oligonucleotide
  Target: ATXN1; (-) strand; PAM type: NRG; PAM sequence: GGG
tctctcaaagtttcagggct

SEQ ID NO: 69500 - DNA, 20 bp, Artificial Sequence
  Description of Artificial Sequence: Synthetic oligonucleotide
  Target: ATXN1; (-) strand; PAM type: NRG; PAM sequence: TGG
ctctctcaaagtttcagggc

SEQ ID NO: 69501 - DNA, 20 bp, Artificial Sequence
  Description of Artificial Sequence: Synthetic oligonucleotide
  Target: ATXN1; (-) strand; PAM type: NRG; PAM sequence: GGG
caccctctctcaaagtttca

SEQ ID NO: 69502 - DNA, 20 bp, Artificial Sequence
  Description of Artificial Sequence: Synthetic oligonucleotide
  Target: ATXN1; (-) strand; PAM type: NRG; PAM sequence: AGG
tcaccctctctcaaagtttc

SEQ ID NO: 69503 - DNA, 20 bp, Artificial Sequence
  Description of Artificial Sequence: Synthetic oligonucleotide
  Target: ATXN1; (-) strand; PAM type: NRG; PAM sequence: CAG
gtcaccctctctcaaagttt

SEQ ID NO: 69504 - DNA, 20 bp, Artificial Sequence
  Description of Artificial Sequence: Synthetic oligonucleotide
  Target: ATXN1; (-) strand; PAM type: NRG; PAM sequence: AAG
tggttggtcaccctctctca

SEQ ID NO: 69505 - DNA, 20 bp, Artificial Sequence
  Description of Artificial Sequence: Synthetic oligonucleotide
  Target: ATXN1; (-) strand; PAM type: NRG; PAM sequence: TGG
gtgagacttgaaggtgtggt

SEQ ID NO: 69506 - DNA, 20 bp, Artificial Sequence
  Description of Artificial Sequence: Synthetic oligonucleotide
  Target: ATXN1; (-) strand; PAM type: NRG; PAM sequence: TGG
atgggtgagacttgaaggtg

SEQ ID NO: 69507 - DNA, 20 bp, Artificial Sequence
  Description of Artificial Sequence: Synthetic oligonucleotide
  Target: ATXN1; (-) strand; PAM type: NRG; PAM sequence: AGG
cgtaaatgggtgagacttga

SEQ ID NO: 69508 - DNA, 20 bp, Artificial Sequence
  Description of Artificial Sequence: Synthetic oligonucleotide
  Target: ATXN1; (-) strand; PAM type: NRG; PAM sequence: AAG
tcgtaaatgggtgagacttg

SEQ ID NO: 69509 - DNA, 20 bp, Artificial Sequence
  Description of Artificial Sequence: Synthetic oligonucleotide
  Target: ATXN1; (-) strand; PAM type: NRG; PAM sequence: GAG
ggtcagagtcgtaaatgggt

SEQ ID NO: 69510 - DNA, 20 bp, Artificial Sequence
  Description of Artificial Sequence: Synthetic oligonucleotide
  Target: ATXN1; (-) strand; PAM type: NRG; PAM sequence: GGG
catgggtcagagtcgtaaat

SEQ ID NO: 69511 - DNA, 20 bp, Artificial Sequence
  Description of Artificial Sequence: Synthetic oligonucleotide
  Target: ATXN1; (-) strand; PAM type: NRG; PAM sequence: TGG
ccatgggtcagagtcgtaaa

SEQ ID NO: 69512 - DNA, 20 bp, Artificial Sequence
  Description of Artificial Sequence: Synthetic oligonucleotide
  Target: ATXN1; (-) strand; PAM type: NRG; PAM sequence: GAG
ctgccttcccccatgggtca

SEQ ID NO: 69513 - DNA, 20 bp, Artificial Sequence
  Description of Artificial Sequence: Synthetic oligonucleotide
  Target: ATXN1; (-) strand; PAM type: NRG; PAM sequence: CAG
ctctgccttcccccatgggt

SEQ ID NO: 69514 - DNA, 20 bp, Artificial Sequence
  Description of Artificial Sequence: Synthetic oligonucleotide
  Target: ATXN1; (-) strand; PAM type: NRG; PAM sequence: GGG
aatcctctgccttcccccat

SEQ ID NO: 69515 - DNA, 20 bp, Artificial Sequence
  Description of Artificial Sequence: Synthetic oligonucleotide
  Target: ATXN1; (-) strand; PAM type: NRG; PAM sequence: TGG
taatcctctgccttccccca

SEQ ID NO: 69516 - DNA, 20 bp, Artificial Sequence
  Description of Artificial Sequence: Synthetic oligonucleotide
  Target: ATXN1; (-) strand; PAM type: NRG; PAM sequence: AAG
tctgctggggtggaaggaga

SEQ ID NO: 69517 - DNA, 20 bp, Artificial Sequence
  Description of Artificial Sequence: Synthetic oligonucleotide
  Target: ATXN1; (-) strand; PAM type: NRG; PAM sequence: GAG
tccctctgctggggtggaag

SEQ ID NO: 69518 - DNA, 20 bp, Artificial Sequence
  Description of Artificial Sequence: Synthetic oligonucleotide
  Target: ATXN1; (-) strand; PAM type: NRG; PAM sequence: AGG
ggtccctctgctggggtgga

SEQ ID NO: 69519 - DNA, 20 bp, Artificial Sequence
  Description of Artificial Sequence: Synthetic oligonucleotide
  Target: ATXN1; (-) strand; PAM type: NRG; PAM sequence: AAG
aggtccctctgctggggtgg

SEQ ID NO: 69520 - DNA, 20 bp, Artificial Sequence
  Description of Artificial Sequence: Synthetic oligonucleotide
  Target: ATXN1; (-) strand; PAM type: NRG; PAM sequence: TGG
aacaggtccctctgctgggg

SEQ ID NO: 69521 - DNA, 20 bp, Artificial Sequence
  Description of Artificial Sequence: Synthetic oligonucleotide
  Target: ATXN1; (-) strand; PAM type: NRG; PAM sequence: GGG
aagaacaggtccctctgctg

SEQ ID NO: 69522 - DNA, 20 bp, Artificial Sequence
  Description of Artificial Sequence: Synthetic oligonucleotide
  Target: ATXN1; (-) strand; PAM type: NRG; PAM sequence: GGG
taagaacaggtccctctgct

SEQ ID NO: 69523 - DNA, 20 bp, Artificial Sequence
  Description of Artificial Sequence: Synthetic oligonucleotide
  Target: ATXN1; (-) strand; PAM type: NRG; PAM sequence: TGG
ctaagaacaggtccctctgc

SEQ ID NO: 69524 - DNA, 20 bp, Artificial Sequence
  Description of Artificial Sequence: Synthetic oligonucleotide
  Target: ATXN1; (-) strand; PAM type: NRG; PAM sequence: AGG
caagctgggaagctaagaac

SEQ ID NO: 69525 - DNA, 20 bp, Artificial Sequence
  Description of Artificial Sequence: Synthetic oligonucleotide
  Target: ATXN1; (-) strand; PAM type: NRG; PAM sequence: CAG
tcaagctgggaagctaagaa

SEQ ID NO: 69526 - DNA, 20 bp, Artificial Sequence
  Description of Artificial Sequence: Synthetic oligonucleotide
  Target: ATXN1; (-) strand; PAM type: NRG; PAM sequence: AAG
gacgctcaagctgggaagct

SEQ ID NO: 69527 - DNA, 20 bp, Artificial Sequence
  Description of Artificial Sequence: Synthetic oligonucleotide
  Target: ATXN1; (-) strand; PAM type: NRG; PAM sequence: AAG
aaagagacgctcaagctggg

SEQ ID NO: 69528 - DNA, 20 bp, Artificial Sequence
  Description of Artificial Sequence: Synthetic oligonucleotide
  Target: ATXN1; (-) strand; PAM type: NRG; PAM sequence: GGG
cagaaagagacgctcaagct

SEQ ID NO: 69529 - DNA, 20 bp, Artificial Sequence
  Description of Artificial Sequence: Synthetic oligonucleotide
  Target: ATXN1; (-) strand; PAM type: NRG; PAM sequence: TGG
acagaaagagacgctcaagc

SEQ ID NO: 69530 - DNA, 20 bp, Artificial Sequence
  Description of Artificial Sequence: Synthetic oligonucleotide
  Target: ATXN1; (-) strand; PAM type: NRG; PAM sequence: AAG
agaaacagaaagagacgctc

SEQ ID NO: 69531 - DNA, 20 bp, Artificial Sequence
  Description of Artificial Sequence: Synthetic oligonucleotide
  Target: ATXN1; (-) strand; PAM type: NRG; PAM sequence: GAG
tccaaagaaagaaacagaaa

SEQ ID NO: 69532 - DNA, 20 bp, Artificial Sequence
  Description of Artificial Sequence: Synthetic oligonucleotide
  Target: ATXN1; (-) strand; PAM type: NRG; PAM sequence: AAG
gctccaaagaaagaaacaga

SEQ ID NO: 69533 - DNA, 20 bp, Artificial Sequence
  Description of Artificial Sequence: Synthetic oligonucleotide
  Target: ATXN1; (-) strand; PAM type: NRG; PAM sequence: CAG
aagagctccaaagaaagaaa

SEQ ID NO: 69534 - DNA, 20 bp, Artificial Sequence
  Description of Artificial Sequence: Synthetic oligonucleotide
  Target: ATXN1; (-) strand; PAM type: NRG; PAM sequence: AAG
atacagaagagctccaaaga

SEQ ID NO: 69535 - DNA, 20 bp, Artificial Sequence
  Description of Artificial Sequence: Synthetic oligonucleotide
  Target: ATXN1; (-) strand; PAM type: NRG; PAM sequence: AAG
acaaatacagaagagctcca

SEQ ID NO: 69536 - DNA, 20 bp, Artificial Sequence
  Description of Artificial Sequence: Synthetic oligonucleotide
  Target: ATXN1; (-) strand; PAM type: NRG; PAM sequence: GAG
aaaaaggaacaaatacagaa

SEQ ID NO: 69537 - DNA, 20 bp, Artificial Sequence
  Description of Artificial Sequence: Synthetic oligonucleotide
  Target: ATXN1; (-) strand; PAM type: NRG; PAM sequence: AAG
tgaaaaaggaacaaatacag

SEQ ID NO: 69538 - DNA, 20 bp, Artificial Sequence
  Description of Artificial Sequence: Synthetic oligonucleotide
  Target: ATXN1; (-) strand; PAM type: NRG; PAM sequence: CAG
gactgaaaaaggaacaaata

SEQ ID NO: 69539 - DNA, 20 bp, Artificial Sequence
  Description of Artificial Sequence: Synthetic oligonucleotide
  Target: ATXN1; (-) strand; PAM type: NRG; PAM sequence: AGG
tcagccctcgggactgaaaa

SEQ ID NO: 69540 - DNA, 20 bp, Artificial Sequence
  Description of Artificial Sequence: Synthetic oligonucleotide
  Target: ATXN1; (-) strand; PAM type: NRG; PAM sequence: AAG
atcagccctcgggactgaaa

SEQ ID NO: 69541 - DNA, 20 bp, Artificial Sequence
  Description of Artificial Sequence: Synthetic oligonucleotide
  Target: ATXN1; (-) strand; PAM type: NRG; PAM sequence: GGG
gtttccagtgatcagccctc

SEQ ID NO: 69542 - DNA, 20 bp, Artificial Sequence
  Description of Artificial Sequence: Synthetic oligonucleotide
  Target: ATXN1; (-) strand; PAM type: NRG; PAM sequence: CGG
tgtttccagtgatcagccct

SEQ ID NO: 69543 - DNA, 20 bp, Artificial Sequence
  Description of Artificial Sequence: Synthetic oligonucleotide
  Target: ATXN1; (-) strand; PAM type: NRG; PAM sequence: CAG
gttgccctgtttccagtgat

SEQ ID NO: 69544 - DNA, 20 bp, Artificial Sequence
  Description of Artificial Sequence: Synthetic oligonucleotide
  Target: ATXN1; (-) strand; PAM type: NRG; PAM sequence: CAG
accagaggttgccctgtttc

SEQ ID NO: 69545 - DNA, 20 bp, Artificial Sequence
  Description of Artificial Sequence: Synthetic oligonucleotide
  Target: ATXN1; (-) strand; PAM type: NRG; PAM sequence: AGG
atgaaaaaccaggtcaccag

SEQ ID NO: 69546 - DNA, 20 bp, Artificial Sequence
  Description of Artificial Sequence: Synthetic oligonucleotide
  Target: ATXN1; (-) strand; PAM type: NRG; PAM sequence: GAG
gatgaaaaaccaggtcacca

SEQ ID NO: 69547 - DNA, 20 bp, Artificial Sequence
  Description of Artificial Sequence: Synthetic oligonucleotide
  Target: ATXN1; (-) strand; PAM type: NRG; PAM sequence: CAG
gtgatgaaaaaccaggtcac

SEQ ID NO: 69548 - DNA, 20 bp, Artificial Sequence
  Description of Artificial Sequence: Synthetic oligonucleotide
  Target: ATXN1; (-) strand; PAM type: NRG; PAM sequence: AGG
ctggctggtgatgaaaaacc

SEQ ID NO: 69549 - DNA, 20 bp, Artificial Sequence
  Description of Artificial Sequence: Synthetic oligonucleotide
  Target: ATXN1; (-) strand; PAM type: NRG; PAM sequence: CAG
cctggctggtgatgaaaaac

SEQ ID NO: 69550 - DNA, 20 bp, Artificial Sequence
  Description of Artificial Sequence: Synthetic oligonucleotide
  Target: ATXN1; (-) strand; PAM type: NRG; PAM sequence: TGG
ttgacttcttctgccctggc

SEQ ID NO: 69551 - DNA, 20 bp, Artificial Sequence
  Description of Artificial Sequence: Synthetic oligonucleotide
  Target: ATXN1; (-) strand; PAM type: NRG; PAM sequence: TGG
cactttgacttcttctgccc

SEQ ID NO: 69552 - DNA, 20 bp, Artificial Sequence
  Description of Artificial Sequence: Synthetic oligonucleotide
  Target: ATXN1; (-) strand; PAM type: NRG; PAM sequence: GAG
gagcagcgtgcaaagccctt

SEQ ID NO: 69553 - DNA, 20 bp, Artificial Sequence
  Description of Artificial Sequence: Synthetic oligonucleotide
  Target: ATXN1; (-) strand; PAM type: NRG; PAM sequence: AAG
gttctagggagcagcgtgca

SEQ ID NO: 69554 - DNA, 20 bp, Artificial Sequence
  Description of Artificial Sequence: Synthetic oligonucleotide
  Target: ATXN1; (-) strand; PAM type: NRG; PAM sequence: CAG
aggcgtccagttctagggag

SEQ ID NO: 69555 - DNA, 20 bp, Artificial Sequence
  Description of Artificial Sequence: Synthetic oligonucleotide
  Target: ATXN1; (-) strand; PAM type: NRG; PAM sequence: GAG
caaaggcgtccagttctagg

SEQ ID NO: 69556 - DNA, 20 bp, Artificial Sequence
  Description of Artificial Sequence: Synthetic oligonucleotide
  Target: ATXN1; (-) strand; PAM type: NRG; PAM sequence: GGG
ctcaaaggcgtccagttcta

SEQ ID NO: 69557 - DNA, 20 bp, Artificial Sequence
  Description of Artificial Sequence: Synthetic oligonucleotide
  Target: ATXN1; (-) strand; PAM type: NRG; PAM sequence: AGG
tctcaaaggcgtccagttct

SEQ ID NO: 69558 - DNA, 20 bp, Artificial Sequence
  Description of Artificial Sequence: Synthetic oligonucleotide
  Target: ATXN1; (-) strand; PAM type: NRG; PAM sequence: TAG
ttctcaaaggcgtccagttc

SEQ ID NO: 69559 - DNA, 20 bp, Artificial Sequence
  Description of Artificial Sequence: Synthetic oligonucleotide
  Target: ATXN1; (-) strand; PAM type: NRG; PAM sequence: CAG
ccagatttctcaaaggcgtc

SEQ ID NO: 69560 - DNA, 20 bp, Artificial Sequence
  Description of Artificial Sequence: Synthetic oligonucleotide
  Target: ATXN1; (-) strand; PAM type: NRG; PAM sequence: AGG
aagaatcccagatttctcaa

SEQ ID NO: 69561 - DNA, 20 bp, Artificial Sequence
  Description of Artificial Sequence: Synthetic oligonucleotide
  Target: ATXN1; (-) strand; PAM type: NRG; PAM sequence: AAG
gaagaatcccagatttctca

SEQ ID NO: 69562 - DNA, 20 bp, Artificial Sequence
  Description of Artificial Sequence: Synthetic oligonucleotide
  Target: ATXN1; (-) strand; PAM type: NRG; PAM sequence: CAG
tctgccgcctggaagaatcc

SEQ ID NO: 69563 - DNA, 20 bp, Artificial Sequence
  Description of Artificial Sequence: Synthetic oligonucleotide
  Target: ATXN1; (-) strand; PAM type: NRG; PAM sequence: AAG
gaatgaagtctgccgcctgg

SEQ ID NO: 69564 - DNA, 20 bp, Artificial Sequence
  Description of Artificial Sequence: Synthetic oligonucleotide
  Target: ATXN1; (-) strand; PAM type: NRG; PAM sequence: TGG
gtggaatgaagtctgccgcc

SEQ ID NO: 69565 - DNA, 20 bp, Artificial Sequence
  Description of Artificial Sequence: Synthetic oligonucleotide
  Target: ATXN1; (-) strand; PAM type: NRG; PAM sequence: AAG
ttttccaccactgtggaatg

SEQ ID NO: 69566 - DNA, 20 bp, Artificial Sequence
  Description of Artificial Sequence: Synthetic oligonucleotide
  Target: ATXN1; (-) strand; PAM type: NRG; PAM sequence: TGG
ggccagcttttccaccactg

SEQ ID NO: 69567 - DNA, 20 bp, Artificial Sequence
  Description of Artificial Sequence: Synthetic oligonucleotide
  Target: ATXN1; (-) strand; PAM type: NRG; PAM sequence: CAG
aattgctctctctccctggc

SEQ ID NO: 69568 - DNA, 20 bp, Artificial Sequence
  Description of Artificial Sequence: Synthetic oligonucleotide
  Target: ATXN1; (-) strand; PAM type: NRG; PAM sequence: TGG
gcaaaattgctctctctccc

SEQ ID NO: 69569 - DNA, 20 bp, Artificial Sequence
  Description of Artificial Sequence: Synthetic oligonucleotide
  Target: ATXN1; (-) strand; PAM type: NRG; PAM sequence: CGG
tcaggatacaggtccaagtg

SEQ ID NO: 69570 - DNA, 20 bp, Artificial Sequence
  Description of Artificial Sequence: Synthetic oligonucleotide
  Target: ATXN1; (-) strand; PAM type: NRG; PAM sequence: AAG
cggtgtcaggatacaggtcc

SEQ ID NO: 69571 - DNA, 20 bp, Artificial Sequence
  Description of Artificial Sequence: Synthetic oligonucleotide
  Target: ATXN1; (-) strand; PAM type: NRG; PAM sequence: AGG
atttggcggtgtcaggatac

SEQ ID NO: 69572 - DNA, 20 bp, Artificial Sequence
  Description of Artificial Sequence: Synthetic oligonucleotide
  Target: ATXN1; (-) strand; PAM type: NRG; PAM sequence: CAG
gatttggcggtgtcaggata

SEQ ID NO: 69573 - DNA, 20 bp, Artificial Sequence
  Description of Artificial Sequence: Synthetic oligonucleotide
  Target: ATXN1; (-) strand; PAM type: NRG; PAM sequence: AGG
tcctctgatttggcggtgtc

SEQ ID NO: 69574 - DNA, 20 bp, Artificial Sequence
  Description of Artificial Sequence: Synthetic oligonucleotide
  Target: ATXN1; (-) strand; PAM type: NRG; PAM sequence: CAG
ctcctctgatttggcggtgt

SEQ ID NO: 69575 - DNA, 20 bp, Artificial Sequence
  Description of Artificial Sequence: Synthetic oligonucleotide
  Target: ATXN1; (-) strand; PAM type: NRG; PAM sequence: CGG
ttctgcctcctctgatttgg

SEQ ID NO: 69576 - DNA, 20 bp, Artificial Sequence
  Description of Artificial Sequence: Synthetic oligonucleotide
  Target: ATXN1; (-) strand; PAM type: NRG; PAM sequence: TGG
gctttctgcctcctctgatt

SEQ ID NO: 69577 - DNA, 20 bp, Artificial Sequence
  Description of Artificial Sequence: Synthetic oligonucleotide
  Target: ATXN1; (-) strand; PAM type: NRG; PAM sequence: GGG
cagacgttctgtaacactca

SEQ ID NO: 69578 - DNA, 20 bp, Artificial Sequence
  Description of Artificial Sequence: Synthetic oligonucleotide
  Target: ATXN1; (-) strand; PAM type: NRG; PAM sequence: AGG
tcagacgttctgtaacactc

SEQ ID NO: 69579 - DNA, 20 bp, Artificial Sequence
  Description of Artificial Sequence: Synthetic oligonucleotide
  Target: ATXN1; (-) strand; PAM type: NRG; PAM sequence: CAG
ctcagacgttctgtaacact

SEQ ID NO: 69580 - DNA, 20 bp, Artificial Sequence
  Description of Artificial Sequence: Synthetic oligonucleotide
  Target: ATXN1; (-) strand; PAM type: NRG; PAM sequence: CAG
cttagaggcctcctctagct

SEQ ID NO: 69581 - DNA, 20 bp, Artificial Sequence
  Description of Artificial Sequence: Synthetic oligonucleotide
  Target: ATXN1; (-) strand; PAM type: NRG; PAM sequence: TAG
aagctcttagaggcctcctc

SEQ ID NO: 69582 - DNA, 20 bp, Artificial Sequence
  Description of Artificial Sequence: Synthetic oligonucleotide
  Target: ATXN1; (-) strand; PAM type: NRG; PAM sequence: AGG
actggactgaaagctcttag

SEQ ID NO: 69583 - DNA, 20 bp, Artificial Sequence
  Description of Artificial Sequence: Synthetic oligonucleotide
  Target: ATXN1; (-) strand; PAM type: NRG; PAM sequence: GAG
gactggactgaaagctctta

SEQ ID NO: 69584 - DNA, 20 bp, Artificial Sequence
  Description of Artificial Sequence: Synthetic oligonucleotide
  Target: ATXN1; (-) strand; PAM type: NRG; PAM sequence: TAG
gagactggactgaaagctct

SEQ ID NO: 69585 - DNA, 20 bp, Artificial Sequence
  Description of Artificial Sequence: Synthetic oligonucleotide
  Target: ATXN1; (-) strand; PAM type: NRG; PAM sequence: AAG
aaatgaggagactggactga

SEQ ID NO: 69586 - DNA, 20 bp, Artificial Sequence
  Description of Artificial Sequence: Synthetic oligonucleotide
  Target: ATXN1; (-) strand; PAM type: NRG; PAM sequence: TGG
tgttcattaaatgaggagac

SEQ ID NO: 69587 - DNA, 20 bp, Artificial Sequence
  Description of Artificial Sequence: Synthetic oligonucleotide
  Target: ATXN1; (-) strand; PAM type: NRG; PAM sequence: GAG
ttccgtgttcattaaatgag

SEQ ID NO: 69588 - DNA, 20 bp, Artificial Sequence
  Description of Artificial Sequence: Synthetic oligonucleotide
  Target: ATXN1; (-) strand; PAM type: NRG; PAM sequence: AGG
atttccgtgttcattaaatg

SEQ ID NO: 69589 - DNA, 20 bp, Artificial Sequence
  Description of Artificial Sequence: Synthetic oligonucleotide
  Target: ATXN1; (-) strand; PAM type: NRG; PAM sequence: GAG
aatttccgtgttcattaaat

SEQ ID NO: 69590 - DNA, 20 bp, Artificial Sequence
  Description of Artificial Sequence: Synthetic oligonucleotide
  Target: ATXN1; (-) strand; PAM type: NRG; PAM sequence: AGG
ccaagtcactttacgttagc

SEQ ID NO: 69591 - DNA, 20 bp, Artificial Sequence
  Description of Artificial Sequence: Synthetic oligonucleotide
  Target: ATXN1; (-) strand; PAM type: NRG; PAM sequence: CAG
accaagtcactttacgttag

SEQ ID NO: 69592 - DNA, 20 bp, Artificial Sequence
  Description of Artificial Sequence: Synthetic oligonucleotide
  Target: ATXN1; (-) strand; PAM type: NRG; PAM sequence: TAG
ttgaccaagtcactttacgt

SEQ ID NO: 69593 - DNA, 20 bp, Artificial Sequence
  Description of Artificial Sequence: Synthetic oligonucleotide
  Target: ATXN1; (-) strand; PAM type: NRG; PAM sequence: AAG
gccactgcgtagctttgacc

SEQ ID NO: 69594 - DNA, 20 bp, Artificial Sequence
  Description of Artificial Sequence: Synthetic oligonucleotide
  Target: ATXN1; (-) strand; PAM type: NRG; PAM sequence: TAG
gttttagttgtgccactgcg

SEQ ID NO: 69595 - DNA, 20 bp, Artificial Sequence
  Description of Artificial Sequence: Synthetic oligonucleotide
  Target: ATXN1; (-) strand; PAM type: NRG; PAM sequence: TAG
atgtcagaaatcctgagttt

SEQ ID NO: 69596 - DNA, 20 bp, Artificial Sequence
  Description of Artificial Sequence: Synthetic oligonucleotide
  Target: ATXN1; (-) strand; PAM type: NRG; PAM sequence: GAG
ggcaagatgtcagaaatcct

SEQ ID NO: 69597 - DNA, 20 bp, Artificial Sequence
  Description of Artificial Sequence: Synthetic oligonucleotide
  Target: ATXN1; (-) strand; PAM type: NRG; PAM sequence: CAG
ggtgctcaggggcaagatgt

SEQ ID NO: 69598 - DNA, 20 bp, Artificial Sequence
  Description of Artificial Sequence: Synthetic oligonucleotide
  Target: ATXN1; (-) strand; PAM type: NRG; PAM sequence: AAG
agttttgggtgctcaggggc

SEQ ID NO: 69599 - DNA, 20 bp, Artificial Sequence
  Description of Artificial Sequence: Synthetic oligonucleotide
  Target: ATXN1; (-) strand; PAM type: NRG; PAM sequence: GGG
tttgagttttgggtgctcag

SEQ ID NO: 69600 - DNA, 20 bp, Artificial Sequence
  Description of Artificial Sequence: Synthetic oligonucleotide
  Target: ATXN1; (-) strand; PAM type: NRG; PAM sequence: GGG
ctttgagttttgggtgctca

SEQ ID NO: 69601 - DNA, 20 bp, Artificial Sequence
  Description of Artificial Sequence: Synthetic oligonucleotide
  Target: ATXN1; (-) strand; PAM type: NRG; PAM sequence: AGG
cctttgagttttgggtgctc

SEQ ID NO: 69602 - DNA, 20 bp, Artificial Sequence
  Description of Artificial Sequence: Synthetic oligonucleotide
  Target: ATXN1; (-) strand; PAM type: NRG; PAM sequence: CAG
tcctttgagttttgggtgct

SEQ ID NO: 69603 - DNA, 20 bp, Artificial Sequence
  Description of Artificial Sequence: Synthetic oligonucleotide
  Target: ATXN1; (-) strand; PAM type: NRG; PAM sequence: GGG
ctttctgtcctttgagtttt

SEQ ID NO: 69604 - DNA, 20 bp, Artificial Sequence
  Description of Artificial Sequence: Synthetic oligonucleotide
  Target: ATXN1; (-) strand; PAM type: NRG; PAM sequence: TGG
actttctgtcctttgagttt

SEQ ID NO: 69605 - DNA, 20 bp, Artificial Sequence
  Description of Artificial Sequence: Synthetic oligonucleotide
  Target: ATXN1; (-) strand; PAM type: NRG; PAM sequence: GAG
cattgtactttctgtccttt

SEQ ID NO: 69606 - DNA, 20 bp, Artificial Sequence
  Description of Artificial Sequence: Synthetic oligonucleotide
  Target: ATXN1; (-) strand; PAM type: NRG; PAM sequence: TAG
aagtcctttggttacttctg

SEQ ID NO: 69607 - DNA, 20 bp, Artificial Sequence
  Description of Artificial Sequence: Synthetic oligonucleotide
  Target: ATXN1; (-) strand; PAM type: NRG; PAM sequence: TGG
gacatcaccagaaagtcctt

SEQ ID NO: 69608 - DNA, 20 bp, Artificial Sequence
  Description of Artificial Sequence: Synthetic oligonucleotide
  Target: ATXN1; (-) strand; PAM type: NRG; PAM sequence: AAG
catcatttgacatcaccaga

SEQ ID NO: 69609 - DNA, 20 bp, Artificial Sequence
  Description of Artificial Sequence: Synthetic oligonucleotide
  Target: ATXN1; (-) strand; PAM type: NRG; PAM sequence: CAG
cttgcatcatttgacatcac

SEQ ID NO: 69610 - DNA, 20 bp, Artificial Sequence
  Description of Artificial Sequence: Synthetic oligonucleotide
  Target: ATXN1; (-) strand; PAM type: NRG; PAM sequence: GAG
tatcaatttattcccaactt

SEQ ID NO: 69611 - DNA, 20 bp, Artificial Sequence
  Description of Artificial Sequence: Synthetic oligonucleotide
  Target: ATXN1; (-) strand; PAM type: NRG; PAM sequence: TAG
gccttaagagatggttttaa

SEQ ID NO: 69612 - DNA, 20 bp, Artificial Sequence
  Description of Artificial Sequence: Synthetic oligonucleotide
  Target: ATXN1; (-) strand; PAM type: NRG; PAM sequence: TGG
ccccagaaggccttaagaga

SEQ ID NO: 69613 - DNA, 20 bp, Artificial Sequence
  Description of Artificial Sequence: Synthetic oligonucleotide
  Target: ATXN1; (-) strand; PAM type: NRG; PAM sequence: GAG
tttcccccagaaggccttaa

SEQ ID NO: 69614 - DNA, 20 bp, Artificial Sequence
  Description of Artificial Sequence: Synthetic oligonucleotide
  Target: ATXN1; (-) strand; PAM type: NRG; PAM sequence: AAG
gttttcccccagaaggcctt

SEQ ID NO: 69615 - DNA, 20 bp, Artificial Sequence
  Description of Artificial Sequence: Synthetic oligonucleotide
  Target: ATXN1; (-) strand; PAM type: NRG; PAM sequence: AGG
tggtggcgttttcccccaga

SEQ ID NO: 69616 - DNA, 20 bp, Artificial Sequence
  Description of Artificial Sequence: Synthetic oligonucleotide
  Target: ATXN1; (-) strand; PAM type: NRG; PAM sequence: AAG
gtggtggcgttttcccccag

SEQ ID NO: 69617 - DNA, 20 bp, Artificial Sequence
  Description of Artificial Sequence: Synthetic oligonucleotide
  Target: ATXN1; (-) strand; PAM type: NRG; PAM sequence: CAG
ttggtggtggcgttttcccc

SEQ ID NO: 69618 - DNA, 20 bp, Artificial Sequence
  Description of Artificial Sequence: Synthetic oligonucleotide
  Target: ATXN1; (-) strand; PAM type: NRG; PAM sequence: TGG
cttcaagtaattcttggtgg

SEQ ID NO: 69619 - DNA, 20 bp, Artificial Sequence
  Description of Artificial Sequence: Synthetic oligonucleotide
  Target: ATXN1; (-) strand; PAM type: NRG; PAM sequence: TGG
agccttcaagtaattcttgg

SEQ ID NO: 69620 - DNA, 20 bp, Artificial Sequence
  Description of Artificial Sequence: Synthetic oligonucleotide
  Target: ATXN1; (-) strand; PAM type: NRG; PAM sequence: TGG
acaagccttcaagtaattct

SEQ ID NO: 69621 - DNA, 20 bp, Artificial Sequence
  Description of Artificial Sequence: Synthetic oligonucleotide
  Target: ATXN1; (-) strand; PAM type: NRG; PAM sequence: AAG
aaagcacttgacaagccttc

SEQ ID NO: 69622 - DNA, 20 bp, Artificial Sequence
  Description of Artificial Sequence: Synthetic oligonucleotide
  Target: ATXN1; (-) strand; PAM type: NRG; PAM sequence: AAG
agcgccttaaagcacttgac

SEQ ID NO: 69623 - DNA, 20 bp, Artificial Sequence
  Description of Artificial Sequence: Synthetic oligonucleotide
  Target: ATXN1; (-) strand; PAM type: NRG; PAM sequence: AAG
tcttgccttatagcgcctta

SEQ ID NO: 69624 - DNA, 20 bp, Artificial Sequence
  Description of Artificial Sequence: Synthetic oligonucleotide
  Target: ATXN1; (-) strand; PAM type: NRG; PAM sequence: TAG
cagtgttgcatcttgcctta

SEQ ID NO: 69625 - DNA, 20 bp, Artificial Sequence
  Description of Artificial Sequence: Synthetic oligonucleotide
  Target: ATXN1; (-) strand; PAM type: NRG; PAM sequence: CAG
tatctttttttaatgtctct

SEQ ID NO: 69626 - DNA, 20 bp, Artificial Sequence
  Description of Artificial Sequence: Synthetic oligonucleotide
  Target: ATXN1; (-) strand; PAM type: NRG; PAM sequence: AGG
caactcaggcagtggggaaa

SEQ ID NO: 69627 - DNA, 20 bp, Artificial Sequence
  Description of Artificial Sequence: Synthetic oligonucleotide
  Target: ATXN1; (-) strand; PAM type: NRG; PAM sequence: AAG
gcaactcaggcagtggggaa

SEQ ID NO: 69628 - DNA, 20 bp, Artificial Sequence
  Description of Artificial Sequence: Synthetic oligonucleotide
  Target: ATXN1; (-) strand; PAM type: NRG; PAM sequence: GGG
caagagcaactcaggcagtg

SEQ ID NO: 69629 - DNA, 20 bp, Artificial Sequence
  Description of Artificial Sequence: Synthetic oligonucleotide
  Target: ATXN1; (-) strand; PAM type: NRG; PAM sequence: GGG
tcaagagcaactcaggcagt

SEQ ID NO: 69630 - DNA, 20 bp, Artificial Sequence
  Description of Artificial Sequence: Synthetic oligonucleotide
  Target: ATXN1; (-) strand; PAM type: NRG; PAM sequence: TGG
ctcaagagcaactcaggcag

SEQ ID NO: 69631 - DNA, 20 bp, Artificial Sequence
  Description of Artificial Sequence: Synthetic oligonucleotide
  Target: ATXN1; (-) strand; PAM type: NRG; PAM sequence: CAG
gcactcaagagcaactcagg

SEQ ID NO: 69632 - DNA, 20 bp, Artificial Sequence
  Description of Artificial Sequence: Synthetic oligonucleotide
  Target: ATXN1; (-) strand; PAM type: NRG; PAM sequence: AGG
taggcactcaagagcaactc

SEQ ID NO: 69633 - DNA, 20 bp, Artificial Sequence
  Description of Artificial Sequence: Synthetic oligonucleotide
  Target: ATXN1; (-) strand; PAM type: NRG; PAM sequence: CAG
ctaggcactcaagagcaact

SEQ ID NO: 69634 - DNA, 20 bp, Artificial Sequence
  Description of Artificial Sequence: Synthetic oligonucleotide
  Target: ATXN1; (-) strand; PAM type: NRG; PAM sequence: GAG
ttcacccactaggcactcaa

SEQ ID NO: 69635 - DNA, 20 bp, Artificial Sequence
  Description of Artificial Sequence: Synthetic oligonucleotide
  Target: ATXN1; (-) strand; PAM type: NRG; PAM sequence: AAG
tgttcacccactaggcactc

SEQ ID NO: 69636 - DNA, 20 bp, Artificial Sequence
  Description of Artificial Sequence: Synthetic oligonucleotide
  Target: ATXN1; (-) strand; PAM type: NRG; PAM sequence: AGG
ccctcctctgttcacccact

SEQ ID NO: 69637 - DNA, 20 bp, Artificial Sequence
  Description of Artificial Sequence: Synthetic oligonucleotide
  Target: ATXN1; (-) strand; PAM type: NRG; PAM sequence: TAG
tccctcctctgttcacccac

SEQ ID NO: 69638 - DNA, 20 bp, Artificial Sequence
  Description of Artificial Sequence: Synthetic oligonucleotide
  Target: ATXN1; (-) strand; PAM type: NRG; PAM sequence: GGG
agagaacccattggaagcct

SEQ ID NO: 69639 - DNA, 20 bp, Artificial Sequence
  Description of Artificial Sequence: Synthetic oligonucleotide
  Target: ATXN1; (-) strand; PAM type: NRG; PAM sequence: TGG
cagagaacccattggaagcc

SEQ ID NO: 69640 - DNA, 20 bp, Artificial Sequence
  Description of Artificial Sequence: Synthetic oligonucleotide
  Target: ATXN1; (-) strand; PAM type: NRG; PAM sequence: AAG
ctgtgcagagaacccattgg

SEQ ID NO: 69641 - DNA, 20 bp, Artificial Sequence
  Description of Artificial Sequence: Synthetic oligonucleotide
  Target: ATXN1; (-) strand; PAM type: NRG; PAM sequence: TGG
tggctgtgcagagaacccat

SEQ ID NO: 69642 - DNA, 20 bp, Artificial Sequence
  Description of Artificial Sequence: Synthetic oligonucleotide
  Target: ATXN1; (-) strand; PAM type: NRG; PAM sequence: GAG
aatgaccgtgtggctgtgca

SEQ ID NO: 69643 - DNA, 20 bp, Artificial Sequence
  Description of Artificial Sequence: Synthetic oligonucleotide
  Target: ATXN1; (-) strand; PAM type: NRG; PAM sequence: CAG
ctaatgaccgtgtggctgtg

SEQ ID NO: 69644 - DNA, 20 bp, Artificial Sequence
  Description of Artificial Sequence: Synthetic oligonucleotide
  Target: ATXN1; (-) strand; PAM type: NRG; PAM sequence: TGG
tgtggatgctaatgaccgtg

SEQ ID NO: 69645 - DNA, 20 bp, Artificial Sequence
  Description of Artificial Sequence: Synthetic oligonucleotide
  Target: ATXN1; (-) strand; PAM type: NRG; PAM sequence: TGG
tctggagtgaatgcagattg

SEQ ID NO: 69646 - DNA, 20 bp, Artificial Sequence
  Description of Artificial Sequence: Synthetic oligonucleotide
  Target: ATXN1; (-) strand; PAM type: NRG; PAM sequence: CAG
aatctcatctggagtgaatg

SEQ ID NO: 69647 - DNA, 20 bp, Artificial Sequence
  Description of Artificial Sequence: Synthetic oligonucleotide
  Target: ATXN1; (-) strand; PAM type: NRG; PAM sequence: GAG
cggtgatgaaatctcatctg

SEQ ID NO: 69648 - DNA, 20 bp, Artificial Sequence
  Description of Artificial Sequence: Synthetic oligonucleotide
  Target: ATXN1; (-) strand; PAM type: NRG; PAM sequence: TGG
tgcggtgatgaaatctcatc

SEQ ID NO: 69649 - DNA, 20 bp, Artificial Sequence
  Description of Artificial Sequence: Synthetic oligonucleotide
  Target: ATXN1; (-) strand; PAM type: NRG; PAM sequence: CGG
aggaatgaataaataggatg

SEQ ID NO: 69650 - DNA, 20 bp, Artificial Sequence
  Description of Artificial Sequence: Synthetic oligonucleotide
  Target: ATXN1; (-) strand; PAM type: NRG; PAM sequence: AGG
atattaaggaatgaataaat

SEQ ID NO: 69651 - DNA, 20 bp, Artificial Sequence
  Description of Artificial Sequence: Synthetic oligonucleotide
  Target: ATXN1; (-) strand; PAM type: NRG; PAM sequence: TAG
tatattaaggaatgaataaa

SEQ ID NO: 69652 - DNA, 20 bp, Artificial Sequence
  Description of Artificial Sequence: Synthetic oligonucleotide
  Target: ATXN1; (-) strand; PAM type: NRG; PAM sequence: AGG
cgcaatttagatttatatta

SEQ ID NO: 69653 - DNA, 20 bp, Artificial Sequence
  Description of Artificial Sequence: Synthetic oligonucleotide
  Target: ATXN1; (-) strand; PAM type: NRG; PAM sequence: AAG
gcgcaatttagatttatatt

SEQ ID NO: 69654 - DNA, 20 bp, Artificial Sequence
  Description of Artificial Sequence: Synthetic oligonucleotide
  Target: ATXN1; (-) strand; PAM type: NRG; PAM sequence: TAG
gctatttgaagagcgcaatt

SEQ ID NO: 69655 - DNA, 20 bp, Artificial Sequence
  Description of Artificial Sequence: Synthetic oligonucleotide
  Target: ATXN1; (-) strand; PAM type: NRG; PAM sequence: GAG
agtgctctctgctatttgaa

SEQ ID NO: 69656 - DNA, 20 bp, Artificial Sequence
  Description of Artificial Sequence: Synthetic oligonucleotide
  Target: ATXN1; (-) strand; PAM type: NRG; PAM sequence: AAG
atagtgctctctgctatttg

SEQ ID NO: 69657 - DNA, 20 bp, Artificial Sequence
  Description of Artificial Sequence: Synthetic oligonucleotide
  Target: ATXN1; (-) strand; PAM type: NRG; PAM sequence: TAG
tctttccccttactgaagca

SEQ ID NO: 69658 - DNA, 20 bp, Artificial Sequence
  Description of Artificial Sequence: Synthetic oligonucleotide
  Target: ATXN1; (-) strand; PAM type: NRG; PAM sequence: AAG
gtttctctttccccttactg

SEQ ID NO: 69659 - DNA, 20 bp, Artificial Sequence
  Description of Artificial Sequence: Synthetic oligonucleotide
  Target: ATXN1; (-) strand; PAM type: NRG; PAM sequence: CAG
gggagaagatgaaaatgcag

SEQ ID NO: 69660 - DNA, 20 bp, Artificial Sequence
  Description of Artificial Sequence: Synthetic oligonucleotide
  Target: ATXN1; (-) strand; PAM type: NRG; PAM sequence: CAG
ggagggagaagatgaaaatg

SEQ ID NO: 69661 - DNA, 20 bp, Artificial Sequence
  Description of Artificial Sequence: Synthetic oligonucleotide
  Target: ATXN1; (-) strand; PAM type: NRG; PAM sequence: AAG
caaagtaacataggagggag

SEQ ID NO: 69662 - DNA, 20 bp, Artificial Sequence
  Description of Artificial Sequence: Synthetic oligonucleotide
  Target: ATXN1; (-) strand; PAM type: NRG; PAM sequence: GAG
gaccaaagtaacataggagg

SEQ ID NO: 69663 - DNA, 20 bp, Artificial Sequence
  Description of Artificial Sequence: Synthetic oligonucleotide
  Target: ATXN1; (-) strand; PAM type: NRG; PAM sequence: GGG
aagaccaaagtaacatagga

SEQ ID NO: 69664 - DNA, 20 bp, Artificial Sequence
  Description of Artificial Sequence: Synthetic oligonucleotide
  Target: ATXN1; (-) strand; PAM type: NRG; PAM sequence: AGG
caagaccaaagtaacatagg

SEQ ID NO: 69665 - DNA, 20 bp, Artificial Sequence
  Description of Artificial Sequence: Synthetic oligonucleotide
  Target: ATXN1; (-) strand; PAM type: NRG; PAM sequence: GAG
tcaagaccaaagtaacatag

SEQ ID NO: 69666 - DNA, 20 bp, Artificial Sequence
  Description of Artificial Sequence: Synthetic oligonucleotide
  Target: ATXN1; (-) strand; PAM type: NRG; PAM sequence: AGG
tgtcaagaccaaagtaacat

SEQ ID NO: 69667 - DNA, 20 bp, Artificial Sequence
  Description of Artificial Sequence: Synthetic oligonucleotide
  Target: ATXN1; (-) strand; PAM type: NRG; PAM sequence: TAG
ctgtcaagaccaaagtaaca

SEQ ID NO: 69668 - DNA, 20 bp, Artificial Sequence
  Description of Artificial Sequence: Synthetic oligonucleotide
  Target: ATXN1; (-) strand; PAM type: NRG; PAM sequence: AAG
aattaaggctgtcaagacca

SEQ ID NO: 69669 - DNA, 20 bp, Artificial Sequence
  Description of Artificial Sequence: Synthetic oligonucleotide
  Target: ATXN1; (-) strand; PAM type: NRG; PAM sequence: AAG
ctgtgtgaattaaggctgtc

SEQ ID NO: 69670 - DNA, 20 bp, Artificial Sequence
  Description of Artificial Sequence: Synthetic oligonucleotide
  Target: ATXN1; (-) strand; PAM type: NRG; PAM sequence: AGG
cgggagcactgtgtgaatta

SEQ ID NO: 69671 - DNA, 20 bp, Artificial Sequence
  Description of Artificial Sequence: Synthetic oligonucleotide
  Target: ATXN1; (-) strand; PAM type: NRG; PAM sequence: AAG
ccgggagcactgtgtgaatt

SEQ ID NO: 69672 - DNA, 20 bp, Artificial Sequence
  Description of Artificial Sequence: Synthetic oligonucleotide
  Target: ATXN1; (-) strand; PAM type: NRG; PAM sequence: GAG
gagccagggaagggctccgg

SEQ ID NO: 69673 - DNA, 20 bp, Artificial Sequence
  Description of Artificial Sequence: Synthetic oligonucleotide
  Target: ATXN1; (-) strand; PAM type: NRG; PAM sequence: GGG
acgagccagggaagggctcc

SEQ ID NO: 69674 - DNA, 20 bp, Artificial Sequence
  Description of Artificial Sequence: Synthetic oligonucleotide
  Target: ATXN1; (-) strand; PAM type: NRG; PAM sequence: CGG
gacgagccagggaagggctc

SEQ ID NO: 69675 - DNA, 20 bp, Artificial Sequence
  Description of Artificial Sequence: Synthetic oligonucleotide
  Target: ATXN1; (-) strand; PAM type: NRG; PAM sequence: GGG
ccttgggacgagccagggaa

SEQ ID NO: 69676 - DNA, 20 bp, Artificial Sequence
  Description of Artificial Sequence: Synthetic oligonucleotide
  Target: ATXN1; (-) strand; PAM type: NRG; PAM sequence: AGG
tccttgggacgagccaggga

SEQ ID NO: 69677 - DNA, 20 bp, Artificial Sequence
  Description of Artificial Sequence: Synthetic oligonucleotide
  Target: ATXN1; (-) strand; PAM type: NRG; PAM sequence: AAG
atccttgggacgagccaggg

SEQ ID NO: 69678 - DNA, 20 bp, Artificial Sequence
  Description of Artificial Sequence: Synthetic oligonucleotide
  Target: ATXN1; (-) strand; PAM type: NRG; PAM sequence: GGG
ctgatccttgggacgagcca

SEQ ID NO: 69679 - DNA, 20 bp, Artificial Sequence
  Description of Artificial Sequence: Synthetic oligonucleotide
  Target: ATXN1; (-) strand; PAM type: NRG; PAM sequence: AGG
gctgatccttgggacgagcc

SEQ ID NO: 69680 - DNA, 20 bp, Artificial Sequence
  Description of Artificial Sequence: Synthetic oligonucleotide
  Target: ATXN1; (-) strand; PAM type: NRG; PAM sequence: CAG
tgctgatccttgggacgagc

SEQ ID NO: 69681 - DNA, 20 bp, Artificial Sequence
  Description of Artificial Sequence: Synthetic oligonucleotide
  Target: ATXN1; (-) strand; PAM type: NRG; PAM sequence: GAG
tgtttgctgatccttgggac

SEQ ID NO: 69682 - DNA, 20 bp, Artificial Sequence
  Description of Artificial Sequence: Synthetic oligonucleotide
  Target: ATXN1; (-) strand; PAM type: NRG; PAM sequence: GGG
ccgtgtgtttgctgatcctt

SEQ ID NO: 69683 - DNA, 20 bp, Artificial Sequence
  Description of Artificial Sequence: Synthetic oligonucleotide
  Target: ATXN1; (-) strand; PAM type: NRG; PAM sequence: TGG
gccgtgtgtttgctgatcct

SEQ ID NO: 69684 - DNA, 20 bp, Artificial Sequence
  Description of Artificial Sequence: Synthetic oligonucleotide
  Target: ATXN1; (-) strand; PAM type: NRG; PAM sequence: TAG
cccagtgtgaaaaactaaga

SEQ ID NO: 69685 - DNA, 20 bp, Artificial Sequence
  Description of Artificial Sequence: Synthetic oligonucleotide
  Target: ATXN1; (-) strand; PAM type: NRG; PAM sequence: AAG
gagccccagtgtgaaaaact

SEQ ID NO: 69686 - DNA, 20 bp, Artificial Sequence
  Description of Artificial Sequence: Synthetic oligonucleotide
  Target: ATXN1; (-) strand; PAM type: NRG; PAM sequence: CAG
tttccctctagagagagccc

SEQ ID NO: 69687 - DNA, 20 bp, Artificial Sequence
  Description of Artificial Sequence: Synthetic oligonucleotide
  Target: ATXN1; (-) strand; PAM type: NRG; PAM sequence: GAG
acatactttccctctagaga

SEQ ID NO: 69688 - DNA, 20 bp, Artificial Sequence
  Description of Artificial Sequence: Synthetic oligonucleotide
  Target: ATXN1; (-) strand; PAM type: NRG; PAM sequence: GAG
ctacatactttccctctaga

SEQ ID NO: 69689 - DNA, 20 bp, Artificial Sequence
  Description of Artificial Sequence: Synthetic oligonucleotide
  Target: ATXN1; (-) strand; PAM type: NRG; PAM sequence: GAG
agctacatactttccctcta

SEQ ID NO: 69690 - DNA, 20 bp, Artificial Sequence
  Description of Artificial Sequence: Synthetic oligonucleotide
  Target: ATXN1; (-) strand; PAM type: NRG; PAM sequence: TAG
aaagctacatactttccctc

SEQ ID NO: 69691 - DNA, 20 bp, Artificial Sequence
  Description of Artificial Sequence: Synthetic oligonucleotide
  Target: ATXN1; (-) strand; PAM type: NRG; PAM sequence: AAG
caagtagttgggaatgtgga

SEQ ID NO: 69692 - DNA, 20 bp, Artificial Sequence
  Description of Artificial Sequence: Synthetic oligonucleotide
  Target: ATXN1; (-) strand; PAM type: NRG; PAM sequence: TGG
ctcccaagtagttgggaatg

SEQ ID NO: 69693 - DNA, 20 bp, Artificial Sequence
  Description of Artificial Sequence: Synthetic oligonucleotide
  Target: ATXN1; (-) strand; PAM type: NRG; PAM sequence: GGG
ccttgggctcccaagtagtt

SEQ ID NO: 69694 - DNA, 20 bp, Artificial Sequence
  Description of Artificial Sequence: Synthetic oligonucleotide
  Target: ATXN1; (-) strand; PAM type: NRG; PAM sequence: TGG
accttgggctcccaagtagt

SEQ ID NO: 69695 - DNA, 20 bp, Artificial Sequence
  Description of Artificial Sequence: Synthetic oligonucleotide
  Target: ATXN1; (-) strand; PAM type: NRG; PAM sequence: TAG
aaacaccttgggctcccaag

SEQ ID NO: 69696 - DNA, 20 bp, Artificial Sequence
  Description of Artificial Sequence: Synthetic oligonucleotide
  Target: ATXN1; (-) strand; PAM type: NRG; PAM sequence: AAG
tgcaaacaccttgggctccc

SEQ ID NO: 69697 - DNA, 20 bp, Artificial Sequence
  Description of Artificial Sequence: Synthetic oligonucleotide
  Target: ATXN1; (-) strand; PAM type: NRG; PAM sequence: GGG
ttggctgctgcaaacacctt

SEQ ID NO: 69698 - DNA, 20 bp, Artificial Sequence
  Description of Artificial Sequence: Synthetic oligonucleotide
  Target: ATXN1; (-) strand; PAM type: NRG; PAM sequence: TGG
tttggctgctgcaaacacct

SEQ ID NO: 69699 - DNA, 20 bp, Artificial Sequence
  Description of Artificial Sequence: Synthetic oligonucleotide
  Target: ATXN1; (-) strand; PAM type: NRG; PAM sequence: TGG
tcctactcgttagttgtatt

SEQ ID NO: 69700 - DNA, 20 bp, Artificial Sequence
  Description of Artificial Sequence: Synthetic oligonucleotide
  Target: ATXN1; (-) strand; PAM type: NRG; PAM sequence: TAG
agtgtctttttcctactcgt

SEQ ID NO: 69701 - DNA, 20 bp, Artificial Sequence
  Description of Artificial Sequence: Synthetic oligonucleotide
  Target: ATXN1; (-) strand; PAM type: NRG; PAM sequence: TAG
gacacaattgtggcatttct

SEQ ID NO: 69702 - DNA, 20 bp, Artificial Sequence
  Description of Artificial Sequence: Synthetic oligonucleotide
  Target: ATXN1; (-) strand; PAM type: NRG; PAM sequence: TGG
gaatgtgtcagacacaattg

SEQ ID NO: 69703 - DNA, 20 bp, Artificial Sequence
  Description of Artificial Sequence: Synthetic oligonucleotide
  Target: ATXN1; (-) strand; PAM type: NRG; PAM sequence: CAG
caactgtcttttgaatgtgt

SEQ ID NO: 69704 - DNA, 20 bp, Artificial Sequence
  Description of Artificial Sequence: Synthetic oligonucleotide
  Target: ATXN1; (-) strand; PAM type: NRG; PAM sequence: AGG
acagatcctccatggatggg

SEQ ID NO: 69705 - DNA, 20 bp, Artificial Sequence
  Description of Artificial Sequence: Synthetic oligonucleotide
  Target: ATXN1; (-) strand; PAM type: NRG; PAM sequence: GAG
aacagatcctccatggatgg

SEQ ID NO: 69706 - DNA, 20 bp, Artificial Sequence
  Description of Artificial Sequence: Synthetic oligonucleotide
  Target: ATXN1; (-) strand; PAM type: NRG; PAM sequence: GGG
ggaacagatcctccatggat

SEQ ID NO: 69707 - DNA, 20 bp, Artificial Sequence
  Description of Artificial Sequence: Synthetic oligonucleotide
  Target: ATXN1; (-) strand; PAM type: NRG; PAM sequence: TGG
tggaacagatcctccatgga

SEQ ID NO: 69708 - DNA, 20 bp, Artificial Sequence
  Description of Artificial Sequence: Synthetic oligonucleotide
  Target: ATXN1; (-) strand; PAM type: NRG; PAM sequence: TGG
gtcttggaacagatcctcca

SEQ ID NO: 69709 - DNA, 20 bp, Artificial Sequence
  Description of Artificial Sequence: Synthetic oligonucleotide
  Target: ATXN1; (-) strand; PAM type: NRG; PAM sequence: CAG
cgtccactggggtcttggaa

SEQ ID NO: 69710 - DNA, 20 bp, Artificial Sequence
  Description of Artificial Sequence: Synthetic oligonucleotide
  Target: ATXN1; (-) strand; PAM type: NRG; PAM sequence: TGG
ttaggcgtccactggggtct

SEQ ID NO: 69711 - DNA, 20 bp, Artificial Sequence
  Description of Artificial Sequence: Synthetic oligonucleotide
  Target: ATXN1; (-) strand; PAM type: NRG; PAM sequence: GGG
atggttttaggcgtccactg

SEQ ID NO: 69712 - DNA, 20 bp, Artificial Sequence
  Description of Artificial Sequence: Synthetic oligonucleotide
  Target: ATXN1; (-) strand; PAM type: NRG; PAM sequence: GGG
catggttttaggcgtccact

SEQ ID NO: 69713 - DNA, 20 bp, Artificial Sequence
  Description of Artificial Sequence: Synthetic oligonucleotide
  Target: ATXN1; (-) strand; PAM type: NRG; PAM sequence: TGG
tcatggttttaggcgtccac

SEQ ID NO: 69714 - DNA, 20 bp, Artificial Sequence
  Description of Artificial Sequence: Synthetic oligonucleotide
  Target: ATXN1; (-) strand; PAM type: NRG; PAM sequence: AGG
aaggtactattcatggtttt

SEQ ID NO: 69715 - DNA, 20 bp, Artificial Sequence
  Description of Artificial Sequence: Synthetic oligonucleotide
  Target: ATXN1; (-) strand; PAM type: NRG; PAM sequence: TAG
aaaggtactattcatggttt

SEQ ID NO: 69716 - DNA, 20 bp, Artificial Sequence
  Description of Artificial Sequence: Synthetic oligonucleotide
  Target: ATXN1; (-) strand; PAM type: NRG; PAM sequence: TGG
atacataaaggtactattca

SEQ ID NO: 69717 - DNA, 20 bp, Artificial Sequence
  Description of Artificial Sequence: Synthetic oligonucleotide
  Target: ATXN1; (-) strand; PAM type: NRG; PAM sequence: AGG
aacatagtagatatacataa

SEQ ID NO: 69718 - DNA, 20 bp, Artificial Sequence
  Description of Artificial Sequence: Synthetic oligonucleotide
  Target: ATXN1; (-) strand; PAM type: NRG; PAM sequence: AAG
aaacatagtagatatacata

SEQ ID NO: 69719 - DNA, 20 bp, Artificial Sequence
  Description of Artificial Sequence: Synthetic oligonucleotide
  Target: ATXN1; (-) strand; PAM type: NRG; PAM sequence: TAG
atgtataggaaaaaacatag

SEQ ID NO: 69720 - DNA, 20 bp, Artificial Sequence
  Description of Artificial Sequence: Synthetic oligonucleotide
  Target: ATXN1; (-) strand; PAM type: NRG; PAM sequence: TAG
tatatgtataggaaaaaaca

SEQ ID NO: 69721 - DNA, 20 bp, Artificial Sequence
  Description of Artificial Sequence: Synthetic oligonucleotide
  Target: ATXN1; (-) strand; PAM type: NRG; PAM sequence: AGG
tatcatgggtgtatatgtat

SEQ ID NO: 69722 - DNA, 20 bp, Artificial Sequence
  Description of Artificial Sequence: Synthetic oligonucleotide
  Target: ATXN1; (-) strand; PAM type: NRG; PAM sequence: TAG
ctatcatgggtgtatatgta

SEQ ID NO: 69723 - DNA, 20 bp, Artificial Sequence
  Description of Artificial Sequence: Synthetic oligonucleotide
  Target: ATXN1; (-) strand; PAM type: NRG; PAM sequence: GGG
tataaattaaactctatcat

SEQ ID NO: 69724 - DNA, 20 bp, Artificial Sequence
  Description of Artificial Sequence: Synthetic oligonucleotide
  Target: ATXN1; (-) strand; PAM type: NRG; PAM sequence: TGG
ttataaattaaactctatca

SEQ ID NO: 69725 - DNA, 20 bp, Artificial Sequence
  Description of Artificial Sequence: Synthetic oligonucleotide
  Target: ATXN1; (-) strand; PAM type: NRG; PAM sequence: TAG
tgattgttctattttattat

SEQ ID NO: 69726 - DNA, 20 bp, Artificial Sequence
  Description of Artificial Sequence: Synthetic oligonucleotide
  Target: ATXN1; (-) strand; PAM type: NRG; PAM sequence: CAG
cattcacataacttttagta

SEQ ID NO: 69727 - DNA, 20 bp, Artificial Sequence
  Description of Artificial Sequence: Synthetic oligonucleotide
  Target: ATXN1; (-) strand; PAM type: NRG; PAM sequence: TAG
caccacattcacataacttt

SEQ ID NO: 69728 - DNA, 20 bp, Artificial Sequence
  Description of Artificial Sequence: Synthetic oligonucleotide
  Target: ATXN1; (-) strand; PAM type: NRG; PAM sequence: GAG
gatattttgagagagagaga

SEQ ID NO: 69729 - DNA, 20 bp, Artificial Sequence
  Description of Artificial Sequence: Synthetic oligonucleotide
  Target: ATXN1; (-) strand; PAM type: NRG; PAM sequence: GAG
aagatattttgagagagaga

SEQ ID NO: 69730 - DNA, 20 bp, Artificial Sequence
  Description of Artificial Sequence: Synthetic oligonucleotide
  Target: ATXN1; (-) strand; PAM type: NRG; PAM sequence: GAG
ataagatattttgagagaga

SEQ ID NO: 69731 - DNA, 20 bp, Artificial Sequence
  Description of Artificial Sequence: Synthetic oligonucleotide
  Target: ATXN1; (-) strand; PAM type: NRG; PAM sequence: GAG
caataagatattttgagaga

SEQ ID NO: 69732 - DNA, 20 bp, Artificial Sequence
  Description of Artificial Sequence: Synthetic oligonucleotide
  Target: ATXN1; (-) strand; PAM type: NRG; PAM sequence: GAG
tgcaataagatattttgaga

SEQ ID NO: 69733 - DNA, 20 bp, Artificial Sequence
  Description of Artificial Sequence: Synthetic oligonucleotide
  Target: ATXN1; (-) strand; PAM type: NRG; PAM sequence: GAG
catgcaataagatattttga

SEQ ID NO: 69734 - DNA, 20 bp, Artificial Sequence
  Description of Artificial Sequence: Synthetic oligonucleotide
  Target: ATXN1; (-) strand; PAM type: NRG; PAM sequence: GAG
gccatgcaataagatatttt

SEQ ID NO: 69735 - DNA, 20 bp, Artificial Sequence
  Description of Artificial Sequence: Synthetic oligonucleotide
  Target: ATXN1; (-) strand; PAM type: NRG; PAM sequence: AAG
acaggtgagtgccatgcaat

SEQ ID NO: 69736 - DNA, 20 bp, Artificial Sequence
  Description of Artificial Sequence: Synthetic oligonucleotide
  Target: ATXN1; (-) strand; PAM type: NRG; PAM sequence: GAG
agcgtggtacaaaaacaggt

SEQ ID NO: 69737 - DNA, 20 bp, Artificial Sequence
  Description of Artificial Sequence: Synthetic oligonucleotide
  Target: ATXN1; (-) strand; PAM type: NRG; PAM sequence: AGG
gtcaagcgtggtacaaaaac

SEQ ID NO: 69738 - DNA, 20 bp, Artificial Sequence
  Description of Artificial Sequence: Synthetic oligonucleotide
  Target: ATXN1; (-) strand; PAM type: NRG; PAM sequence: CAG
agtcaagcgtggtacaaaaa

SEQ ID NO: 69739 - DNA, 20 bp, Artificial Sequence
  Description of Artificial Sequence: Synthetic oligonucleotide
  Target: ATXN1; (-) strand; PAM type: NRG; PAM sequence: TGG
caattacccacagtcaagcg

SEQ ID NO: 69740 - DNA, 20 bp, Artificial Sequence
  Description of Artificial Sequence: Synthetic oligonucleotide
  Target: ATXN1; (-) strand; PAM type: NRG; PAM sequence: AAG
tgtttcaattacccacagtc

SEQ ID NO: 69741 - DNA, 20 bp, Artificial Sequence
  Description of Artificial Sequence: Synthetic oligonucleotide
  Target: ATXN1; (-) strand; PAM type: NRG; PAM sequence: CAG
tctgctgtttcaattaccca

SEQ ID NO: 69742 - DNA, 20 bp, Artificial Sequence
  Description of Artificial Sequence: Synthetic oligonucleotide
  Target: ATXN1; (-) strand; PAM type: NRG; PAM sequence: CGG
ttccccccaccccccatctt

SEQ ID NO: 69743 - DNA, 20 bp, Artificial Sequence
  Description of Artificial Sequence: Synthetic oligonucleotide
  Target: ATXN1; (-) strand; PAM type: NRG; PAM sequence: TAG
acttatccaggttgatacag

SEQ ID NO: 69744 - DNA, 20 bp, Artificial Sequence
  Description of Artificial Sequence: Synthetic oligonucleotide
  Target: ATXN1; (-) strand; PAM type: NRG; PAM sequence: CAG
tgaacttatccaggttgata

SEQ ID NO: 69745 - DNA, 20 bp, Artificial Sequence
  Description of Artificial Sequence: Synthetic oligonucleotide
  Target: ATXN1; (-) strand; PAM type: NRG; PAM sequence: AGG
cgttccctgtgaacttatcc

SEQ ID NO: 69746 - DNA, 20 bp, Artificial Sequence
  Description of Artificial Sequence: Synthetic oligonucleotide
  Target: ATXN1; (-) strand; PAM type: NRG; PAM sequence: CAG
ccgttccctgtgaacttatc

SEQ ID NO: 69747 - DNA, 20 bp, Artificial Sequence
  Description of Artificial Sequence: Synthetic oligonucleotide
  Target: ATXN1; (-) strand; PAM type: NRG; PAM sequence: AAG
tttatgcatcaccttctgga

SEQ ID NO: 69748 - DNA, 20 bp, Artificial Sequence
  Description of Artificial Sequence: Synthetic oligonucleotide
  Target: ATXN1; (-) strand; PAM type: NRG; PAM sequence: TGG
tgattttatgcatcaccttc

SEQ ID NO: 69749 - DNA, 20 bp, Artificial Sequence
  Description of Artificial Sequence: Synthetic oligonucleotide
  Target: ATXN1; (-) strand; PAM type: NRG; PAM sequence: TGG
tcattcccaaaggccatttg

SEQ ID NO: 69750 - DNA, 20 bp, Artificial Sequence
  Description of Artificial Sequence: Synthetic oligonucleotide
  Target: ATXN1; (-) strand; PAM type: NRG; PAM sequence: AGG
aaatgtcccatcattcccaa

SEQ ID NO: 69751 - DNA, 20 bp, Artificial Sequence
  Description of Artificial Sequence: Synthetic oligonucleotide
  Target: ATXN1; (-) strand; PAM type: NRG; PAM sequence: AAG
caaatgtcccatcattccca

SEQ ID NO: 69752 - DNA, 20 bp, Artificial Sequence
  Description of Artificial Sequence: Synthetic oligonucleotide
  Target: ATXN1; (-) strand; PAM type: NRG; PAM sequence: GGG
aggccagagctcagctccct

SEQ ID NO: 69753 - DNA, 20 bp, Artificial Sequence
  Description of Artificial Sequence: Synthetic oligonucleotide
  Target: ATXN1; (-) strand; PAM type: NRG; PAM sequence: TGG
caggccagagctcagctccc

SEQ ID NO: 69754 - DNA, 20 bp, Artificial Sequence
  Description of Artificial Sequence: Synthetic oligonucleotide
  Target: ATXN1; (-) strand; PAM type: NRG; PAM sequence: CAG
gcgggacccaggccagagct

SEQ ID NO: 69755 - DNA, 20 bp, Artificial Sequence
  Description of Artificial Sequence: Synthetic oligonucleotide
  Target: ATXN1; (-) strand; PAM type: NRG; PAM sequence: GAG
aatgagcgggacccaggcca

SEQ ID NO: 69756 - DNA, 20 bp, Artificial Sequence
  Description of Artificial Sequence: Synthetic oligonucleotide
  Target: ATXN1; (-) strand; PAM type: NRG; PAM sequence: CAG
ggaatgagcgggacccaggc

SEQ ID NO: 69757 - DNA, 20 bp, Artificial Sequence
  Description of Artificial Sequence: Synthetic oligonucleotide
  Target: ATXN1; (-) strand; PAM type: NRG; PAM sequence: AGG
ggaaggaatgagcgggaccc

SEQ ID NO: 69758 - DNA, 20 bp, Artificial Sequence
  Description of Artificial Sequence: Synthetic oligonucleotide
  Target: ATXN1; (-) strand; PAM type: NRG; PAM sequence: CAG
gggaaggaatgagcgggacc

SEQ ID NO: 69759 - DNA, 20 bp, Artificial Sequence
  Description of Artificial Sequence: Synthetic oligonucleotide
  Target: ATXN1; (-) strand; PAM type: NRG; PAM sequence: GGG
gacggtgggaaggaatgagc

SEQ ID NO: 69760 - DNA, 20 bp, Artificial Sequence
  Description of Artificial Sequence: Synthetic oligonucleotide
  Target: ATXN1; (-) strand; PAM type: NRG; PAM sequence: CGG
ggacggtgggaaggaatgag

SEQ ID NO: 69761 - DNA, 20 bp, Artificial Sequence
  Description of Artificial Sequence: Synthetic oligonucleotide
  Target: ATXN1; (-) strand; PAM type: NRG; PAM sequence: GAG
gcgggacggtgggaaggaat

SEQ ID NO: 69762 - DNA, 20 bp, Artificial Sequence
  Description of Artificial Sequence: Synthetic oligonucleotide
  Target: ATXN1; (-) strand; PAM type: NRG; PAM sequence: AGG
gtggctgcgggacggtggga

SEQ ID NO: 69763 - DNA, 20 bp, Artificial Sequence
  Description of Artificial Sequence: Synthetic oligonucleotide
  Target: ATXN1; (-) strand; PAM type: NRG; PAM sequence: AAG
ggtggctgcgggacggtggg

SEQ ID NO: 69764 - DNA, 20 bp, Artificial Sequence
  Description of Artificial Sequence: Synthetic oligonucleotide
  Target: ATXN1; (-) strand; PAM type: NRG; PAM sequence: GGG
ggtggtggctgcgggacggt

SEQ ID NO: 69765 - DNA, 20 bp, Artificial Sequence
  Description of Artificial Sequence: Synthetic oligonucleotide
  Target: ATXN1; (-) strand; PAM type: NRG; PAM sequence: TGG
tggtggtggctgcgggacgg

SEQ ID NO: 69766 - DNA, 20 bp, Artificial Sequence
  Description of Artificial Sequence: Synthetic oligonucleotide
  Target: ATXN1; (-) strand; PAM type: NRG; PAM sequence: CGG
aggtggtggtggctgcggga

SEQ ID NO: 69767 - DNA, 20 bp, Artificial Sequence
  Description of Artificial Sequence: Synthetic oligonucleotide
  Target: ATXN1; (-) strand; PAM type: NRG; PAM sequence: GGG
tgagaggtggtggtggctgc

SEQ ID NO: 69768 - DNA, 20 bp, Artificial Sequence
  Description of Artificial Sequence: Synthetic oligonucleotide
  Target: ATXN1; (-) strand; PAM type: NRG; PAM sequence: CGG
atgagaggtggtggtggctg

SEQ ID NO: 69769 - DNA, 20 bp, Artificial Sequence
  Description of Artificial Sequence: Synthetic oligonucleotide
  Target: ATXN1; (-) strand; PAM type: NRG; PAM sequence: TGG
cacagaatgagaggtggtgg

SEQ ID NO: 69770 - DNA, 20 bp, Artificial Sequence
  Description of Artificial Sequence: Synthetic oligonucleotide
  Target: ATXN1; (-) strand; PAM type: NRG; PAM sequence: TGG
ccgcacagaatgagaggtgg

SEQ ID NO: 69771 - DNA, 20 bp, Artificial Sequence
  Description of Artificial Sequence: Synthetic oligonucleotide
  Target: ATXN1; (-) strand; PAM type: NRG; PAM sequence: TGG
ctcccgcacagaatgagagg

SEQ ID NO: 69772 - DNA, 20 bp, Artificial Sequence
  Description of Artificial Sequence: Synthetic oligonucleotide
  Target: ATXN1; (-) strand; PAM type: NRG; PAM sequence: AGG
cccctcccgcacagaatgag

SEQ ID NO: 69773 - DNA, 20 bp, Artificial Sequence
  Description of Artificial Sequence: Synthetic oligonucleotide
  Target: ATXN1; (-) strand; PAM type: NRG; PAM sequence: GAG
tcccctcccgcacagaatga

SEQ ID NO: 69774 - DNA, 20 bp, Artificial Sequence
  Description of Artificial Sequence: Synthetic oligonucleotide
  Target: ATXN1; (-) strand; PAM type: NRG; PAM sequence: GAG
tgtcccctcccgcacagaat

SEQ ID NO: 69775 - DNA, 20 bp, Artificial Sequence
  Description of Artificial Sequence: Synthetic oligonucleotide
  Target: ATXN1; (-) strand; PAM type: NRG; PAM sequence: CAG
gccacatgtcccctcccgca

SEQ ID NO: 69776 - DNA, 20 bp, Artificial Sequence
  Description of Artificial Sequence: Synthetic oligonucleotide
  Target: ATXN1; (-) strand; PAM type: NRG; PAM sequence: GGG
taaggaaagtggtggtgcta

SEQ ID NO: 69777 - DNA, 20 bp, Artificial Sequence
  Description of Artificial Sequence: Synthetic oligonucleotide
  Target: ATXN1; (-) strand; PAM type: NRG; PAM sequence: AGG
ataaggaaagtggtggtgct

SEQ ID NO: 69778 - DNA, 20 bp, Artificial Sequence
  Description of Artificial Sequence: Synthetic oligonucleotide
  Target: ATXN1; (-) strand; PAM type: NRG; PAM sequence: TAG
tataaggaaagtggtggtgc

SEQ ID NO: 69779 - DNA, 20 bp, Artificial Sequence
  Description of Artificial Sequence: Synthetic oligonucleotide
  Target: ATXN1; (-) strand; PAM type: NRG; PAM sequence: TGG
actttttataaggaaagtgg

SEQ ID NO: 69780 - DNA, 20 bp, Artificial Sequence
  Description of Artificial Sequence: Synthetic oligonucleotide
  Target: ATXN1; (-) strand; PAM type: NRG; PAM sequence: TGG
attactttttataaggaaag

SEQ ID NO: 69781 - DNA, 20 bp, Artificial Sequence
  Description of Artificial Sequence: Synthetic oligonucleotide
  Target: ATXN1; (-) strand; PAM type: NRG; PAM sequence: AAG
taaattactttttataagga

SEQ ID NO: 69782 - DNA, 20 bp, Artificial Sequence
  Description of Artificial Sequence: Synthetic oligonucleotide
  Target: ATXN1; (-) strand; PAM type: NRG; PAM sequence: AGG
accataaattactttttata

SEQ ID NO: 69783 - DNA, 20 bp, Artificial Sequence
  Description of Artificial Sequence: Synthetic oligonucleotide
  Target: ATXN1; (-) strand; PAM type: NRG; PAM sequence: AAG
aaccataaattactttttat

SEQ ID NO: 69784 - DNA, 20 bp, Artificial Sequence
  Description of Artificial Sequence: Synthetic oligonucleotide
  Target: ATXN1; (-) strand; PAM type: NRG; PAM sequence: GGG
agttttcctgtcatgggaaa

SEQ ID NO: 69785 - DNA, 20 bp, Artificial Sequence
  Description of Artificial Sequence: Synthetic oligonucleotide
  Target: ATXN1; (-) strand; PAM type: NRG; PAM sequence: AGG
cagttttcctgtcatgggaa

SEQ ID NO: 69786 - DNA, 20 bp, Artificial Sequence
  Description of Artificial Sequence: Synthetic oligonucleotide
  Target: ATXN1; (-) strand; PAM type: NRG; PAM sequence: AAG
tcagttttcctgtcatggga

SEQ ID NO: 69787 - DNA, 20 bp, Artificial Sequence
  Description of Artificial Sequence: Synthetic oligonucleotide
  Target: ATXN1; (-) strand; PAM type: NRG; PAM sequence: GGG
tctatcagttttcctgtcat

SEQ ID NO: 69788 - DNA, 20 bp, Artificial Sequence
  Description of Artificial Sequence: Synthetic oligonucleotide
  Target: ATXN1; (-) strand; PAM type: NRG; PAM sequence: TGG
ttctatcagttttcctgtca

SEQ ID NO: 69789 - DNA, 20 bp, Artificial Sequence
  Description of Artificial Sequence: Synthetic oligonucleotide
  Target: ATXN1; (-) strand; PAM type: NRG; PAM sequence: CAG
ttttgcctgtaaacttctat

SEQ ID NO: 69790 - DNA, 20 bp, Artificial Sequence
  Description of Artificial Sequence: Synthetic oligonucleotide
  Target: ATXN1; (-) strand; PAM type: NRG; PAM sequence: TAG
tatccccaaatgaaaagaat

SEQ ID NO: 69791 - DNA, 20 bp, Artificial Sequence
  Description of Artificial Sequence: Synthetic oligonucleotide
  Target: ATXN1; (-) strand; PAM type: NRG; PAM sequence: AAG
ttgtcttatccccaaatgaa

SEQ ID NO: 69792 - DNA, 20 bp, Artificial Sequence
  Description of Artificial Sequence: Synthetic oligonucleotide
  Target: ATXN1; (-) strand; PAM type: NRG; PAM sequence: AAG
aaatacacacagagggggaa

SEQ ID NO: 69793 - DNA, 20 bp, Artificial Sequence
  Description of Artificial Sequence: Synthetic oligonucleotide
  Target: ATXN1; (-) strand; PAM type: NRG; PAM sequence: GGG
tttaaaaatacacacagagg

SEQ ID NO: 69794 - DNA, 20 bp, Artificial Sequence
  Description of Artificial Sequence: Synthetic oligonucleotide
  Target: ATXN1; (-) strand; PAM type: NRG; PAM sequence: GGG
ttttaaaaatacacacagag

SEQ ID NO: 69795 - DNA, 20 bp, Artificial Sequence
  Description of Artificial Sequence: Synthetic oligonucleotide
  Target: ATXN1; (-) strand; PAM type: NRG; PAM sequence: GGG
attttaaaaatacacacaga

SEQ ID NO: 69796 - DNA, 20 bp, Artificial Sequence
  Description of Artificial Sequence: Synthetic oligonucleotide
  Target: ATXN1; (-) strand; PAM type: NRG; PAM sequence: AGG
tattttaaaaatacacacag

SEQ ID NO: 69797 - DNA, 20 bp, Artificial Sequence
  Description of Artificial Sequence: Synthetic oligonucleotide
  Target: ATXN1; (-) strand; PAM type: NRG; PAM sequence: GAG
ctattttaaaaatacacaca

SEQ ID NO: 69798 - DNA, 20 bp, Artificial Sequence
  Description of Artificial Sequence: Synthetic oligonucleotide
  Target: ATXN1; (-) strand; PAM type: NRG; PAM sequence: CAG
tactattttaaaaatacaca

SEQ ID NO: 69799 - DNA, 20 bp, Artificial Sequence
  Description of Artificial Sequence: Synthetic oligonucleotide
  Target: ATXN1; (-) strand; PAM type: NRG; PAM sequence: AGG
gcatatgtgcaagccgataa

SEQ ID NO: 69800 - DNA, 20 bp, Artificial Sequence
  Description of Artificial Sequence: Synthetic oligonucleotide
  Target: ATXN1; (-) strand; PAM type: NRG; PAM sequence: AAG
agcatatgtgcaagccgata

SEQ ID NO: 69801 - DNA, 20 bp, Artificial Sequence
  Description of Artificial Sequence: Synthetic oligonucleotide
  Target: ATXN1; (-) strand; PAM type: NRG; PAM sequence: AAG
cctgcctttagcatatgtgc

SEQ ID NO: 69802 - DNA, 20 bp, Artificial Sequence
  Description of Artificial Sequence: Synthetic oligonucleotide
  Target: ATXN1; (-) strand; PAM type: NRG; PAM sequence: TAG
agtcttatgtgccctgcctt

SEQ ID NO: 69803 - DNA, 20 bp, Artificial Sequence
  Description of Artificial Sequence: Synthetic oligonucleotide
  Target: ATXN1; (-) strand; PAM type: NRG; PAM sequence: GAG
cttggcatactttcctgtaa

SEQ ID NO: 69804 - DNA, 20 bp, Artificial Sequence
  Description of Artificial Sequence: Synthetic oligonucleotide
  Target: ATXN1; (-) strand; PAM type: NRG; PAM sequence: AAG
ctcttggcatactttcctgt

SEQ ID NO: 69805 - DNA, 20 bp, Artificial Sequence
  Description of Artificial Sequence: Synthetic oligonucleotide
  Target: ATXN1; (-) strand; PAM type: NRG; PAM sequence: TGG
ttgatcattcttttttctct

SEQ ID NO: 69806 - DNA, 20 bp, Artificial Sequence
  Description of Artificial Sequence: Synthetic oligonucleotide
  Target: ATXN1; (-) strand; PAM type: NRG; PAM sequence: GAG
ctggtttaaggcatatttag

SEQ ID NO: 69807 - DNA, 20 bp, Artificial Sequence
  Description of Artificial Sequence: Synthetic oligonucleotide
  Target: ATXN1; (-) strand; PAM type: NRG; PAM sequence: AGG
ccctggtttaaggcatattt

SEQ ID NO: 69808 - DNA, 20 bp, Artificial Sequence
  Description of Artificial Sequence: Synthetic oligonucleotide
  Target: ATXN1; (-) strand; PAM type: NRG; PAM sequence: TAG
cccctggtttaaggcatatt

SEQ ID NO: 69809 - DNA, 20 bp, Artificial Sequence
  Description of Artificial Sequence: Synthetic oligonucleotide
  Target: ATXN1; (-) strand; PAM type: NRG; PAM sequence: AGG
gtcacgtatcccctggttta

SEQ ID NO: 69810 - DNA, 20 bp, Artificial Sequence
  Description of Artificial Sequence: Synthetic oligonucleotide
  Target: ATXN1; (-) strand; PAM type: NRG; PAM sequence: AAG
ggtcacgtatcccctggttt

SEQ ID NO: 69811 - DNA, 20 bp, Artificial Sequence
  Description of Artificial Sequence: Synthetic oligonucleotide
  Target: ATXN1; (-) strand; PAM type: NRG; PAM sequence: TGG
aaaattggtcacgtatcccc

SEQ ID NO: 69812 - DNA, 20 bp, Artificial Sequence
  Description of Artificial Sequence: Synthetic oligonucleotide
  Target: ATXN1; (-) strand; PAM type: NRG; PAM sequence: TGG
acagaattactgaataaaat

SEQ ID NO: 69813 - DNA, 20 bp, Artificial Sequence
  Description of Artificial Sequence: Synthetic oligonucleotide
  Target: ATXN1; (-) strand; PAM type: NRG; PAM sequence: CAG
gtggttagaacacatgcaaa

SEQ ID NO: 69814 - DNA, 20 bp, Artificial Sequence
  Description of Artificial Sequence: Synthetic oligonucleotide
  Target: ATXN1; (-) strand; PAM type: NRG; PAM sequence: TAG
atagctgaaatggtagtggt

SEQ ID NO: 69815 - DNA, 20 bp, Artificial Sequence
  Description of Artificial Sequence: Synthetic oligonucleotide
  Target: ATXN1; (-) strand; PAM type: NRG; PAM sequence: TGG
gaaaatagctgaaatggtag

SEQ ID NO: 69816 - DNA, 20 bp, Artificial Sequence
  Description of Artificial Sequence: Synthetic oligonucleotide
  Target: ATXN1; (-) strand; PAM type: NRG; PAM sequence: TAG
taggaaaatagctgaaatgg

SEQ ID NO: 69817 - DNA, 20 bp, Artificial Sequence
  Description of Artificial Sequence: Synthetic oligonucleotide
  Target: ATXN1; (-) strand; PAM type: NRG; PAM sequence: TGG
ttttaggaaaatagctgaaa

SEQ ID NO: 69818 - DNA, 20 bp, Artificial Sequence
  Description of Artificial Sequence: Synthetic oligonucleotide
  Target: ATXN1; (-) strand; PAM type: NRG; PAM sequence: TAG
tttttttttttttaggaaaa

SEQ ID NO: 69819 - DNA, 20 bp, Artificial Sequence
  Description of Artificial Sequence: Synthetic oligonucleotide
  Target: ATXN1; (-) strand; PAM type: NRG; PAM sequence: AGG
tttttttttttttttttttt

SEQ ID NO: 69820 - DNA, 20 bp, Artificial Sequence
  Description of Artificial Sequence: Synthetic oligonucleotide
  Target: ATXN1; (-) strand; PAM type: NRG; PAM sequence: TAG
tttttttttttttttttttt

SEQ ID NO: 69821 - DNA, 20 bp, Artificial Sequence
  Description of Artificial Sequence: Synthetic oligonucleotide
  Target: ATXN1; (-) strand; PAM type: NRG; PAM sequence: AGG
tctaaattcctctgagccct

SEQ ID NO: 69822 - DNA, 20 bp, Artificial Sequence
  Description of Artificial Sequence: Synthetic oligonucleotide
  Target: ATXN1; (-) strand; PAM type: NRG; PAM sequence: TAG
atctaaattcctctgagccc

SEQ ID NO: 69823 - DNA, 20 bp, Artificial Sequence
  Description of Artificial Sequence: Synthetic oligonucleotide
  Target: ATXN1; (-) strand; PAM type: NRG; PAM sequence: GAG
gaaaacatctaaattcctct

SEQ ID NO: 69824 - DNA, 20 bp, Artificial Sequence
  Description of Artificial Sequence: Synthetic oligonucleotide
  Target: ATXN1; (-) strand; PAM type: NRG; PAM sequence: TAG
gaagctctaaaagcatcaag

SEQ ID NO: 69825 - DNA, 20 bp, Artificial Sequence
  Description of Artificial Sequence: Synthetic oligonucleotide
  Target: ATXN1; (-) strand; PAM type: NRG; PAM sequence: AAG
catgaagctctaaaagcatc

SEQ ID NO: 69826 - DNA, 20 bp, Artificial Sequence
  Description of Artificial Sequence: Synthetic oligonucleotide
  Target: ATXN1; (-) strand; PAM type: NRG; PAM sequence: AAG
actcaagcatgaagctctaa

SEQ ID NO: 69827 - DNA, 20 bp, Artificial Sequence
  Description of Artificial Sequence: Synthetic oligonucleotide
  Target: ATXN1; (-) strand; PAM type: NRG; PAM sequence: AAG
tcgcctttaactcaagcatg

SEQ ID NO: 69828 - DNA, 20 bp, Artificial Sequence
  Description of Artificial Sequence: Synthetic oligonucleotide
  Target: ATXN1; (-) strand; PAM type: NRG; PAM sequence: AAG
taagtgctcgcctttaactc

SEQ ID NO: 69829 - DNA, 20 bp, Artificial Sequence
  Description of Artificial Sequence: Synthetic oligonucleotide
  Target: ATXN1; (-) strand; PAM type: NRG; PAM sequence: AAG
agaggttagagttaattttt

SEQ ID NO: 69830 - DNA, 20 bp, Artificial Sequence
  Description of Artificial Sequence: Synthetic oligonucleotide
  Target: ATXN1; (-) strand; PAM type: NRG; PAM sequence: GAG
agccctaaacccagaggtta

SEQ ID NO: 69831 - DNA, 20 bp, Artificial Sequence
  Description of Artificial Sequence: Synthetic oligonucleotide
  Target: ATXN1; (-) strand; PAM type: NRG; PAM sequence: TAG
ctagccctaaacccagaggt

SEQ ID NO: 69832 - DNA, 20 bp, Artificial Sequence
  Description of Artificial Sequence: Synthetic oligonucleotide
  Target: ATXN1; (-) strand; PAM type: NRG; PAM sequence: AGG
gcttctagccctaaacccag

SEQ ID NO: 69833 - DNA, 20 bp, Artificial Sequence
  Description of Artificial Sequence: Synthetic oligonucleotide
  Target: ATXN1; (-) strand; PAM type: NRG; PAM sequence: GAG
ggcttctagccctaaaccca

SEQ ID NO: 69834 - DNA, 20 bp, Artificial Sequence
  Description of Artificial Sequence: Synthetic oligonucleotide
  Target: ATXN1; (-) strand; PAM type: NRG; PAM sequence: CAG
ttggcttctagccctaaacc

SEQ ID NO: 69835 - DNA, 20 bp, Artificial Sequence
  Description of Artificial Sequence: Synthetic oligonucleotide
  Target: ATXN1; (-) strand; PAM type: NRG; PAM sequence: TAG
tatgggaagtcattggcttc

SEQ ID NO: 69836 - DNA, 20 bp, Artificial Sequence
  Description of Artificial Sequence: Synthetic oligonucleotide
  Target: ATXN1; (-) strand; PAM type: NRG; PAM sequence: TGG
gtgaccctatgggaagtcat

SEQ ID NO: 69837 - DNA, 20 bp, Artificial Sequence
  Description of Artificial Sequence: Synthetic oligonucleotide
  Target: ATXN1; (-) strand; PAM type: NRG; PAM sequence: AAG
atctttagtgaccctatggg

SEQ ID NO: 69838 - DNA, 20 bp, Artificial Sequence
  Description of Artificial Sequence: Synthetic oligonucleotide
  Target: ATXN1; (-) strand; PAM type: NRG; PAM sequence: GGG
agcatctttagtgaccctat

SEQ ID NO: 69839 - DNA, 20 bp, Artificial Sequence
  Description of Artificial Sequence: Synthetic oligonucleotide
  Target: ATXN1; (-) strand; PAM type: NRG; PAM sequence: TGG
tagcatctttagtgacccta

SEQ ID NO: 69840 - DNA, 20 bp, Artificial Sequence
  Description of Artificial Sequence: Synthetic oligonucleotide
  Target: ATXN1; (-) strand; PAM type: NRG; PAM sequence: TAG
tagccaacaaatagcatctt

SEQ ID NO: 69841 - DNA, 20 bp, Artificial Sequence
  Description of Artificial Sequence: Synthetic oligonucleotide
  Target: ATXN1; (-) strand; PAM type: NRG; PAM sequence: TAG
ggacaaatctagccaacaaa

SEQ ID NO: 69842 - DNA, 20 bp, Artificial Sequence
  Description of Artificial Sequence: Synthetic oligonucleotide
  Target: ATXN1; (-) strand; PAM type: NRG; PAM sequence: TAG
gagtactcccaggacaaatc

SEQ ID NO: 69843 - DNA, 20 bp, Artificial Sequence
  Description of Artificial Sequence: Synthetic oligonucleotide
  Target: ATXN1; (-) strand; PAM type: NRG; PAM sequence: AGG
cgagacccttgagtactccc

SEQ ID NO: 69844 - DNA, 20 bp, Artificial Sequence
  Description of Artificial Sequence: Synthetic oligonucleotide
  Target: ATXN1; (-) strand; PAM type: NRG; PAM sequence: CAG
gcgagacccttgagtactcc

SEQ ID NO: 69845 - DNA, 20 bp, Artificial Sequence
  Description of Artificial Sequence: Synthetic oligonucleotide
  Target: ATXN1; (-) strand; PAM type: NRG; PAM sequence: GAG
acttttgttgcgagaccctt

SEQ ID NO: 69846 - DNA, 20 bp, Artificial Sequence
  Description of Artificial Sequence: Synthetic oligonucleotide
  Target: ATXN1; (-) strand; PAM type: NRG; PAM sequence: GAG
aaccctgttacttttgttgc

SEQ ID NO: 69847 - DNA, 20 bp, Artificial Sequence
  Description of Artificial Sequence: Synthetic oligonucleotide
  Target: ATXN1; (-) strand; PAM type: NRG; PAM sequence: AAG
caatcgagtctttaggttcg

SEQ ID NO: 69848 - DNA, 20 bp, Artificial Sequence
  Description of Artificial Sequence: Synthetic oligonucleotide
  Target: ATXN1; (-) strand; PAM type: NRG; PAM sequence: AGG
catgctgcaatcgagtcttt

SEQ ID NO: 69849 - DNA, 20 bp, Artificial Sequence
  Description of Artificial Sequence: Synthetic oligonucleotide
  Target: ATXN1; (-) strand; PAM type: NRG; PAM sequence: TAG
ccatgctgcaatcgagtctt

SEQ ID NO: 69850 - DNA, 20 bp, Artificial Sequence
  Description of Artificial Sequence: Synthetic oligonucleotide
  Target: ATXN1; (-) strand; PAM type: NRG; PAM sequence: GAG
tgttttcccatgctgcaatc

SEQ ID NO: 69851 - DNA, 20 bp, Artificial Sequence
  Description of Artificial Sequence: Synthetic oligonucleotide
  Target: ATXN1; (-) strand; PAM type: NRG; PAM sequence: AGG
ttcagacttgatagtaaaaa

SEQ ID NO: 69852 - DNA, 20 bp, Artificial Sequence
  Description of Artificial Sequence: Synthetic oligonucleotide
  Target: ATXN1; (-) strand; PAM type: NRG; PAM sequence: AAG
cttcagacttgatagtaaaa

SEQ ID NO: 69853 - DNA, 20 bp, Artificial Sequence
  Description of Artificial Sequence: Synthetic oligonucleotide
  Target: ATXN1; (-) strand; PAM type: NRG; PAM sequence: TAG
ctccagtacttcagacttga

SEQ ID NO: 69854 - DNA, 20 bp, Artificial Sequence
  Description of Artificial Sequence: Synthetic oligonucleotide
  Target: ATXN1; (-) strand; PAM type: NRG; PAM sequence: CAG
tctcatcatctccagtactt

SEQ ID NO: 69855 - DNA, 20 bp, Artificial Sequence
  Description of Artificial Sequence: Synthetic oligonucleotide
  Target: ATXN1; (-) strand; PAM type: NRG; PAM sequence: CAG
gatgttcctctcatcatctc

SEQ ID NO: 69856 - DNA, 20 bp, Artificial Sequence
  Description of Artificial Sequence: Synthetic oligonucleotide
  Target: ATXN1; (-) strand; PAM type: NRG; PAM sequence: TGG
ggactggaattttctcttca

SEQ ID NO: 69857 - DNA, 20 bp, Artificial Sequence
  Description of Artificial Sequence: Synthetic oligonucleotide
  Target: ATXN1; (-) strand; PAM type: NRG; PAM sequence: TGG
caggatggcacacccaggac

SEQ ID NO: 69858 - DNA, 20 bp, Artificial Sequence
  Description of Artificial Sequence: Synthetic oligonucleotide
  Target: ATXN1; (-) strand; PAM type: NRG; PAM sequence: AGG
ttgctcaggatggcacaccc

SEQ ID NO: 69859 - DNA, 20 bp, Artificial Sequence
  Description of Artificial Sequence: Synthetic oligonucleotide
  Target: ATXN1; (-) strand; PAM type: NRG; PAM sequence: CAG
cttgctcaggatggcacacc

SEQ ID NO: 69860 - DNA, 20 bp, Artificial Sequence
  Description of Artificial Sequence: Synthetic oligonucleotide
  Target: ATXN1; (-) strand; PAM type: NRG; PAM sequence: TGG
gagctatgacttgctcagga

SEQ ID NO: 69861 - DNA, 20 bp, Artificial Sequence
  Description of Artificial Sequence: Synthetic oligonucleotide
  Target: ATXN1; (-) strand; PAM type: NRG; PAM sequence: AGG
aggagagctatgacttgctc

SEQ ID NO: 69862 - DNA, 20 bp, Artificial Sequence
  Description of Artificial Sequence: Synthetic oligonucleotide
  Target: ATXN1; (-) strand; PAM type: NRG; PAM sequence: CAG
gaggagagctatgacttgct

SEQ ID NO: 69863 - DNA, 20 bp, Artificial Sequence
  Description of Artificial Sequence: Synthetic oligonucleotide
  Target: ATXN1; (-) strand; PAM type: NRG; PAM sequence: GAG
ggaaactgaggtgcagagga

SEQ ID NO: 69864 - DNA, 20 bp, Artificial Sequence
  Description of Artificial Sequence: Synthetic oligonucleotide
  Target: ATXN1; (-) strand; PAM type: NRG; PAM sequence: GAG
taggaaactgaggtgcagag

SEQ ID NO: 69865 - DNA, 20 bp, Artificial Sequence
  Description of Artificial Sequence: Synthetic oligonucleotide
  Target: ATXN1; (-) strand; PAM type: NRG; PAM sequence: AGG
attaggaaactgaggtgcag

SEQ ID NO: 69866 - DNA, 20 bp, Artificial Sequence
  Description of Artificial Sequence: Synthetic oligonucleotide
  Target: ATXN1; (-) strand; PAM type: NRG; PAM sequence: GAG
gattaggaaactgaggtgca

SEQ ID NO: 69867 - DNA, 20 bp, Artificial Sequence
  Description of Artificial Sequence: Synthetic oligonucleotide
  Target: ATXN1; (-) strand; PAM type: NRG; PAM sequence: CAG
ctgattaggaaactgaggtg

SEQ ID NO: 69868 - DNA, 20 bp, Artificial Sequence
  Description of Artificial Sequence: Synthetic oligonucleotide
  Target: ATXN1; (-) strand; PAM type: NRG; PAM sequence: AGG
ttttactgattaggaaactg

SEQ ID NO: 69869 - DNA, 20 bp, Artificial Sequence
  Description of Artificial Sequence: Synthetic oligonucleotide
  Target: ATXN1; (-) strand; PAM type: NRG; PAM sequence: GAG
gttttactgattaggaaact

SEQ ID NO: 69870 - DNA, 20 bp, Artificial Sequence
  Description of Artificial Sequence: Synthetic oligonucleotide
  Target: ATXN1; (-) strand; PAM type: NRG; PAM sequence: AGG
actcccttgttttactgatt

SEQ ID NO: 69871 - DNA, 20 bp, Artificial Sequence
  Description of Artificial Sequence: Synthetic oligonucleotide
  Target: ATXN1; (-) strand; PAM type: NRG; PAM sequence: TAG
aactcccttgttttactgat

SEQ ID NO: 69872 - DNA, 20 bp, Artificial Sequence
  Description of Artificial Sequence: Synthetic oligonucleotide
  Target: ATXN1; (-) strand; PAM type: NRG; PAM sequence: GAG
ctggagcatgcgagggactt

SEQ ID NO: 69873 - DNA, 20 bp, Artificial Sequence
  Description of Artificial Sequence: Synthetic oligonucleotide
  Target: ATXN1; (-) strand; PAM type: NRG; PAM sequence: GGG
cggagacctggagcatgcga

SEQ ID NO: 69874 - DNA, 20 bp, Artificial Sequence
  Description of Artificial Sequence: Synthetic oligonucleotide
  Target: ATXN1; (-) strand; PAM type: NRG; PAM sequence: AGG
tcggagacctggagcatgcg

SEQ ID NO: 69875 - DNA, 20 bp, Artificial Sequence
  Description of Artificial Sequence: Synthetic oligonucleotide
  Target: ATXN1; (-) strand; PAM type: NRG; PAM sequence: GAG
atcggagacctggagcatgc

SEQ ID NO: 69876 - DNA, 20 bp, Artificial Sequence
  Description of Artificial Sequence: Synthetic oligonucleotide
  Target: ATXN1; (-) strand; PAM type: NRG; PAM sequence: GAG
agcgtggaatcggagacctg

SEQ ID NO: 69877 - DNA, 20 bp, Artificial Sequence
  Description of Artificial Sequence: Synthetic oligonucleotide
  Target: ATXN1; (-) strand; PAM type: NRG; PAM sequence: TGG
ggagcgtggaatcggagacc

SEQ ID NO: 69878 - DNA, 20 bp, Artificial Sequence
  Description of Artificial Sequence: Synthetic oligonucleotide
  Target: ATXN1; (-) strand; PAM type: NRG; PAM sequence: GAG
agacgaggagcgtggaatcg

SEQ ID NO: 69879 - DNA, 20 bp, Artificial Sequence
  Description of Artificial Sequence: Synthetic oligonucleotide
  Target: ATXN1; (-) strand; PAM type: NRG; PAM sequence: CGG
aaagacgaggagcgtggaat

SEQ ID NO: 69880 - DNA, 20 bp, Artificial Sequence
  Description of Artificial Sequence: Synthetic oligonucleotide
  Target: ATXN1; (-) strand; PAM type: NRG; PAM sequence: TGG
aaagagaaagacgaggagcg

SEQ ID NO: 69881 - DNA, 20 bp, Artificial Sequence
  Description of Artificial Sequence: Synthetic oligonucleotide
  Target: ATXN1; (-) strand; PAM type: NRG; PAM sequence: GAG
ctggcaaagagaaagacgag

SEQ ID NO: 69882 - DNA, 20 bp, Artificial Sequence
  Description of Artificial Sequence: Synthetic oligonucleotide
  Target: ATXN1; (-) strand; PAM type: NRG; PAM sequence: AGG
tgctggcaaagagaaagacg

SEQ ID NO: 69883 - DNA, 20 bp, Artificial Sequence
  Description of Artificial Sequence: Synthetic oligonucleotide
  Target: ATXN1; (-) strand; PAM type: NRG; PAM sequence: GAG
ctgctggcaaagagaaagac

SEQ ID NO: 69884 - DNA, 20 bp, Artificial Sequence
  Description of Artificial Sequence: Synthetic oligonucleotide
  Target: ATXN1; (-) strand; PAM type: NRG; PAM sequence: AAG
agtccctgctggcaaagaga

SEQ ID NO: 69885 - DNA, 20 bp, Artificial Sequence
  Description of Artificial Sequence: Synthetic oligonucleotide
  Target: ATXN1; (-) strand; PAM type: NRG; PAM sequence: GAG
actcagtccctgctggcaaa

SEQ ID NO: 69886 - DNA, 20 bp, Artificial Sequence
  Description of Artificial Sequence: Synthetic oligonucleotide
  Target: ATXN1; (-) strand; PAM type: NRG; PAM sequence: AAG
acactcagtccctgctggca

SEQ ID NO: 69887 - DNA, 20 bp, Artificial Sequence
  Description of Artificial Sequence: Synthetic oligonucleotide
  Target: ATXN1; (-) strand; PAM type: NRG; PAM sequence: TGG
gtcacacactcagtccctgc

SEQ ID NO: 69888 - DNA, 20 bp, Artificial Sequence
  Description of Artificial Sequence: Synthetic oligonucleotide
  Target: ATXN1; (-) strand; PAM type: NRG; PAM sequence: CAG
cacaaccttcgtcacacact

SEQ ID NO: 69889 - DNA, 20 bp, Artificial Sequence
  Description of Artificial Sequence: Synthetic oligonucleotide
  Target: ATXN1; (-) strand; PAM type: NRG; PAM sequence: AGG
tcacattcctctgaggtcaa

SEQ ID NO: 69890 - DNA, 20 bp, Artificial Sequence
  Description of Artificial Sequence: Synthetic oligonucleotide
  Target: ATXN1; (-) strand; PAM type: NRG; PAM sequence: AAG
gtcacattcctctgaggtca

SEQ ID NO: 69891 - DNA, 20 bp, Artificial Sequence
  Description of Artificial Sequence: Synthetic oligonucleotide
  Target: ATXN1; (-) strand; PAM type: NRG; PAM sequence: AGG
gccgttgtcacattcctctg

SEQ ID NO: 69892 - DNA, 20 bp, Artificial Sequence
  Description of Artificial Sequence: Synthetic oligonucleotide
  Target: ATXN1; (-) strand; PAM type: NRG; PAM sequence: GAG
ggccgttgtcacattcctct

SEQ ID NO: 69893 - DNA, 20 bp, Artificial Sequence
  Description of Artificial Sequence: Synthetic oligonucleotide
  Target: ATXN1; (-) strand; PAM type: NRG; PAM sequence: AGG
ctgtgggaacaatgcaagga

SEQ ID NO: 69894 - DNA, 20 bp, Artificial Sequence
  Description of Artificial Sequence: Synthetic oligonucleotide
  Target: ATXN1; (-) strand; PAM type: NRG; PAM sequence: AAG
actgtgggaacaatgcaagg

SEQ ID NO: 69895 - DNA, 20 bp, Artificial Sequence
  Description of Artificial Sequence: Synthetic oligonucleotide
  Target: ATXN1; (-) strand; PAM type: NRG; PAM sequence: AGG
gttactgtgggaacaatgca

SEQ ID NO: 69896 - DNA, 20 bp, Artificial Sequence
  Description of Artificial Sequence: Synthetic oligonucleotide
  Target: ATXN1; (-) strand; PAM type: NRG; PAM sequence: AAG
ggttactgtgggaacaatgc

SEQ ID NO: 69897 - DNA, 20 bp, Artificial Sequence
  Description of Artificial Sequence: Synthetic oligonucleotide
  Target: ATXN1; (-) strand; PAM type: NRG; PAM sequence: GGG
cagctggctctggttactgt

SEQ ID NO: 69898 - DNA, 20 bp, Artificial Sequence
  Description of Artificial Sequence: Synthetic oligonucleotide
  Target: ATXN1; (-) strand; PAM type: NRG; PAM sequence: TGG
acagctggctctggttactg

SEQ ID NO: 69899 - DNA, 20 bp, Artificial Sequence
  Description of Artificial Sequence: Synthetic oligonucleotide
  Target: ATXN1; (-) strand; PAM type: NRG; PAM sequence: TGG
ccggcctggacagctggctc

SEQ ID NO: 69900 - DNA, 20 bp, Artificial Sequence
  Description of Artificial Sequence: Synthetic oligonucleotide
  Target: ATXN1; (-) strand; PAM type: NRG; PAM sequence: TGG
ggccagccggcctggacagc

SEQ ID NO: 69901 - DNA, 20 bp, Artificial Sequence
  Description of Artificial Sequence: Synthetic oligonucleotide
  Target: ATXN1; (-) strand; PAM type: NRG; PAM sequence: CAG
acttggccagccggcctgga

SEQ ID NO: 69902 - DNA, 20 bp, Artificial Sequence
  Description of Artificial Sequence: Synthetic oligonucleotide
  Target: ATXN1; (-) strand; PAM type: NRG; PAM sequence: TGG
cacaacttggccagccggcc

SEQ ID NO: 69903 - DNA, 20 bp, Artificial Sequence
  Description of Artificial Sequence: Synthetic oligonucleotide
  Target: ATXN1; (-) strand; PAM type: NRG; PAM sequence: CGG
tgcgccacaacttggccagc

SEQ ID NO: 69904 - DNA, 20 bp, Artificial Sequence
  Description of Artificial Sequence: Synthetic oligonucleotide
  Target: ATXN1; (-) strand; PAM type: NRG; PAM sequence: CAG
atcctgcgccacaacttggc

SEQ ID NO: 69905 - DNA, 20 bp, Artificial Sequence
  Description of Artificial Sequence: Synthetic oligonucleotide
  Target: ATXN1; (-) strand; PAM type: NRG; PAM sequence: TGG
tgtgatcctgcgccacaact

SEQ ID NO: 69906 - DNA, 20 bp, Artificial Sequence
  Description of Artificial Sequence: Synthetic oligonucleotide
  Target: ATXN1; (-) strand; PAM type: NRG; PAM sequence: GAG
gaggcggagtcccccaagca

SEQ ID NO: 69907 - DNA, 20 bp, Artificial Sequence
  Description of Artificial Sequence: Synthetic oligonucleotide
  Target: ATXN1; (-) strand; PAM type: NRG; PAM sequence: CAG
ttgaggcggagtcccccaag

SEQ ID NO: 69908 - DNA, 20 bp, Artificial Sequence
  Description of Artificial Sequence: Synthetic oligonucleotide
  Target: ATXN1; (-) strand; PAM type: NRG; PAM sequence: AAG
gccttgaggcggagtccccc

SEQ ID NO: 69909 - DNA, 20 bp, Artificial Sequence
  Description of Artificial Sequence: Synthetic oligonucleotide
  Target: ATXN1; (-) strand; PAM type: NRG; PAM sequence: GAG
aagggggaggccttgaggcg

SEQ ID NO: 69910 - DNA, 20 bp, Artificial Sequence
  Description of Artificial Sequence: Synthetic oligonucleotide
  Target: ATXN1; (-) strand; PAM type: NRG; PAM sequence: CGG
ggaagggggaggccttgagg

SEQ ID NO: 69911 - DNA, 20 bp, Artificial Sequence
  Description of Artificial Sequence: Synthetic oligonucleotide
  Target: ATXN1; (-) strand; PAM type: NRG; PAM sequence: AGG
agaggaagggggaggccttg

SEQ ID NO: 69912 - DNA, 20 bp, Artificial Sequence
  Description of Artificial Sequence: Synthetic oligonucleotide
  Target: ATXN1; (-) strand; PAM type: NRG; PAM sequence: GAG
tagaggaagggggaggcctt

SEQ ID NO: 69913 - DNA, 20 bp, Artificial Sequence
  Description of Artificial Sequence: Synthetic oligonucleotide
  Target: ATXN1; (-) strand; PAM type: NRG; PAM sequence: AGG
aaagacctagaggaaggggg

SEQ ID NO: 69914 - DNA, 20 bp, Artificial Sequence
  Description of Artificial Sequence: Synthetic oligonucleotide
  Target: ATXN1; (-) strand; PAM type: NRG; PAM sequence: GAG
taaagacctagaggaagggg

SEQ ID NO: 69915 - DNA, 20 bp, Artificial Sequence
  Description of Artificial Sequence: Synthetic oligonucleotide
  Target: ATXN1; (-) strand; PAM type: NRG; PAM sequence: GGG
gataaagacctagaggaagg

SEQ ID NO: 69916 - DNA, 20 bp, Artificial Sequence
  Description of Artificial Sequence: Synthetic oligonucleotide
  Target: ATXN1; (-) strand; PAM type: NRG; PAM sequence: GGG
ggataaagacctagaggaag

SEQ ID NO: 69917 - DNA, 20 bp, Artificial Sequence
  Description of Artificial Sequence: Synthetic oligonucleotide
  Target: ATXN1; (-) strand; PAM type: NRG; PAM sequence: GGG
cggataaagacctagaggaa

SEQ ID NO: 69918 - DNA, 20 bp, Artificial Sequence
  Description of Artificial Sequence: Synthetic oligonucleotide
  Target: ATXN1; (-) strand; PAM type: NRG; PAM sequence: AGG
gcggataaagacctagagga

SEQ ID NO: 69919 - DNA, 20 bp, Artificial Sequence
  Description of Artificial Sequence: Synthetic oligonucleotide
  Target: ATXN1; (-) strand; PAM type: NRG; PAM sequence: AAG
tgcggataaagacctagagg

SEQ ID NO: 69920 - DNA, 20 bp, Artificial Sequence
  Description of Artificial Sequence: Synthetic oligonucleotide
  Target: ATXN1; (-) strand; PAM type: NRG; PAM sequence: AGG
acctgcggataaagacctag

SEQ ID NO: 69921 - DNA, 20 bp, Artificial Sequence
  Description of Artificial Sequence: Synthetic oligonucleotide
  Target: ATXN1; (-) strand; PAM type: NRG; PAM sequence: GAG
gacctgcggataaagaccta

SEQ ID NO: 69922 - DNA, 20 bp, Artificial Sequence
  Description of Artificial Sequence: Synthetic oligonucleotide
  Target: ATXN1; (-) strand; PAM type: NRG; PAM sequence: TAG
ccgacctgcggataaagacc

SEQ ID NO: 69923 - DNA, 20 bp, Artificial Sequence
  Description of Artificial Sequence: Synthetic oligonucleotide
  Target: ATXN1; (-) strand; PAM type: NRG; PAM sequence: AAG
agggtcccgacctgcggata

SEQ ID NO: 69924 - DNA, 20 bp, Artificial Sequence
  Description of Artificial Sequence: Synthetic oligonucleotide
  Target: ATXN1; (-) strand; PAM type: NRG; PAM sequence: CGG
cttaggagggtcccgacctg

SEQ ID NO: 69925 - DNA, 20 bp, Artificial Sequence
  Description of Artificial Sequence: Synthetic oligonucleotide
  Target: ATXN1; (-) strand; PAM type: NRG; PAM sequence: GGG
tcattcttgtgttcttagga

SEQ ID NO: 69926 - DNA, 20 bp, Artificial Sequence
  Description of Artificial Sequence: Synthetic oligonucleotide
  Target: ATXN1; (-) strand; PAM type: NRG; PAM sequence: AGG
ctcattcttgtgttcttagg

SEQ ID NO: 69927 - DNA, 20 bp, Artificial Sequence
  Description of Artificial Sequence: Synthetic oligonucleotide
  Target: ATXN1; (-) strand; PAM type: NRG; PAM sequence: GAG
gctcattcttgtgttcttag

SEQ ID NO: 69928 - DNA, 20 bp, Artificial Sequence
  Description of Artificial Sequence: Synthetic oligonucleotide
  Target: ATXN1; (-) strand; PAM type: NRG; PAM sequence: AGG
aggctcattcttgtgttctt

SEQ ID NO: 69929 - DNA, 20 bp, Artificial Sequence
  Description of Artificial Sequence: Synthetic oligonucleotide
  Target: ATXN1; (-) strand; PAM type: NRG; PAM sequence: TAG
caggctcattcttgtgttct

SEQ ID NO: 69930 - DNA, 20 bp, Artificial Sequence
  Description of Artificial Sequence: Synthetic oligonucleotide
  Target: ATXN1; (-) strand; PAM type: NRG; PAM sequence: AGG
agttatttaggaaggattgc

SEQ ID NO: 69931 - DNA, 20 bp, Artificial Sequence
  Description of Artificial Sequence: Synthetic oligonucleotide
  Target: ATXN1; (-) strand; PAM type: NRG; PAM sequence: CAG
aagttatttaggaaggattg

SEQ ID NO: 69932 - DNA, 20 bp, Artificial Sequence
  Description of Artificial Sequence: Synthetic oligonucleotide
  Target: ATXN1; (-) strand; PAM type: NRG; PAM sequence: AGG
cccccaaaagttatttagga

SEQ ID NO: 69933 - DNA, 20 bp, Artificial Sequence
  Description of Artificial Sequence: Synthetic oligonucleotide
  Target: ATXN1; (-) strand; PAM type: NRG; PAM sequence: AAG
gcccccaaaagttatttagg

SEQ ID NO: 69934 - DNA, 20 bp, Artificial Sequence
  Description of Artificial Sequence: Synthetic oligonucleotide
  Target: ATXN1; (-) strand; PAM type: NRG; PAM sequence: AGG
taagcccccaaaagttattt

SEQ ID NO: 69935 - DNA, 20 bp, Artificial Sequence
  Description of Artificial Sequence: Synthetic oligonucleotide
  Target: ATXN1; (-) strand; PAM type: NRG; PAM sequence: TAG
ttaagcccccaaaagttatt

SEQ ID NO: 69936 - DNA, 20 bp, Artificial Sequence
  Description of Artificial Sequence: Synthetic oligonucleotide
  Target: ATXN1; (-) strand; PAM type: NRG; PAM sequence: AAG
ccaggattttaagcccccaa

SEQ ID NO: 69937 - DNA, 20 bp, Artificial Sequence
  Description of Artificial Sequence: Synthetic oligonucleotide
  Target: ATXN1; (-) strand; PAM type: NRG; PAM sequence: AAG
gtagctacacccaggatttt

SEQ ID NO: 69938 - DNA, 20 bp, Artificial Sequence
  Description of Artificial Sequence: Synthetic oligonucleotide
  Target: ATXN1; (-) strand; PAM type: NRG; PAM sequence: AGG
acatgattgtagctacaccc

SEQ ID NO: 69939 - DNA, 20 bp, Artificial Sequence
  Description of Artificial Sequence: Synthetic oligonucleotide
  Target: ATXN1; (-) strand; PAM type: NRG; PAM sequence: CAG
cacatgattgtagctacacc

SEQ ID NO: 69940 - DNA, 20 bp, Artificial Sequence
  Description of Artificial Sequence: Synthetic oligonucleotide
  Target: ATXN1; (-) strand; PAM type: NRG; PAM sequence: TAG
gggggagtttcacatgattg

SEQ ID NO: 69941 - DNA, 20 bp, Artificial Sequence
  Description of Artificial Sequence: Synthetic oligonucleotide
  Target: ATXN1; (-) strand; PAM type: NRG; PAM sequence: GAG
cctctagctgtcattagggg

SEQ ID NO: 69942 - DNA, 20 bp, Artificial Sequence
  Description of Artificial Sequence: Synthetic oligonucleotide
  Target: ATXN1; (-) strand; PAM type: NRG; PAM sequence: GGG
atcctctagctgtcattagg

SEQ ID NO: 69943 - DNA, 20 bp, Artificial Sequence
  Description of Artificial Sequence: Synthetic oligonucleotide
  Target: ATXN1; (-) strand; PAM type: NRG; PAM sequence: GGG
aatcctctagctgtcattag

SEQ ID NO: 69944 - DNA, 20 bp, Artificial Sequence
  Description of Artificial Sequence: Synthetic oligonucleotide
  Target: ATXN1; (-) strand; PAM type: NRG; PAM sequence: GGG
aaatcctctagctgtcatta

SEQ ID NO: 69945 - DNA, 20 bp, Artificial Sequence
  Description of Artificial Sequence: Synthetic oligonucleotide
  Target: ATXN1; (-) strand; PAM type: NRG; PAM sequence: AGG
caaatcctctagctgtcatt

SEQ ID NO: 69946 - DNA, 20 bp, Artificial Sequence
  Description of Artificial Sequence: Synthetic oligonucleotide
  Target: ATXN1; (-) strand; PAM type: NRG; PAM sequence: TAG
ccaaatcctctagctgtcat

SEQ ID NO: 69947 - DNA, 20 bp, Artificial Sequence
  Description of Artificial Sequence: Synthetic oligonucleotide
  Target: ATXN1; (-) strand; PAM type: NRG; PAM sequence: TAG
gaatacacacccaaatcctc

SEQ ID NO: 69948 - DNA, 20 bp, Artificial Sequence
  Description of Artificial Sequence: Synthetic oligonucleotide
  Target: ATXN1; (-) strand; PAM type: NRG; PAM sequence: GAG
gatgtagggtcatagactca

SEQ ID NO: 69949 - DNA, 20 bp, Artificial Sequence
  Description of Artificial Sequence: Synthetic oligonucleotide
  Target: ATXN1; (-) strand; PAM type: NRG; PAM sequence: CAG
cagatgtagggtcatagact

SEQ ID NO: 69950 - DNA, 20 bp, Artificial Sequence
  Description of Artificial Sequence: Synthetic oligonucleotide
  Target: ATXN1; (-) strand; PAM type: NRG; PAM sequence: TAG
gcatcccagatgtagggtca

SEQ ID NO: 69951 - DNA, 20 bp, Artificial Sequence
  Description of Artificial Sequence: Synthetic oligonucleotide
  Target: ATXN1; (-) strand; PAM type: NRG; PAM sequence: GGG
cccacagcatcccagatgta

SEQ ID NO: 69952 - DNA, 20 bp, Artificial Sequence
  Description of Artificial Sequence: Synthetic oligonucleotide
  Target: ATXN1; (-) strand; PAM type: NRG; PAM sequence: AGG
ccccacagcatcccagatgt

SEQ ID NO: 69953 - DNA, 20 bp, Artificial Sequence
  Description of Artificial Sequence: Synthetic oligonucleotide
  Target: ATXN1; (-) strand; PAM type: NRG; PAM sequence: TAG
accccacagcatcccagatg

SEQ ID NO: 69954 - DNA, 20 bp, Artificial Sequence
  Description of Artificial Sequence: Synthetic oligonucleotide
  Target: ATXN1; (-) strand; PAM type: NRG; PAM sequence: CAG
gcaagcaccccacagcatcc

SEQ ID NO: 69955 - DNA, 20 bp, Artificial Sequence
  Description of Artificial Sequence: Synthetic oligonucleotide
  Target: ATXN1; (-) strand; PAM type: NRG; PAM sequence: CAG
tataggttgcaagcacccca

SEQ ID NO: 69956 - DNA, 20 bp, Artificial Sequence
  Description of Artificial Sequence: Synthetic oligonucleotide
  Target: ATXN1; (-) strand; PAM type: NRG; PAM sequence: AAG
acctgctgtctataggttgc

SEQ ID NO: 69957 - DNA, 20 bp, Artificial Sequence
  Description of Artificial Sequence: Synthetic oligonucleotide
  Target: ATXN1; (-) strand; PAM type: NRG; PAM sequence: AGG
ggaaaacacctgctgtctat

SEQ ID NO: 69958 - DNA, 20 bp, Artificial Sequence
  Description of Artificial Sequence: Synthetic oligonucleotide
  Target: ATXN1; (-) strand; PAM type: NRG; PAM sequence: TAG
tggaaaacacctgctgtcta

SEQ ID NO: 69959 - DNA, 20 bp, Artificial Sequence
  Description of Artificial Sequence: Synthetic oligonucleotide
  Target: ATXN1; (-) strand; PAM type: NRG; PAM sequence: TGG
ccataacacgccaacgcgcc

SEQ ID NO: 69960 - DNA, 20 bp, Artificial Sequence
  Description of Artificial Sequence: Synthetic oligonucleotide
  Target: ATXN1; (-) strand; PAM type: NRG; PAM sequence: CAG
gttcatcctcacttgaatcc

SEQ ID NO: 69961 - DNA, 20 bp, Artificial Sequence
  Description of Artificial Sequence: Synthetic oligonucleotide
  Target: ATXN1; (-) strand; PAM type: NRG; PAM sequence: TAG
gctcactccagctctcatct

SEQ ID NO: 69962 - DNA, 20 bp, Artificial Sequence
  Description of Artificial Sequence: Synthetic oligonucleotide
  Target: ATXN1; (-) strand; PAM type: NRG; PAM sequence: CAG
ttacaaatcgtggctcactc

SEQ ID NO: 69963 - DNA, 20 bp, Artificial Sequence
  Description of Artificial Sequence: Synthetic oligonucleotide
  Target: ATXN1; (-) strand; PAM type: NRG; PAM sequence: TGG
atctgcatggttacaaatcg

SEQ ID NO: 69964 - DNA, 20 bp, Artificial Sequence
  Description of Artificial Sequence: Synthetic oligonucleotide
  Target: ATXN1; (-) strand; PAM type: NRG; PAM sequence: TGG
cgctgctgctcacatctgca

SEQ ID NO: 69965 - DNA, 20 bp, Artificial Sequence
  Description of Artificial Sequence: Synthetic oligonucleotide
  Target: ATXN1; (-) strand; PAM type: NRG; PAM sequence: TGG
ggcaaggaggaaagcctgca

SEQ ID NO: 69966 - DNA, 20 bp, Artificial Sequence
  Description of Artificial Sequence: Synthetic oligonucleotide
  Target: ATXN1; (-) strand; PAM type: NRG; PAM sequence: AAG
caagctgcaggcaaggagga

SEQ ID NO: 69967 - DNA, 20 bp, Artificial Sequence
  Description of Artificial Sequence: Synthetic oligonucleotide
  Target: ATXN1; (-) strand; PAM type: NRG; PAM sequence: AGG
gatgcaagctgcaggcaagg

SEQ ID NO: 69968 - DNA, 20 bp, Artificial Sequence
  Description of Artificial Sequence: Synthetic oligonucleotide
  Target: ATXN1; (-) strand; PAM type: NRG; PAM sequence: GAG
agatgcaagctgcaggcaag

SEQ ID NO: 69969 - DNA, 20 bp, Artificial Sequence
  Description of Artificial Sequence: Synthetic oligonucleotide
  Target: ATXN1; (-) strand; PAM type: NRG; PAM sequence: AGG
tcagatgcaagctgcaggca

SEQ ID NO: 69970 - DNA, 20 bp, Artificial Sequence
  Description of Artificial Sequence: Synthetic oligonucleotide
  Target: ATXN1; (-) strand; PAM type: NRG; PAM sequence: AAG
ctcagatgcaagctgcaggc

SEQ ID NO: 69971 - DNA, 20 bp, Artificial Sequence
  Description of Artificial Sequence: Synthetic oligonucleotide
  Target: ATXN1; (-) strand; PAM type: NRG; PAM sequence: AGG
ggatctcagatgcaagctgc

SEQ ID NO: 69972 - DNA, 20 bp, Artificial Sequence
  Description of Artificial Sequence: Synthetic oligonucleotide
  Target: ATXN1; (-) strand; PAM type: NRG; PAM sequence: CAG
aggatctcagatgcaagctg

SEQ ID NO: 69973 - DNA, 20 bp, Artificial Sequence
  Description of Artificial Sequence: Synthetic oligonucleotide
  Target: ATXN1; (-) strand; PAM type: NRG; PAM sequence: AAG
cttattaggatctcagatgc

SEQ ID NO: 69974 - DNA, 20 bp, Artificial Sequence
  Description of Artificial Sequence: Synthetic oligonucleotide
  Target: ATXN1; (-) strand; PAM type: NRG; PAM sequence: CAG
atcctcccttattaggatct

SEQ ID NO: 69975 - DNA, 20 bp, Artificial Sequence
  Description of Artificial Sequence: Synthetic oligonucleotide
  Target: ATXN1; (-) strand; PAM type: NRG; PAM sequence: AGG
tccagtgatcctcccttatt

SEQ ID NO: 69976 - DNA, 20 bp, Artificial Sequence
  Description of Artificial Sequence: Synthetic oligonucleotide
  Target: ATXN1; (-) strand; PAM type: NRG; PAM sequence: TAG
ttccagtgatcctcccttat

SEQ ID NO: 69977 - DNA, 20 bp, Artificial Sequence
  Description of Artificial Sequence: Synthetic oligonucleotide
  Target: ATXN1; (-) strand; PAM type: NRG; PAM sequence: CAG
aaaataatggtaatactttc

SEQ ID NO: 69978 - DNA, 20 bp, Artificial Sequence
  Description of Artificial Sequence: Synthetic oligonucleotide
  Target: ATXN1; (-) strand; PAM type: NRG; PAM sequence: TGG
cttagaaaagctaaaaataa

SEQ ID NO: 69979 - DNA, 20 bp, Artificial Sequence
  Description of Artificial Sequence: Synthetic oligonucleotide
  Target: ATXN1; (-) strand; PAM type: NRG; PAM sequence: AAG
aactcctccctcccttagaa

SEQ ID NO: 69980 - DNA, 20 bp, Artificial Sequence
  Description of Artificial Sequence: Synthetic oligonucleotide
  Target: ATXN1; (-) strand; PAM type: NRG; PAM sequence: TAG
tcgaaaactcctccctccct

SEQ ID NO: 69981 - DNA, 20 bp, Artificial Sequence
  Description of Artificial Sequence: Synthetic oligonucleotide
  Target: ATXN1; (-) strand; PAM type: NRG; PAM sequence: AAG
aagctgcttatctgtcctga

SEQ ID NO: 69982 - DNA, 20 bp, Artificial Sequence
  Description of Artificial Sequence: Synthetic oligonucleotide
  Target: ATXN1; (-) strand; PAM type: NRG; PAM sequence: AAG
tctattaaggaaggagaagg

SEQ ID NO: 69983 - DNA, 20 bp, Artificial Sequence
  Description of Artificial Sequence: Synthetic oligonucleotide
  Target: ATXN1; (-) strand; PAM type: NRG; PAM sequence: AGG
tcatctattaaggaaggaga

SEQ ID NO: 69984 - DNA, 20 bp, Artificial Sequence
  Description of Artificial Sequence: Synthetic oligonucleotide
  Target: ATXN1; (-) strand; PAM type: NRG; PAM sequence: AAG
atcatctattaaggaaggag

SEQ ID NO: 69985 - DNA, 20 bp, Artificial Sequence
  Description of Artificial Sequence: Synthetic oligonucleotide
  Target: ATXN1; (-) strand; PAM type: NRG; PAM sequence: GAG
gtgatcatctattaaggaag

SEQ ID NO: 69986 - DNA, 20 bp, Artificial Sequence
  Description of Artificial Sequence: Synthetic oligonucleotide
  Target: ATXN1; (-) strand; PAM type: NRG; PAM sequence: AGG
ctgtgatcatctattaagga

SEQ ID NO: 69987 - DNA, 20 bp, Artificial Sequence
  Description of Artificial Sequence: Synthetic oligonucleotide
  Target: ATXN1; (-) strand; PAM type: NRG; PAM sequence: AAG
gctgtgatcatctattaagg

SEQ ID NO: 69988 - DNA, 20 bp, Artificial Sequence
  Description of Artificial Sequence: Synthetic oligonucleotide
  Target: ATXN1; (-) strand; PAM type: NRG; PAM sequence: AGG
ctggctgtgatcatctatta

SEQ ID NO: 69989 - DNA, 20 bp, Artificial Sequence
  Description of Artificial Sequence: Synthetic oligonucleotide
  Target: ATXN1; (-) strand; PAM type: NRG; PAM sequence: AAG
cctggctgtgatcatctatt

SEQ ID NO: 69990 - DNA, 20 bp, Artificial Sequence
  Description of Artificial Sequence: Synthetic oligonucleotide
  Target: ATXN1; (-) strand; PAM type: NRG; PAM sequence: TGG
gttttataaccctggaagcc

SEQ ID NO: 69991 - DNA, 20 bp, Artificial Sequence
  Description of Artificial Sequence: Synthetic oligonucleotide
  Target: ATXN1; (-) strand; PAM type: NRG; PAM sequence: AAG
gtgttgttttataaccctgg

SEQ ID NO: 69992 - DNA, 20 bp, Artificial Sequence
  Description of Artificial Sequence: Synthetic oligonucleotide
  Target: ATXN1; (-) strand; PAM type: NRG; PAM sequence: TGG
ttggtgttgttttataaccc

SEQ ID NO: 69993 - DNA, 20 bp, Artificial Sequence
  Description of Artificial Sequence: Synthetic oligonucleotide
  Target: ATXN1; (-) strand; PAM type: NRG; PAM sequence: TGG
atacctggacctgaagacct

SEQ ID NO: 69994 - DNA, 20 bp, Artificial Sequence
  Description of Artificial Sequence: Synthetic oligonucleotide
  Target: ATXN1; (-) strand; PAM type: NRG; PAM sequence: AAG
tctctacatacctggacctg

SEQ ID NO: 69995 - DNA, 20 bp, Artificial Sequence
  Description of Artificial Sequence: Synthetic oligonucleotide
  Target: ATXN1; (-) strand; PAM type: NRG; PAM sequence: TGG
ctcctttgtctctacatacc

SEQ ID NO: 69996 - DNA, 20 bp, Artificial Sequence
  Description of Artificial Sequence: Synthetic oligonucleotide
  Target: ATXN1; (-) strand; PAM type: NRG; PAM sequence: AAG
agaaaaatggtttccttgcg

SEQ ID NO: 69997 - DNA, 20 bp, Artificial Sequence
  Description of Artificial Sequence: Synthetic oligonucleotide
  Target: ATXN1; (-) strand; PAM type: NRG; PAM sequence: TGG
ttgccatgctcttagaaaaa

SEQ ID NO: 69998 - DNA, 20 bp, Artificial Sequence
  Description of Artificial Sequence: Synthetic oligonucleotide
  Target: ATXN1; (-) strand; PAM type: NRG; PAM sequence: TAG
atgcgtatttgccatgctct

SEQ ID NO: 69999 - DNA, 20 bp, Artificial Sequence
  Description of Artificial Sequence: Synthetic oligonucleotide
  Target: ATXN1; (-) strand; PAM type: NRG; PAM sequence: TGG
tgaaaaaaaatcccacaaca

SEQ ID NO: 70000 - DNA, 20 bp, Artificial Sequence
  Description of Artificial Sequence: Synthetic oligonucleotide
  Target: ATXN1; (-) strand; PAM type: NRG; PAM sequence: AAG
cagctatgtttcaagaaagg

SEQ ID NO: 70001 - DNA, 20 bp, Artificial Sequence
  Description of Artificial Sequence: Synthetic oligonucleotide
  Target: ATXN1; (-) strand; PAM type: NRG; PAM sequence: AGG
catcagctatgtttcaagaa

SEQ ID NO: 70002 - DNA, 20 bp, Artificial Sequence
  Description of Artificial Sequence: Synthetic oligonucleotide
  Target: ATXN1; (-) strand; PAM type: NRG; PAM sequence: AAG
tcatcagctatgtttcaaga

SEQ ID NO: 70003 - DNA, 20 bp, Artificial Sequence
  Description of Artificial Sequence: Synthetic oligonucleotide
  Target: ATXN1; (-) strand; PAM type: NRG; PAM sequence: AAG
ggcctcatcagctatgtttc

SEQ ID NO: 70004 - DNA, 20 bp, Artificial Sequence
  Description of Artificial Sequence: Synthetic oligonucleotide
  Target: ATXN1; (-) strand; PAM type: NRG; PAM sequence: CAG
gcttctattagtggcctcat

SEQ ID NO: 70005 - DNA, 20 bp, Artificial Sequence
  Description of Artificial Sequence: Synthetic oligonucleotide
  Target: ATXN1; (-) strand; PAM type: NRG; PAM sequence: TGG
ttccaagaagcttctattag

SEQ ID NO: 70006 - DNA, 20 bp, Artificial Sequence
  Description of Artificial Sequence: Synthetic oligonucleotide
  Target: ATXN1; (-) strand; PAM type: NRG; PAM sequence: TAG
cttttccaagaagcttctat

SEQ ID NO: 70007 - DNA, 20 bp, Artificial Sequence
  Description of Artificial Sequence: Synthetic oligonucleotide
  Target: ATXN1; (-) strand; PAM type: NRG; PAM sequence: AAG
ttatgaaactcttttccaag

SEQ ID NO: 70008 - DNA, 20 bp, Artificial Sequence
  Description of Artificial Sequence: Synthetic oligonucleotide
  Target: ATXN1; (-) strand; PAM type: NRG; PAM sequence: AAG
gaattatgaaactcttttcc

SEQ ID NO: 70009 - DNA, 20 bp, Artificial Sequence
  Description of Artificial Sequence: Synthetic oligonucleotide
  Target: ATXN1; (-) strand; PAM type: NRG; PAM sequence: AAG
ggggggtaataagaaagtta

SEQ ID NO: 70010 - DNA, 20 bp, Artificial Sequence
  Description of Artificial Sequence: Synthetic oligonucleotide
  Target: ATXN1; (-) strand; PAM type: NRG; PAM sequence: AAG
cattttggggggtaataaga

SEQ ID NO: 70011 - DNA, 20 bp, Artificial Sequence
  Description of Artificial Sequence: Synthetic oligonucleotide
  Target: ATXN1; (-) strand; PAM type: NRG; PAM sequence: AAG
aggacattttggggggtaat

SEQ ID NO: 70012 - DNA, 20 bp, Artificial Sequence
  Description of Artificial Sequence: Synthetic oligonucleotide
  Target: ATXN1; (-) strand; PAM type: NRG; PAM sequence: GGG
accaaagaggacattttggg

SEQ ID NO: 70013 - DNA, 20 bp, Artificial Sequence
  Description of Artificial Sequence: Synthetic oligonucleotide
  Target: ATXN1; (-) strand; PAM type: NRG; PAM sequence: GGG
gaccaaagaggacattttgg

SEQ ID NO: 70014 - DNA, 20 bp, Artificial Sequence
  Description of Artificial Sequence: Synthetic oligonucleotide
  Target: ATXN1; (-) strand; PAM type: NRG; PAM sequence: GGG
agaccaaagaggacattttg

SEQ ID NO: 70015 - DNA, 20 bp, Artificial Sequence
  Description of Artificial Sequence: Synthetic oligonucleotide
  Target: ATXN1; (-) strand; PAM type: NRG; PAM sequence: GGG
aagaccaaagaggacatttt

SEQ ID NO: 70016 - DNA, 20 bp, Artificial Sequence
  Description of Artificial Sequence: Synthetic oligonucleotide
  Target: ATXN1; (-) strand; PAM type: NRG; PAM sequence: TGG
taagaccaaagaggacattt

SEQ ID NO: 70017 - DNA, 20 bp, Artificial Sequence
  Description of Artificial Sequence: Synthetic oligonucleotide
  Target: ATXN1; (-) strand; PAM type: NRG; PAM sequence: AGG
tgatcgctgtaagaccaaag

SEQ ID NO: 70018 - DNA, 20 bp, Artificial Sequence
  Description of Artificial Sequence: Synthetic oligonucleotide
  Target: ATXN1; (-) strand; PAM type: NRG; PAM sequence: GAG
atgatcgctgtaagaccaaa

SEQ ID NO: 70019 - DNA, 20 bp, Artificial Sequence
  Description of Artificial Sequence: Synthetic oligonucleotide
  Target: ATXN1; (-) strand; PAM type: NRG; PAM sequence: AAG
tcatgatcgctgtaagacca

SEQ ID NO: 70020 - DNA, 20 bp, Artificial Sequence
  Description of Artificial Sequence: Synthetic oligonucleotide
  Target: ATXN1; (-) strand; PAM type: NRG; PAM sequence: AAG
ggaacattcatgatcgctgt

SEQ ID NO: 70021 - DNA, 20 bp, Artificial Sequence
  Description of Artificial Sequence: Synthetic oligonucleotide
  Target: ATXN1; (-) strand; PAM type: NRG; PAM sequence: TGG
tcattcatctcctattaatc

SEQ ID NO: 70022 - DNA, 20 bp, Artificial Sequence
  Description of Artificial Sequence: Synthetic oligonucleotide
  Target: ATXN1; (-) strand; PAM type: NRG; PAM sequence: GAG
acatattaaggtcatttaag

SEQ ID NO: 70023 - DNA, 20 bp, Artificial Sequence
  Description of Artificial Sequence: Synthetic oligonucleotide
  Target: ATXN1; (-) strand; PAM type: NRG; PAM sequence: AGG
gaacatattaaggtcattta

SEQ ID NO: 70024 - DNA, 20 bp, Artificial Sequence
  Description of Artificial Sequence: Synthetic oligonucleotide
  Target: ATXN1; (-) strand; PAM type: NRG; PAM sequence: AAG
tgaacatattaaggtcattt

SEQ ID NO: 70025 - DNA, 20 bp, Artificial Sequence
  Description of Artificial Sequence: Synthetic oligonucleotide
  Target: ATXN1; (-) strand; PAM type: NRG; PAM sequence: AGG
tttgctacttgaacatatta

SEQ ID NO: 70026 - DNA, 20 bp, Artificial Sequence
  Description of Artificial Sequence: Synthetic oligonucleotide
  Target: ATXN1; (-) strand; PAM type: NRG; PAM sequence: AAG
ctttgctacttgaacatatt

SEQ ID NO: 70027 - DNA, 20 bp, Artificial Sequence
  Description of Artificial Sequence: Synthetic oligonucleotide
  Target: ATXN1; (-) strand; PAM type: NRG; PAM sequence: TGG
actgtctccccagaagtcac

SEQ ID NO: 70028 - DNA, 20 bp, Artificial Sequence
  Description of Artificial Sequence: Synthetic oligonucleotide
  Target: ATXN1; (-) strand; PAM type: NRG; PAM sequence: AAG
ccatacaactgtctccccag

SEQ ID NO: 70029 - DNA, 20 bp, Artificial Sequence
  Description of Artificial Sequence: Synthetic oligonucleotide
  Target: ATXN1; (-) strand; PAM type: NRG; PAM sequence: CAG
agcccatacaactgtctccc

SEQ ID NO: 70030 - DNA, 20 bp, Artificial Sequence
  Description of Artificial Sequence: Synthetic oligonucleotide
  Target: ATXN1; (-) strand; PAM type: NRG; PAM sequence: TAG
ctcaaaatgttatgtgttct

SEQ ID NO: 70031 - DNA, 20 bp, Artificial Sequence
  Description of Artificial Sequence: Synthetic oligonucleotide
  Target: ATXN1; (-) strand; PAM type: NRG; PAM sequence: AAG
ttgccaaaaaaaaaaaagac

SEQ ID NO: 70032 - DNA, 20 bp, Artificial Sequence
  Description of Artificial Sequence: Synthetic oligonucleotide
  Target: ATXN1; (-) strand; PAM type: NRG; PAM sequence: AAG
ttctattgccaaaaaaaaaa

SEQ ID NO: 70033 - DNA, 20 bp, Artificial Sequence
  Description of Artificial Sequence: Synthetic oligonucleotide
  Target: ATXN1; (-) strand; PAM type: NRG; PAM sequence: AGG
tgctgtggccttttcagctc

SEQ ID NO: 70034 - DNA, 20 bp, Artificial Sequence
  Description of Artificial Sequence: Synthetic oligonucleotide
  Target: ATXN1; (-) strand; PAM type: NRG; PAM sequence: CAG
atgctgtggccttttcagct

SEQ ID NO: 70035 - DNA, 20 bp, Artificial Sequence
  Description of Artificial Sequence: Synthetic oligonucleotide
  Target: ATXN1; (-) strand; PAM type: NRG; PAM sequence: CAG
aatacatgctgtggcctttt

SEQ ID NO: 70036 - DNA, 20 bp, Artificial Sequence
  Description of Artificial Sequence: Synthetic oligonucleotide
  Target: ATXN1; (-) strand; PAM type: NRG; PAM sequence: TGG
gaattgaagaatacatgctg

SEQ ID NO: 70037 - DNA, 20 bp, Artificial Sequence
  Description of Artificial Sequence: Synthetic oligonucleotide
  Target: ATXN1; (-) strand; PAM type: NRG; PAM sequence: AAG
attaccaggaccctgaattg

SEQ ID NO: 70038 - DNA, 20 bp, Artificial Sequence
  Description of Artificial Sequence: Synthetic oligonucleotide
  Target: ATXN1; (-) strand; PAM type: NRG; PAM sequence: AGG
ttgtggttccagtgattacc

SEQ ID NO: 70039 - DNA, 20 bp, Artificial Sequence
  Description of Artificial Sequence: Synthetic oligonucleotide
  Target: ATXN1; (-) strand; PAM type: NRG; PAM sequence: CAG
cttgtggttccagtgattac

SEQ ID NO: 70040 - DNA, 20 bp, Artificial Sequence
  Description of Artificial Sequence: Synthetic oligonucleotide
  Target: ATXN1; (-) strand; PAM type: NRG; PAM sequence: CAG
ggcatttgaacttgtggttc

SEQ ID NO: 70041 - DNA, 20 bp, Artificial Sequence
  Description of Artificial Sequence: Synthetic oligonucleotide
  Target: ATXN1; (-) strand; PAM type: NRG; PAM sequence: TGG
ctagatggcatttgaacttg

SEQ ID NO: 70042 - DNA, 20 bp, Artificial Sequence
  Description of Artificial Sequence: Synthetic oligonucleotide
  Target: ATXN1; (-) strand; PAM type: NRG; PAM sequence: TGG
aagagtccttatggtctaga

SEQ ID NO: 70043 - DNA, 20 bp, Artificial Sequence
  Description of Artificial Sequence: Synthetic oligonucleotide
  Target: ATXN1; (-) strand; PAM type: NRG; PAM sequence: TAG
ttataagagtccttatggtc

SEQ ID NO: 70044 - DNA, 20 bp, Artificial Sequence
  Description of Artificial Sequence: Synthetic oligonucleotide
  Target: ATXN1; (-) strand; PAM type: NRG; PAM sequence: TGG
gtgttttataagagtcctta

SEQ ID NO: 70045 - DNA, 20 bp, Artificial Sequence
  Description of Artificial Sequence: Synthetic oligonucleotide
  Target: ATXN1; (-) strand; PAM type: NRG; PAM sequence: GAG
aagtggtttgtgttttataa

SEQ ID NO: 70046 - DNA, 20 bp, Artificial Sequence
  Description of Artificial Sequence: Synthetic oligonucleotide
  Target: ATXN1; (-) strand; PAM type: NRG; PAM sequence: AAG
tgaagtggtttgtgttttat

SEQ ID NO: 70047 - DNA, 20 bp, Artificial Sequence
  Description of Artificial Sequence: Synthetic oligonucleotide
  Target: ATXN1; (-) strand; PAM type: NRG; PAM sequence: TGG
taggtttgttgatgatgaag

SEQ ID NO: 70048 - DNA, 20 bp, Artificial Sequence
  Description of Artificial Sequence: Synthetic oligonucleotide
  Target: ATXN1; (-) strand; PAM type: NRG; PAM sequence: AAG
aaataggtttgttgatgatg

SEQ ID NO: 70049 - DNA, 20 bp, Artificial Sequence
  Description of Artificial Sequence: Synthetic oligonucleotide
  Target: ATXN1; (-) strand; PAM type: NRG; PAM sequence: AGG
aaaagttctagtaggcaaat

SEQ ID NO: 70050 - DNA, 20 bp, Artificial Sequence
  Description of Artificial Sequence: Synthetic oligonucleotide
  Target: ATXN1; (-) strand; PAM type: NRG; PAM sequence: TAG
taaaagttctagtaggcaaa

SEQ ID NO: 70051 - DNA, 20 bp, Artificial Sequence
  Description of Artificial Sequence: Synthetic oligonucleotide
  Target: ATXN1; (-) strand; PAM type: NRG; PAM sequence: AGG
cttgctttaaaagttctagt

SEQ ID NO: 70052 - DNA, 20 bp, Artificial Sequence
  Description of Artificial Sequence: Synthetic oligonucleotide
  Target: ATXN1; (-) strand; PAM type: NRG; PAM sequence: TAG
ccttgctttaaaagttctag

SEQ ID NO: 70053 - DNA, 20 bp, Artificial Sequence
  Description of Artificial Sequence: Synthetic oligonucleotide
  Target: ATXN1; (-) strand; PAM type: NRG; PAM sequence: TAG
cagccttgctttaaaagttc

SEQ ID NO: 70054 - DNA, 20 bp, Artificial Sequence
  Description of Artificial Sequence: Synthetic oligonucleotide
  Target: ATXN1; (-) strand; PAM type: NRG; PAM sequence: AAG
agtttgcagccttgctttaa

SEQ ID NO: 70055 - DNA, 20 bp, Artificial Sequence
  Description of Artificial Sequence: Synthetic oligonucleotide
  Target: ATXN1; (-) strand; PAM type: NRG; PAM sequence: CAG
ttgtttacttgaatagtttg

SEQ ID NO: 70056 - DNA, 20 bp, Artificial Sequence
  Description of Artificial Sequence: Synthetic oligonucleotide
  Target: ATXN1; (-) strand; PAM type: NRG; PAM sequence: TAG
cacaaggttgtttacttgaa

SEQ ID NO: 70057 - DNA, 20 bp, Artificial Sequence
  Description of Artificial Sequence: Synthetic oligonucleotide
  Target: ATXN1; (-) strand; PAM type: NRG; PAM sequence: AGG
tccatgtcaaccaccccaca

SEQ ID NO: 70058 - DNA, 20 bp, Artificial Sequence
  Description of Artificial Sequence: Synthetic oligonucleotide
  Target: ATXN1; (-) strand; PAM type: NRG; PAM sequence: AAG
gtccatgtcaaccaccccac

SEQ ID NO: 70059 - DNA, 20 bp, Artificial Sequence
  Description of Artificial Sequence: Synthetic oligonucleotide
  Target: ATXN1; (-) strand; PAM type: NRG; PAM sequence: CGG
agtgttctcttgttagctct

SEQ ID NO: 70060 - DNA, 20 bp, Artificial Sequence
  Description of Artificial Sequence: Synthetic oligonucleotide
  Target: ATXN1; (-) strand; PAM type: NRG; PAM sequence: TAG
taattccagtgttctcttgt

SEQ ID NO: 70061 - DNA, 20 bp, Artificial Sequence
  Description of Artificial Sequence: Synthetic oligonucleotide
  Target: ATXN1; (-) strand; PAM type: NRG; PAM sequence: CAG
tgaaactgagaagctaattc

SEQ ID NO: 70062 - DNA, 20 bp, Artificial Sequence
  Description of Artificial Sequence: Synthetic oligonucleotide
  Target: ATXN1; (-) strand; PAM type: NRG; PAM sequence: AAG
ggtcctattttgaaactgag

SEQ ID NO: 70063 - DNA, 20 bp, Artificial Sequence
  Description of Artificial Sequence: Synthetic oligonucleotide
  Target: ATXN1; (-) strand; PAM type: NRG; PAM sequence: GAG
ttaggtcctattttgaaact

SEQ ID NO: 70064 - DNA, 20 bp, Artificial Sequence
  Description of Artificial Sequence: Synthetic oligonucleotide
  Target: ATXN1; (-) strand; PAM type: NRG; PAM sequence: AGG
cctatagcgcaaactccttt

SEQ ID NO: 70065 - DNA, 20 bp, Artificial Sequence
  Description of Artificial Sequence: Synthetic oligonucleotide
  Target: ATXN1; (-) strand; PAM type: NRG; PAM sequence: TAG
tcctatagcgcaaactcctt

SEQ ID NO: 70066 - DNA, 20 bp, Artificial Sequence
  Description of Artificial Sequence: Synthetic oligonucleotide
  Target: ATXN1; (-) strand; PAM type: NRG; PAM sequence: TAG
atgcagcaactcttctccta

SEQ ID NO: 70067 - DNA, 20 bp, Artificial Sequence
  Description of Artificial Sequence: Synthetic oligonucleotide
  Target: ATXN1; (-) strand; PAM type: NRG; PAM sequence: CAG
tagttccattaaacaaaatg

SEQ ID NO: 70068 - DNA, 20 bp, Artificial Sequence
  Description of Artificial Sequence: Synthetic oligonucleotide
  Target: ATXN1; (-) strand; PAM type: NRG; PAM sequence: TAG
gatttaaatgggcacaaatt

SEQ ID NO: 70069 - DNA, 20 bp, Artificial Sequence
  Description of Artificial Sequence: Synthetic oligonucleotide
  Target: ATXN1; (-) strand; PAM type: NRG; PAM sequence: GGG
cacctgctcatgatttaaat

SEQ ID NO: 70070 - DNA, 20 bp, Artificial Sequence
  Description of Artificial Sequence: Synthetic oligonucleotide
  Target: ATXN1; (-) strand; PAM type: NRG; PAM sequence: TGG
ccacctgctcatgatttaaa

SEQ ID NO: 70071 - DNA, 20 bp, Artificial Sequence
  Description of Artificial Sequence: Synthetic oligonucleotide
  Target: ATXN1; (-) strand; PAM type: NRG; PAM sequence: AAG
ttcaggctttctttgctacc

SEQ ID NO: 70072 - DNA, 20 bp, Artificial Sequence
  Description of Artificial Sequence: Synthetic oligonucleotide
  Target: ATXN1; (-) strand; PAM type: NRG; PAM sequence: AGG
cactaaatgtgaatattttc

SEQ ID NO: 70073 - DNA, 20 bp, Artificial Sequence
  Description of Artificial Sequence: Synthetic oligonucleotide
  Target: ATXN1; (-) strand; PAM type: NRG; PAM sequence: CAG
tcactaaatgtgaatatttt

SEQ ID NO: 70074 - DNA, 20 bp, Artificial Sequence
  Description of Artificial Sequence: Synthetic oligonucleotide
  Target: ATXN1; (-) strand; PAM type: NRG; PAM sequence: CAG
gagtactttaaaataaatct

SEQ ID NO: 70075 - DNA, 20 bp, Artificial Sequence
  Description of Artificial Sequence: Synthetic oligonucleotide
  Target: ATXN1; (-) strand; PAM type: NRG; PAM sequence: GAG
gaaaagagtacaaaagatta

SEQ ID NO: 70076 - DNA, 20 bp, Artificial Sequence
  Description of Artificial Sequence: Synthetic oligonucleotide
  Target: ATXN1; (-) strand; PAM type: NRG; PAM sequence: TAG
tagaaaagagtacaaaagat

SEQ ID NO: 70077 - DNA, 20 bp, Artificial Sequence
  Description of Artificial Sequence: Synthetic oligonucleotide
  Target: ATXN1; (-) strand; PAM type: NRG; PAM sequence: AAG
aattgtagaaaagagtacaa

SEQ ID NO: 70078 - DNA, 20 bp, Artificial Sequence
  Description of Artificial Sequence: Synthetic oligonucleotide
  Target: ATXN1; (-) strand; PAM type: NRG; PAM sequence: GAG
ccagtttgaattgtagaaaa

SEQ ID NO: 70079 - DNA, 20 bp, Artificial Sequence
  Description of Artificial Sequence: Synthetic oligonucleotide
  Target: ATXN1; (-) strand; PAM type: NRG; PAM sequence: AAG
caccagtttgaattgtagaa

SEQ ID NO: 70080 - DNA, 20 bp, Artificial Sequence
  Description of Artificial Sequence: Synthetic oligonucleotide
  Target: ATXN1; (-) strand; PAM type: NRG; PAM sequence: TAG
tttctcaccagtttgaattg

SEQ ID NO: 70081 - DNA, 20 bp, Artificial Sequence
  Description of Artificial Sequence: Synthetic oligonucleotide
  Target: ATXN1; (-) strand; PAM type: NRG; PAM sequence: CAG
agctgctctctatttctcac

SEQ ID NO: 70082 - DNA, 20 bp, Artificial Sequence
  Description of Artificial Sequence: Synthetic oligonucleotide
  Target: ATXN1; (-) strand; PAM type: NRG; PAM sequence: AAG
tgctttcataataaattcaa

SEQ ID NO: 70083 - DNA, 20 bp, Artificial Sequence
  Description of Artificial Sequence: Synthetic oligonucleotide
  Target: ATXN1; (-) strand; PAM type: NRG; PAM sequence: TAG
tttcttaacagctaatacga

SEQ ID NO: 70084 - DNA, 20 bp, Artificial Sequence
  Description of Artificial Sequence: Synthetic oligonucleotide
  Target: ATXN1; (-) strand; PAM type: NRG; PAM sequence: CAG
ccccattttttatttcttaa

SEQ ID NO: 70085 - DNA, 20 bp, Artificial Sequence
  Description of Artificial Sequence: Synthetic oligonucleotide
  Target: ATXN1; (-) strand; PAM type: NRG; PAM sequence: GAG
tcctaatgtacatattatta

SEQ ID NO: 70086 - DNA, 20 bp, Artificial Sequence
  Description of Artificial Sequence: Synthetic oligonucleotide
  Target: ATXN1; (-) strand; PAM type: NRG; PAM sequence: TAG
gttcctaatgtacatattat

SEQ ID NO: 70087 - DNA, 20 bp, Artificial Sequence
  Description of Artificial Sequence: Synthetic oligonucleotide
  Target: ATXN1; (-) strand; PAM type: NRG; PAM sequence: TGG
ggaaagaaagccctttgctt

SEQ ID NO: 70088 - DNA, 20 bp, Artificial Sequence
  Description of Artificial Sequence: Synthetic oligonucleotide
  Target: ATXN1; (-) strand; PAM type: NRG; PAM sequence: AAG
tcactactctgaaggaaaga

SEQ ID NO: 70089 - DNA, 20 bp, Artificial Sequence
  Description of Artificial Sequence: Synthetic oligonucleotide
  Target: ATXN1; (-) strand; PAM type: NRG; PAM sequence: AAG
agactcactactctgaagga

SEQ ID NO: 70090 - DNA, 20 bp, Artificial Sequence
  Description of Artificial Sequence: Synthetic oligonucleotide
  Target: ATXN1; (-) strand; PAM type: NRG; PAM sequence: AGG
cagcagactcactactctga

SEQ ID NO: 70091 - DNA, 20 bp, Artificial Sequence
  Description of Artificial Sequence: Synthetic oligonucleotide
  Target: ATXN1; (-) strand; PAM type: NRG; PAM sequence: AAG
gcagcagactcactactctg

SEQ ID NO: 70092 - DNA, 20 bp, Artificial Sequence
  Description of Artificial Sequence: Synthetic oligonucleotide
  Target: ATXN1; (-) strand; PAM type: NRG; PAM sequence: CAG
tcatttctcaggaacagcag

SEQ ID NO: 70093 - DNA, 20 bp, Artificial Sequence
  Description of Artificial Sequence: Synthetic oligonucleotide
  Target: ATXN1; (-) strand; PAM type: NRG; PAM sequence: CAG
cactcatttctcaggaacag

SEQ ID NO: 70094 - DNA, 20 bp, Artificial Sequence
  Description of Artificial Sequence: Synthetic oligonucleotide
  Target: ATXN1; (-) strand; PAM type: NRG; PAM sequence: CAG
gctcactcatttctcaggaa

SEQ ID NO: 70095 - DNA, 20 bp, Artificial Sequence
  Description of Artificial Sequence: Synthetic oligonucleotide
  Target: ATXN1; (-) strand; PAM type: NRG; PAM sequence: AGG
gtgcagctcactcatttctc

SEQ ID NO: 70096 - DNA, 20 bp, Artificial Sequence
  Description of Artificial Sequence: Synthetic oligonucleotide
  Target: ATXN1; (-) strand; PAM type: NRG; PAM sequence: CAG
tgtgcagctcactcatttct

SEQ ID NO: 70097 - DNA, 20 bp, Artificial Sequence
  Description of Artificial Sequence: Synthetic oligonucleotide
  Target: ATXN1; (-) strand; PAM type: NRG; PAM sequence: CAG
tcctactggctggtcctgtg

SEQ ID NO: 70098 - DNA, 20 bp, Artificial Sequence
  Description of Artificial Sequence: Synthetic oligonucleotide
  Target: ATXN1; (-) strand; PAM type: NRG; PAM sequence: TGG
cccatcgccctcctactggc

SEQ ID NO: 70099 - DNA, 20 bp, Artificial Sequence
  Description of Artificial Sequence: Synthetic oligonucleotide
  Target: ATXN1; (-) strand; PAM type: NRG; PAM sequence: TGG
tcttcccatcgccctcctac

SEQ ID NO: 70100 - DNA, 20 bp, Artificial Sequence
  Description of Artificial Sequence: Synthetic oligonucleotide
  Target: ATXN1; (-) strand; PAM type: NRG; PAM sequence: TGG
gtgagtctttggtacatgtt

SEQ ID NO: 70101 - DNA, 20 bp, Artificial Sequence
  Description of Artificial Sequence: Synthetic oligonucleotide
  Target: ATXN1; (-) strand; PAM type: NRG; PAM sequence: TGG
ggtgttctattgtgagtctt

SEQ ID NO: 70102 - DNA, 20 bp, Artificial Sequence
  Description of Artificial Sequence: Synthetic oligonucleotide
  Target: ATXN1; (-) strand; PAM type: NRG; PAM sequence: GAG
gatatttggtgttctattgt

SEQ ID NO: 70103 - DNA, 20 bp, Artificial Sequence
  Description of Artificial Sequence: Synthetic oligonucleotide
  Target: ATXN1; (-) strand; PAM type: NRG; PAM sequence: TGG
gatgctgagtaatggatatt

SEQ ID NO: 70104 - DNA, 20 bp, Artificial Sequence
  Description of Artificial Sequence: Synthetic oligonucleotide
  Target: ATXN1; (-) strand; PAM type: NRG; PAM sequence: TGG
tcactgttgatgctgagtaa

SEQ ID NO: 70105 - DNA, 20 bp, Artificial Sequence
  Description of Artificial Sequence: Synthetic oligonucleotide
  Target: ATXN1; (-) strand; PAM type: NRG; PAM sequence: GAG
ggtttgtcactgttgatgct

SEQ ID NO: 70106 - DNA, 20 bp, Artificial Sequence
  Description of Artificial Sequence: Synthetic oligonucleotide
  Target: ATXN1; (-) strand; PAM type: NRG; PAM sequence: TGG
cttgaagacacaatcagcca

SEQ ID NO: 70107 - DNA, 20 bp, Artificial Sequence
  Description of Artificial Sequence: Synthetic oligonucleotide
  Target: ATXN1; (-) strand; PAM type: NRG; PAM sequence: CAG
gatttgcttgaagacacaat

SEQ ID NO: 70108 - DNA, 20 bp, Artificial Sequence
  Description of Artificial Sequence: Synthetic oligonucleotide
  Target: ATXN1; (-) strand; PAM type: NRG; PAM sequence: AAG
acagttctgggatttgcttg

SEQ ID NO: 70109 - DNA, 20 bp, Artificial Sequence
  Description of Artificial Sequence: Synthetic oligonucleotide
  Target: ATXN1; (-) strand; PAM type: NRG; PAM sequence: GGG
agggatgaaattacagttct

SEQ ID NO: 70110 - DNA, 20 bp, Artificial Sequence
  Description of Artificial Sequence: Synthetic oligonucleotide
  Target: ATXN1; (-) strand; PAM type: NRG; PAM sequence: TGG
tagggatgaaattacagttc

SEQ ID NO: 70111 - DNA, 20 bp, Artificial Sequence
  Description of Artificial Sequence: Synthetic oligonucleotide
  Target: ATXN1; (-) strand; PAM type: NRG; PAM sequence: CAG
aatacttagggatgaaatta

SEQ ID NO: 70112 - DNA, 20 bp, Artificial Sequence
  Description of Artificial Sequence: Synthetic oligonucleotide
  Target: ATXN1; (-) strand; PAM type: NRG; PAM sequence: GGG
ggttcctaatgaaatactta

SEQ ID NO: 70113 - DNA, 20 bp, Artificial Sequence
  Description of Artificial Sequence: Synthetic oligonucleotide
  Target: ATXN1; (-) strand; PAM type: NRG; PAM sequence: AGG
tggttcctaatgaaatactt

SEQ ID NO: 70114 - DNA, 20 bp, Artificial Sequence
  Description of Artificial Sequence: Synthetic oligonucleotide
  Target: ATXN1; (-) strand; PAM type: NRG; PAM sequence: TAG
atggttcctaatgaaatact

SEQ ID NO: 70115 - DNA, 20 bp, Artificial Sequence
  Description of Artificial Sequence: Synthetic oligonucleotide
  Target: ATXN1; (-) strand; PAM type: NRG; PAM sequence: TGG
agggagcttaaaaaattcta

SEQ ID NO: 70116 - DNA, 20 bp, Artificial Sequence
  Description of Artificial Sequence: Synthetic oligonucleotide
  Target: ATXN1; (-) strand; PAM type: NRG; PAM sequence: GAG
aggacctcaggaaaatgagg

SEQ ID NO: 70117 - DNA, 20 bp, Artificial Sequence
  Description of Artificial Sequence: Synthetic oligonucleotide
  Target: ATXN1; (-) strand; PAM type: NRG; PAM sequence: GGG
tgaggacctcaggaaaatga

SEQ ID NO: 70118 - DNA, 20 bp, Artificial Sequence
  Description of Artificial Sequence: Synthetic oligonucleotide
  Target: ATXN1; (-) strand; PAM type: NRG; PAM sequence: AGG
ttgaggacctcaggaaaatg

SEQ ID NO: 70119 - DNA, 20 bp, Artificial Sequence
  Description of Artificial Sequence: Synthetic oligonucleotide
  Target: ATXN1; (-) strand; PAM type: NRG; PAM sequence: GAG
tttgaggacctcaggaaaat

SEQ ID NO: 70120 - DNA, 20 bp, Artificial Sequence
  Description of Artificial Sequence: Synthetic oligonucleotide
  Target: ATXN1; (-) strand; PAM type: NRG; PAM sequence: AGG
atttgacttttgaggacctc

SEQ ID NO: 70121 - DNA, 20 bp, Artificial Sequence
  Description of Artificial Sequence: Synthetic oligonucleotide
  Target: ATXN1; (-) strand; PAM type: NRG; PAM sequence: CAG
catttgacttttgaggacct

SEQ ID NO: 70122 - DNA, 20 bp, Artificial Sequence
  Description of Artificial Sequence: Synthetic oligonucleotide
  Target: ATXN1; (-) strand; PAM type: NRG; PAM sequence: AGG
cctgggtcatttgacttttg

SEQ ID NO: 70123 - DNA, 20 bp, Artificial Sequence
  Description of Artificial Sequence: Synthetic oligonucleotide
  Target: ATXN1; (-) strand; PAM type: NRG; PAM sequence: GAG
ccctgggtcatttgactttt

SEQ ID NO: 70124 - DNA, 20 bp, Artificial Sequence
  Description of Artificial Sequence: Synthetic oligonucleotide
  Target: ATXN1; (-) strand; PAM type: NRG; PAM sequence: GGG
cagttggacatgatggccct

SEQ ID NO: 70125 - DNA, 20 bp, Artificial Sequence
  Description of Artificial Sequence: Synthetic oligonucleotide
  Target: ATXN1; (-) strand; PAM type: NRG; PAM sequence: TGG
acagttggacatgatggccc

SEQ ID NO: 70126 - DNA, 20 bp, Artificial Sequence
  Description of Artificial Sequence: Synthetic oligonucleotide
  Target: ATXN1; (-) strand; PAM type: NRG; PAM sequence: TGG
ctcatcacagttggacatga

SEQ ID NO: 70127 - DNA, 20 bp, Artificial Sequence
  Description of Artificial Sequence: Synthetic oligonucleotide
  Target: ATXN1; (-) strand; PAM type: NRG; PAM sequence: TGG
cagccctgcctcatcacagt

SEQ ID NO: 70128 - DNA, 20 bp, Artificial Sequence
  Description of Artificial Sequence: Synthetic oligonucleotide
  Target: ATXN1; (-) strand; PAM type: NRG; PAM sequence: CAG
gctccagccctgcctcatca

SEQ ID NO: 70129 - DNA, 20 bp, Artificial Sequence
  Description of Artificial Sequence: Synthetic oligonucleotide
  Target: ATXN1; (-) strand; PAM type: NRG; PAM sequence: CAG
caggtgacaagactgggctc

SEQ ID NO: 70130 - DNA, 20 bp, Artificial Sequence
  Description of Artificial Sequence: Synthetic oligonucleotide
  Target: ATXN1; (-) strand; PAM type: NRG; PAM sequence: GGG
tggccccaggtgacaagact

SEQ ID NO: 70131 - DNA, 20 bp, Artificial Sequence
  Description of Artificial Sequence: Synthetic oligonucleotide
  Target: ATXN1; (-) strand; PAM type: NRG; PAM sequence: TGG
ctggccccaggtgacaagac

SEQ ID NO: 70132 - DNA, 20 bp, Artificial Sequence
  Description of Artificial Sequence: Synthetic oligonucleotide
  Target: ATXN1; (-) strand; PAM type: NRG; PAM sequence: AAG
cacacctggccccaggtgac

SEQ ID NO: 70133 - DNA, 20 bp, Artificial Sequence
  Description of Artificial Sequence: Synthetic oligonucleotide
  Target: ATXN1; (-) strand; PAM type: NRG; PAM sequence: AGG
aggagagcacacctggcccc

SEQ ID NO: 70134 - DNA, 20 bp, Artificial Sequence
  Description of Artificial Sequence: Synthetic oligonucleotide
  Target: ATXN1; (-) strand; PAM type: NRG; PAM sequence: CAG
aaggagagcacacctggccc

SEQ ID NO: 70135 - DNA, 20 bp, Artificial Sequence
  Description of Artificial Sequence: Synthetic oligonucleotide
  Target: ATXN1; (-) strand; PAM type: NRG; PAM sequence: TGG
ggcttgaaggagagcacacc

SEQ ID NO: 70136 - DNA, 20 bp, Artificial Sequence
  Description of Artificial Sequence: Synthetic oligonucleotide
  Target: ATXN1; (-) strand; PAM type: NRG; PAM sequence: GAG
tgggggtggggcttgaagga

SEQ ID NO: 70137 - DNA, 20 bp, Artificial Sequence
  Description of Artificial Sequence: Synthetic oligonucleotide
  Target: ATXN1; (-) strand; PAM type: NRG; PAM sequence: GAG
gttgggggtggggcttgaag

SEQ ID NO: 70138 - DNA, 20 bp, Artificial Sequence
  Description of Artificial Sequence: Synthetic oligonucleotide
  Target: ATXN1; (-) strand; PAM type: NRG; PAM sequence: AGG
gagttgggggtggggcttga

SEQ ID NO: 70139 - DNA, 20 bp, Artificial Sequence
  Description of Artificial Sequence: Synthetic oligonucleotide
  Target: ATXN1; (-) strand; PAM type: NRG; PAM sequence: AAG
ggagttgggggtggggcttg

SEQ ID NO: 70140 - DNA, 20 bp, Artificial Sequence
  Description of Artificial Sequence: Synthetic oligonucleotide
  Target: ATXN1; (-) strand; PAM type: NRG; PAM sequence: GGG
agagatgggagttgggggtg

SEQ ID NO: 70141 - DNA, 20 bp, Artificial Sequence
  Description of Artificial Sequence: Synthetic oligonucleotide
  Target: ATXN1; (-) strand; PAM type: NRG; PAM sequence: GGG
gagagatgggagttgggggt

SEQ ID NO: 70142 - DNA, 20 bp, Artificial Sequence
  Description of Artificial Sequence: Synthetic oligonucleotide
  Target: ATXN1; (-) strand; PAM type: NRG; PAM sequence: TGG
agagagatgggagttggggg

SEQ ID NO: 70143 - DNA, 20 bp, Artificial Sequence
  Description of Artificial Sequence: Synthetic oligonucleotide
  Target: ATXN1; (-) strand; PAM type: NRG; PAM sequence: GGG
acaagagagatgggagttgg

SEQ ID NO: 70144 - DNA, 20 bp, Artificial Sequence
  Description of Artificial Sequence: Synthetic oligonucleotide
  Target: ATXN1; (-) strand; PAM type: NRG; PAM sequence: GGG
tacaagagagatgggagttg

SEQ ID NO: 70145 - DNA, 20 bp, Artificial Sequence
  Description of Artificial Sequence: Synthetic oligonucleotide
  Target: ATXN1; (-) strand; PAM type: NRG; PAM sequence: GGG
gtacaagagagatgggagtt

SEQ ID NO: 70146 - DNA, 20 bp, Artificial Sequence
  Description of Artificial Sequence: Synthetic oligonucleotide
  Target: ATXN1; (-) strand; PAM type: NRG; PAM sequence: TGG
agtacaagagagatgggagt

SEQ ID NO: 70147 - DNA, 20 bp, Artificial Sequence
  Description of Artificial Sequence: Synthetic oligonucleotide
  Target: ATXN1; (-) strand; PAM type: NRG; PAM sequence: GAG
ggtaagtacaagagagatgg

SEQ ID NO: 70148 - DNA, 20 bp, Artificial Sequence
  Description of Artificial Sequence: Synthetic oligonucleotide
  Target: ATXN1; (-) strand; PAM type: NRG; PAM sequence: GGG
gtggtaagtacaagagagat

SEQ ID NO: 70149 - DNA, 20 bp, Artificial Sequence
  Description of Artificial Sequence: Synthetic oligonucleotide
  Target: ATXN1; (-) strand; PAM type: NRG; PAM sequence: TGG
agtggtaagtacaagagaga

SEQ ID NO: 70150 - DNA, 20 bp, Artificial Sequence
  Description of Artificial Sequence: Synthetic oligonucleotide
  Target: ATXN1; (-) strand; PAM type: NRG; PAM sequence: GAG
agggagtggtaagtacaaga

SEQ ID NO: 70151 - DNA, 20 bp, Artificial Sequence
  Description of Artificial Sequence: Synthetic oligonucleotide
  Target: ATXN1; (-) strand; PAM type: NRG; PAM sequence: GAG
gaagggagtggtaagtacaa

SEQ ID NO: 70152 - DNA, 20 bp, Artificial Sequence
  Description of Artificial Sequence: Synthetic oligonucleotide
  Target: ATXN1; (-) strand; PAM type: NRG; PAM sequence: AAG
ctgaagggagtggtaagtac

SEQ ID NO: 70153 - DNA, 20 bp, Artificial Sequence
  Description of Artificial Sequence: Synthetic oligonucleotide
  Target: ATXN1; (-) strand; PAM type: NRG; PAM sequence: AAG
aaacgtctgaagggagtggt

SEQ ID NO: 70154 - DNA, 20 bp, Artificial Sequence
  Description of Artificial Sequence: Synthetic oligonucleotide
  Target: ATXN1; (-) strand; PAM type: NRG; PAM sequence: TGG
ttaaaaacgtctgaagggag

SEQ ID NO: 70155 - DNA, 20 bp, Artificial Sequence
  Description of Artificial Sequence: Synthetic oligonucleotide
  Target: ATXN1; (-) strand; PAM type: NRG; PAM sequence: GAG
cagttaaaaacgtctgaagg

SEQ ID NO: 70156 - DNA, 20 bp, Artificial Sequence
  Description of Artificial Sequence: Synthetic oligonucleotide
  Target: ATXN1; (-) strand; PAM type: NRG; PAM sequence: GGG
tccagttaaaaacgtctgaa

SEQ ID NO: 70157 - DNA, 20 bp, Artificial Sequence
  Description of Artificial Sequence: Synthetic oligonucleotide
  Target: ATXN1; (-) strand; PAM type: NRG; PAM sequence: AGG
gtccagttaaaaacgtctga

SEQ ID NO: 70158 - DNA, 20 bp, Artificial Sequence
  Description of Artificial Sequence: Synthetic oligonucleotide
  Target: ATXN1; (-) strand; PAM type: NRG; PAM sequence: AAG
ggtccagttaaaaacgtctg

SEQ ID NO: 70159 - DNA, 20 bp, Artificial Sequence
  Description of Artificial Sequence: Synthetic oligonucleotide
  Target: ATXN1; (-) strand; PAM type: NRG; PAM sequence: CAG
taattttatggctcagggtc

SEQ ID NO: 70160 - DNA, 20 bp, Artificial Sequence
  Description of Artificial Sequence: Synthetic oligonucleotide
  Target: ATXN1; (-) strand; PAM type: NRG; PAM sequence: GGG
tgtgttaattttatggctca

SEQ ID NO: 70161 - DNA, 20 bp, Artificial Sequence
  Description of Artificial Sequence: Synthetic oligonucleotide
  Target: ATXN1; (-) strand; PAM type: NRG; PAM sequence: AGG
ctgtgttaattttatggctc

SEQ ID NO: 70162 - DNA, 20 bp, Artificial Sequence
  Description of Artificial Sequence: Synthetic oligonucleotide
  Target: ATXN1; (-) strand; PAM type: NRG; PAM sequence: CAG
tctgtgttaattttatggct

SEQ ID NO: 70163 - DNA, 20 bp, Artificial Sequence
  Description of Artificial Sequence: Synthetic oligonucleotide
  Target: ATXN1; (-) strand; PAM type: NRG; PAM sequence: TGG
cattttctgtgttaatttta

SEQ ID NO: 70164 - DNA, 20 bp, Artificial Sequence
  Description of Artificial Sequence: Synthetic oligonucleotide
  Target: ATXN1; (-) strand; PAM type: NRG; PAM sequence: TAG
attcaggattttctgatttc

SEQ ID NO: 70165 - DNA, 20 bp, Artificial Sequence
  Description of Artificial Sequence: Synthetic oligonucleotide
  Target: ATXN1; (-) strand; PAM type: NRG; PAM sequence: AGG
caaagctgagattaaaattc

SEQ ID NO: 70166 - DNA, 20 bp, Artificial Sequence
  Description of Artificial Sequence: Synthetic oligonucleotide
  Target: ATXN1; (-) strand; PAM type: NRG; PAM sequence: CAG
gcaaagctgagattaaaatt

SEQ ID NO: 70167 - DNA, 20 bp, Artificial Sequence
  Description of Artificial Sequence: Synthetic oligonucleotide
  Target: ATXN1; (-) strand; PAM type: NRG; PAM sequence: GAG
ctcagaaaaatggcaaagct

SEQ ID NO: 70168 - DNA, 20 bp, Artificial Sequence
  Description of Artificial Sequence: Synthetic oligonucleotide
  Target: ATXN1; (-) strand; PAM type: NRG; PAM sequence: AAG
taaggctcagaaaaatggca

SEQ ID NO: 70169 - DNA, 20 bp, Artificial Sequence
  Description of Artificial Sequence: Synthetic oligonucleotide
  Target: ATXN1; (-) strand; PAM type: NRG; PAM sequence: TGG
acaattaaggctcagaaaaa

SEQ ID NO: 70170 - DNA, 20 bp, Artificial Sequence
  Description of Artificial Sequence: Synthetic oligonucleotide
  Target: ATXN1; (-) strand; PAM type: NRG; PAM sequence: CAG
tagttgggacaattaaggct

SEQ ID NO: 70171 - DNA, 20 bp, Artificial Sequence
  Description of Artificial Sequence: Synthetic oligonucleotide
  Target: ATXN1; (-) strand; PAM type: NRG; PAM sequence: AGG
acttatagttgggacaatta

SEQ ID NO: 70172 - DNA, 20 bp, Artificial Sequence
  Description of Artificial Sequence: Synthetic oligonucleotide
  Target: ATXN1; (-) strand; PAM type: NRG; PAM sequence: AAG
tacttatagttgggacaatt

SEQ ID NO: 70173 - DNA, 20 bp, Artificial Sequence
  Description of Artificial Sequence: Synthetic oligonucleotide
  Target: ATXN1; (-) strand; PAM type: NRG; PAM sequence: GGG
tcatatctctacttatagtt

SEQ ID NO: 70174 - DNA, 20 bp, Artificial Sequence
  Description of Artificial Sequence: Synthetic oligonucleotide
  Target: ATXN1; (-) strand; PAM type: NRG; PAM sequence: TGG
ttcatatctctacttatagt

SEQ ID NO: 70175 - DNA, 20 bp, Artificial Sequence
  Description of Artificial Sequence: Synthetic oligonucleotide
  Target: ATXN1; (-) strand; PAM type: NRG; PAM sequence: TAG
caatttcatatctctactta

SEQ ID NO: 70176 - DNA, 20 bp, Artificial Sequence
  Description of Artificial Sequence: Synthetic oligonucleotide
  Target: ATXN1; (-) strand; PAM type: NRG; PAM sequence: TAG
gaagtaattatatcttgtag

SEQ ID NO: 70177 - DNA, 20 bp, Artificial Sequence
  Description of Artificial Sequence: Synthetic oligonucleotide
  Target: ATXN1; (-) strand; PAM type: NRG; PAM sequence: TAG
tcagaagtaattatatcttg

SEQ ID NO: 70178 - DNA, 20 bp, Artificial Sequence
  Description of Artificial Sequence: Synthetic oligonucleotide
  Target: ATXN1; (-) strand; PAM type: NRG; PAM sequence: AAG
cctttttataagtatgtcag

SEQ ID NO: 70179 - DNA, 20 bp, Artificial Sequence
  Description of Artificial Sequence: Synthetic oligonucleotide
  Target: ATXN1; (-) strand; PAM type: NRG; PAM sequence: CAG
aaccctttttataagtatgt

SEQ ID NO: 70180 - DNA, 20 bp, Artificial Sequence
  Description of Artificial Sequence: Synthetic oligonucleotide
  Target: ATXN1; (-) strand; PAM type: NRG; PAM sequence: AAG
tgaaagtcaaccctttttat

SEQ ID NO: 70181 - DNA, 20 bp, Artificial Sequence
  Description of Artificial Sequence: Synthetic oligonucleotide
  Target: ATXN1; (-) strand; PAM type: NRG; PAM sequence: AAG
acataactgttacaagttga

SEQ ID NO: 70182 - DNA, 20 bp, Artificial Sequence
  Description of Artificial Sequence: Synthetic oligonucleotide
  Target: ATXN1; (-) strand; PAM type: NRG; PAM sequence: AAG
accttaaacataactgttac

SEQ ID NO: 70183 - DNA, 20 bp, Artificial Sequence
  Description of Artificial Sequence: Synthetic oligonucleotide
  Target: ATXN1; (-) strand; PAM type: NRG; PAM sequence: CAG
ctaagctttatggcttctaa

SEQ ID NO: 70184 - DNA, 20 bp, Artificial Sequence
  Description of Artificial Sequence: Synthetic oligonucleotide
  Target: ATXN1; (-) strand; PAM type: NRG; PAM sequence: TGG
atctcatagtctaagcttta

SEQ ID NO: 70185 - DNA, 20 bp, Artificial Sequence
  Description of Artificial Sequence: Synthetic oligonucleotide
  Target: ATXN1; (-) strand; PAM type: NRG; PAM sequence: AAG
cggaagtcatctcatagtct

SEQ ID NO: 70186 - DNA, 20 bp, Artificial Sequence
  Description of Artificial Sequence: Synthetic oligonucleotide
  Target: ATXN1; (-) strand; PAM type: NRG; PAM sequence: TAG
acctcacggaagtcatctca

SEQ ID NO: 70187 - DNA, 20 bp, Artificial Sequence
  Description of Artificial Sequence: Synthetic oligonucleotide
  Target: ATXN1; (-) strand; PAM type: NRG; PAM sequence: AAG
taggagatctcacctcacgg

SEQ ID NO: 70188 - DNA, 20 bp, Artificial Sequence
  Description of Artificial Sequence: Synthetic oligonucleotide
  Target: ATXN1; (-) strand; PAM type: NRG; PAM sequence: CGG
acataggagatctcacctca

SEQ ID NO: 70189 - DNA, 20 bp, Artificial Sequence
  Description of Artificial Sequence: Synthetic oligonucleotide
  Target: ATXN1; (-) strand; PAM type: NRG; PAM sequence: GAG
cccaccactcattaacatag

SEQ ID NO: 70190 - DNA, 20 bp, Artificial Sequence
  Description of Artificial Sequence: Synthetic oligonucleotide
  Target: ATXN1; (-) strand; PAM type: NRG; PAM sequence: AGG
tccccaccactcattaacat

SEQ ID NO: 70191 - DNA, 20 bp, Artificial Sequence
  Description of Artificial Sequence: Synthetic oligonucleotide
  Target: ATXN1; (-) strand; PAM type: NRG; PAM sequence: TAG
ctccccaccactcattaaca

SEQ ID NO: 70192 - DNA, 20 bp, Artificial Sequence
  Description of Artificial Sequence: Synthetic oligonucleotide
  Target: ATXN1; (-) strand; PAM type: NRG; PAM sequence: CAG
gtggcaatactctcagggta

SEQ ID NO: 70193 - DNA, 20 bp, Artificial Sequence
  Description of Artificial Sequence: Synthetic oligonucleotide
  Target: ATXN1; (-) strand; PAM type: NRG; PAM sequence: GGG
ttgtcgtggcaatactctca

SEQ ID NO: 70194 - DNA, 20 bp, Artificial Sequence
  Description of Artificial Sequence: Synthetic oligonucleotide
  Target: ATXN1; (-) strand; PAM type: NRG; PAM sequence: AGG
cttgtcgtggcaatactctc

SEQ ID NO: 70195 - DNA, 20 bp, Artificial Sequence
  Description of Artificial Sequence: Synthetic oligonucleotide
  Target: ATXN1; (-) strand; PAM type: NRG; PAM sequence: CAG
acttgtcgtggcaatactct

SEQ ID NO: 70196 - DNA, 20 bp, Artificial Sequence
  Description of Artificial Sequence: Synthetic oligonucleotide
  Target: ATXN1; (-) strand; PAM type: NRG; PAM sequence: TGG
aaaaataaataaacttgtcg

SEQ ID NO: 70197 - DNA, 20 bp, Artificial Sequence
  Description of Artificial Sequence: Synthetic oligonucleotide
  Target: ATXN1; (-) strand; PAM type: NRG; PAM sequence: TGG
tttcagcatgttgaaatagt

SEQ ID NO: 70198 - DNA, 20 bp, Artificial Sequence
  Description of Artificial Sequence: Synthetic oligonucleotide
  Target: ATXN1; (-) strand; PAM type: NRG; PAM sequence: TAG
tccatttcagcatgttgaaa

SEQ ID NO: 70199 - DNA, 20 bp, Artificial Sequence
  Description of Artificial Sequence: Synthetic oligonucleotide
  Target: ATXN1; (-) strand; PAM type: NRG; PAM sequence: CAG
tttcatagaaacttccattt

SEQ ID NO: 70200 - DNA, 20 bp, Artificial Sequence
  Description of Artificial Sequence: Synthetic oligonucleotide
  Target: ATXN1; (-) strand; PAM type: NRG; PAM sequence: TAG
tatgaaacatttgtttttca

SEQ ID NO: 70201 - DNA, 20 bp, Artificial Sequence
  Description of Artificial Sequence: Synthetic oligonucleotide
  Target: ATXN1; (-) strand; PAM type: NRG; PAM sequence: GGG
ggcctgcctttttcctcctt

SEQ ID NO: 70202 - DNA, 20 bp, Artificial Sequence
  Description of Artificial Sequence: Synthetic oligonucleotide
  Target: ATXN1; (-) strand; PAM type: NRG; PAM sequence: TGG
gggcctgcctttttcctcct

SEQ ID NO: 70203 - DNA, 20 bp, Artificial Sequence
  Description of Artificial Sequence: Synthetic oligonucleotide
  Target: ATXN1; (-) strand; PAM type: NRG; PAM sequence: GGG
ctagaacttccccaagggga

SEQ ID NO: 70204 - DNA, 20 bp, Artificial Sequence
  Description of Artificial Sequence: Synthetic oligonucleotide
  Target: ATXN1; (-) strand; PAM type: NRG; PAM sequence: AGG
gctagaacttccccaagggg

SEQ ID NO: 70205 - DNA, 20 bp, Artificial Sequence
  Description of Artificial Sequence: Synthetic oligonucleotide
  Target: ATXN1; (-) strand; PAM type: NRG; PAM sequence: GAG
tgctagaacttccccaaggg

SEQ ID NO: 70206 - DNA, 20 bp, Artificial Sequence
  Description of Artificial Sequence: Synthetic oligonucleotide
  Target: ATXN1; (-) strand; PAM type: NRG; PAM sequence: GGG
gatgctagaacttccccaag

SEQ ID NO: 70207 - DNA, 20 bp, Artificial Sequence
  Description of Artificial Sequence: Synthetic oligonucleotide
  Target: ATXN1; (-) strand; PAM type: NRG; PAM sequence: GGG
agatgctagaacttccccaa

SEQ ID NO: 70208 - DNA, 20 bp, Artificial Sequence
  Description of Artificial Sequence: Synthetic oligonucleotide
  Target: ATXN1; (-) strand; PAM type: NRG; PAM sequence: AGG
aagatgctagaacttcccca

SEQ ID NO: 70209 - DNA, 20 bp, Artificial Sequence
  Description of Artificial Sequence: Synthetic oligonucleotide
  Target: ATXN1; (-) strand; PAM type: NRG; PAM sequence: AAG
aaagatgctagaacttcccc

SEQ ID NO: 70210 - DNA, 20 bp, Artificial Sequence
  Description of Artificial Sequence: Synthetic oligonucleotide
  Target: ATXN1; (-) strand; PAM type: NRG; PAM sequence: TAG
gttctttctctgaaagatgc

SEQ ID NO: 70211 - DNA, 20 bp, Artificial Sequence
  Description of Artificial Sequence: Synthetic oligonucleotide
  Target: ATXN1; (-) strand; PAM type: NRG; PAM sequence: AAG
cttgcctgttctttctctga

SEQ ID NO: 70212 - DNA, 20 bp, Artificial Sequence
  Description of Artificial Sequence: Synthetic oligonucleotide
  Target: ATXN1; (-) strand; PAM type: NRG; PAM sequence: GGG
tcccttttcccactttcctt

SEQ ID NO: 70213 - DNA, 20 bp, Artificial Sequence
  Description of Artificial Sequence: Synthetic oligonucleotide
  Target: ATXN1; (-) strand; PAM type: NRG; PAM sequence: TGG
ttcccttttcccactttcct

SEQ ID NO: 70214 - DNA, 20 bp, Artificial Sequence
  Description of Artificial Sequence: Synthetic oligonucleotide
  Target: ATXN1; (-) strand; PAM type: NRG; PAM sequence: GGG
gcaagtccacaacaaagaga

SEQ ID NO: 70215 - DNA, 20 bp, Artificial Sequence
  Description of Artificial Sequence: Synthetic oligonucleotide
  Target: ATXN1; (-) strand; PAM type: NRG; PAM sequence: AGG
ggcaagtccacaacaaagag

SEQ ID NO: 70216 - DNA, 20 bp, Artificial Sequence
  Description of Artificial Sequence: Synthetic oligonucleotide
  Target: ATXN1; (-) strand; PAM type: NRG; PAM sequence: GAG
tggcaagtccacaacaaaga

SEQ ID NO: 70217 - DNA, 20 bp, Artificial Sequence
  Description of Artificial Sequence: Synthetic oligonucleotide
  Target: ATXN1; (-) strand; PAM type: NRG; PAM sequence: GAG
tttggcaagtccacaacaaa

SEQ ID NO: 70218 - DNA, 20 bp, Artificial Sequence
  Description of Artificial Sequence: Synthetic oligonucleotide
  Target: ATXN1; (-) strand; PAM type: NRG; PAM sequence: AAG
gatttggcaagtccacaaca

SEQ ID NO: 70219 - DNA, 20 bp, Artificial Sequence
  Description of Artificial Sequence: Synthetic oligonucleotide
  Target: ATXN1; (-) strand; PAM type: NRG; PAM sequence: AAG
acttcggtcagggatttggc

SEQ ID NO: 70220 - DNA, 20 bp, Artificial Sequence
  Description of Artificial Sequence: Synthetic oligonucleotide
  Target: ATXN1; (-) strand; PAM type: NRG; PAM sequence: TGG
gtccacttcggtcagggatt

SEQ ID NO: 70221 - DNA, 20 bp, Artificial Sequence
  Description of Artificial Sequence: Synthetic oligonucleotide
  Target: ATXN1; (-) strand; PAM type: NRG; PAM sequence: GGG
ttgtaagtccacttcggtca

SEQ ID NO: 70222 - DNA, 20 bp, Artificial Sequence
  Description of Artificial Sequence: Synthetic oligonucleotide
  Target: ATXN1; (-) strand; PAM type: NRG; PAM sequence: AGG
gttgtaagtccacttcggtc

SEQ ID NO: 70223 - DNA, 20 bp, Artificial Sequence
  Description of Artificial Sequence: Synthetic oligonucleotide
  Target: ATXN1; (-) strand; PAM type: NRG; PAM sequence: CAG
tgttgtaagtccacttcggt

SEQ ID NO: 70224 - DNA, 20 bp, Artificial Sequence
  Description of Artificial Sequence: Synthetic oligonucleotide
  Target: ATXN1; (-) strand; PAM type: NRG; PAM sequence: CGG
gttctgttgtaagtccactt

SEQ ID NO: 70225 - DNA, 20 bp, Artificial Sequence
  Description of Artificial Sequence: Synthetic oligonucleotide
  Target: ATXN1; (-) strand; PAM type: NRG; PAM sequence: AAG
aatatttgcagttctgttgt

SEQ ID NO: 70226 - DNA, 20 bp, Artificial Sequence
  Description of Artificial Sequence: Synthetic oligonucleotide
  Target: ATXN1; (-) strand; PAM type: NRG; PAM sequence: CAG
cactttcgtgagaatatttg

SEQ ID NO: 70227 - DNA, 20 bp, Artificial Sequence
  Description of Artificial Sequence: Synthetic oligonucleotide
  Target: ATXN1; (-) strand; PAM type: NRG; PAM sequence: GAG
ccaggcttggacactttcgt

SEQ ID NO: 70228 - DNA, 20 bp, Artificial Sequence
  Description of Artificial Sequence: Synthetic oligonucleotide
  Target: ATXN1; (-) strand; PAM type: NRG; PAM sequence: TGG
gcttcttatttttccaggct

SEQ ID NO: 70229 - DNA, 20 bp, Artificial Sequence
  Description of Artificial Sequence: Synthetic oligonucleotide
  Target: ATXN1; (-) strand; PAM type: NRG; PAM sequence: AGG
tatttgcttcttatttttcc

SEQ ID NO: 70230 - DNA, 20 bp, Artificial Sequence
  Description of Artificial Sequence: Synthetic oligonucleotide
  Target: ATXN1; (-) strand; PAM type: NRG; PAM sequence: CAG
ttatttgcttcttatttttc

SEQ ID NO: 70231 - DNA, 20 bp, Artificial Sequence
  Description of Artificial Sequence: Synthetic oligonucleotide
  Target: ATXN1; (-) strand; PAM type: NRG; PAM sequence: AGG
acagtatatttccgtctgtt

SEQ ID NO: 70232 - DNA, 20 bp, Artificial Sequence
  Description of Artificial Sequence: Synthetic oligonucleotide
  Target: ATXN1; (-) strand; PAM type: NRG; PAM sequence: TAG
aacagtatatttccgtctgt

SEQ ID NO: 70233 - DNA, 20 bp, Artificial Sequence
  Description of Artificial Sequence: Synthetic oligonucleotide
  Target: ATXN1; (-) strand; PAM type: NRG; PAM sequence: CAG
ggaaaaggagtgcaattgaa

SEQ ID NO: 70234 - DNA, 20 bp, Artificial Sequence
  Description of Artificial Sequence: Synthetic oligonucleotide
  Target: ATXN1; (-) strand; PAM type: NRG; PAM sequence: GAG
tgtgcatttggaaggaaaag

SEQ ID NO: 70235 - DNA, 20 bp, Artificial Sequence
  Description of Artificial Sequence: Synthetic oligonucleotide
  Target: ATXN1; (-) strand; PAM type: NRG; PAM sequence: AGG
tatgtgcatttggaaggaaa

SEQ ID NO: 70236 - DNA, 20 bp, Artificial Sequence
  Description of Artificial Sequence: Synthetic oligonucleotide
  Target: ATXN1; (-) strand; PAM type: NRG; PAM sequence: AAG
ttatgtgcatttggaaggaa

SEQ ID NO: 70237 - DNA, 20 bp, Artificial Sequence
  Description of Artificial Sequence: Synthetic oligonucleotide
  Target: ATXN1; (-) strand; PAM type: NRG; PAM sequence: AGG
tatctttatgtgcatttgga

SEQ ID NO: 70238 - DNA, 20 bp, Artificial Sequence
  Description of Artificial Sequence: Synthetic oligonucleotide
  Target: ATXN1; (-) strand; PAM type: NRG; PAM sequence: AAG
gtatctttatgtgcatttgg

SEQ ID NO: 70239 - DNA, 20 bp, Artificial Sequence
  Description of Artificial Sequence: Synthetic oligonucleotide
  Target: ATXN1; (-) strand; PAM type: NRG; PAM sequence: TGG
actgtatctttatgtgcatt

SEQ ID NO: 70240 - DNA, 20 bp, Artificial Sequence
  Description of Artificial Sequence: Synthetic oligonucleotide
  Target: ATXN1; (-) strand; PAM type: NRG; PAM sequence: GGG
gtttggggttggtttagaat

SEQ ID NO: 70241 - DNA, 20 bp, Artificial Sequence
  Description of Artificial Sequence: Synthetic oligonucleotide
  Target: ATXN1; (-) strand; PAM type: NRG; PAM sequence: TGG
ggtttggggttggtttagaa

SEQ ID NO: 70242 - DNA, 20 bp, Artificial Sequence
  Description of Artificial Sequence: Synthetic oligonucleotide
  Target: ATXN1; (-) strand; PAM type: NRG; PAM sequence: TAG
ctcagggtttggggttggtt

SEQ ID NO: 70243 - DNA, 20 bp, Artificial Sequence
  Description of Artificial Sequence: Synthetic oligonucleotide
  Target: ATXN1; (-) strand; PAM type: NRG; PAM sequence: TGG
caaatctcagggtttggggt

SEQ ID NO: 70244 - DNA, 20 bp, Artificial Sequence
  Description of Artificial Sequence: Synthetic oligonucleotide
  Target: ATXN1; (-) strand; PAM type: NRG; PAM sequence: GGG
aagccaaatctcagggtttg

SEQ ID NO: 70245 - DNA, 20 bp, Artificial Sequence
  Description of Artificial Sequence: Synthetic oligonucleotide
  Target: ATXN1; (-) strand; PAM type: NRG; PAM sequence: GGG
aaagccaaatctcagggttt

SEQ ID NO: 70246 - DNA, 20 bp, Artificial Sequence
  Description of Artificial Sequence: Synthetic oligonucleotide
  Target: ATXN1; (-) strand; PAM type: NRG; PAM sequence: TGG
gaaagccaaatctcagggtt

SEQ ID NO: 70247 - DNA, 20 bp, Artificial Sequence
  Description of Artificial Sequence: Synthetic oligonucleotide
  Target: ATXN1; (-) strand; PAM type: NRG; PAM sequence: GGG
gcattgaaagccaaatctca

SEQ ID NO: 70248 - DNA, 20 bp, Artificial Sequence
  Description of Artificial Sequence: Synthetic oligonucleotide
  Target: ATXN1; (-) strand; PAM type: NRG; PAM sequence: AGG
tgcattgaaagccaaatctc

SEQ ID NO: 70249 - DNA, 20 bp, Artificial Sequence
  Description of Artificial Sequence: Synthetic oligonucleotide
  Target: ATXN1; (-) strand; PAM type: NRG; PAM sequence: CAG
gtgcattgaaagccaaatct

SEQ ID NO: 70250 - DNA, 20 bp, Artificial Sequence
  Description of Artificial Sequence: Synthetic oligonucleotide
  Target: ATXN1; (-) strand; PAM type: NRG; PAM sequence: AAG
tttgaaagcaggtgcattga

SEQ ID NO: 70251 - DNA, 20 bp, Artificial Sequence
  Description of Artificial Sequence: Synthetic oligonucleotide
  Target: ATXN1; (-) strand; PAM type: NRG; PAM sequence: AGG
ctggtttgacttttgaaagc

SEQ ID NO: 70252 - DNA, 20 bp, Artificial Sequence
  Description of Artificial Sequence: Synthetic oligonucleotide
  Target: ATXN1; (-) strand; PAM type: NRG; PAM sequence: CAG
tctggtttgacttttgaaag

SEQ ID NO: 70253 - DNA, 20 bp, Artificial Sequence
  Description of Artificial Sequence: Synthetic oligonucleotide
  Target: ATXN1; (-) strand; PAM type: NRG; PAM sequence: AAG
tcctctggtttgacttttga

SEQ ID NO: 70254 - DNA, 20 bp, Artificial Sequence
  Description of Artificial Sequence: Synthetic oligonucleotide
  Target: ATXN1; (-) strand; PAM type: NRG; PAM sequence: TGG
aaaaatgacaagatttcctc

SEQ ID NO: 70255 - DNA, 20 bp, Artificial Sequence
  Description of Artificial Sequence: Synthetic oligonucleotide
  Target: ATXN1; (-) strand; PAM type: NRG; PAM sequence: AAG
cggtggatgttaaaaatgac

SEQ ID NO: 70256 - DNA, 20 bp, Artificial Sequence
  Description of Artificial Sequence: Synthetic oligonucleotide
  Target: ATXN1; (-) strand; PAM type: NRG; PAM sequence: TGG
tggtaggcatttgctggcgg

SEQ ID NO: 70257 - DNA, 20 bp, Artificial Sequence
  Description of Artificial Sequence: Synthetic oligonucleotide
  Target: ATXN1; (-) strand; PAM type: NRG; PAM sequence: CGG
acatggtaggcatttgctgg

SEQ ID NO: 70258 - DNA, 20 bp, Artificial Sequence
  Description of Artificial Sequence: Synthetic oligonucleotide
  Target: ATXN1; (-) strand; PAM type: NRG; PAM sequence: TGG
tccacatggtaggcatttgc

SEQ ID NO: 70259 - DNA, 20 bp, Artificial Sequence
  Description of Artificial Sequence: Synthetic oligonucleotide
  Target: ATXN1; (-) strand; PAM type: NRG; PAM sequence: AGG
gtggtgagactccacatggt

SEQ ID NO: 70260 - DNA, 20 bp, Artificial Sequence
  Description of Artificial Sequence: Synthetic oligonucleotide
  Target: ATXN1; (-) strand; PAM type: NRG; PAM sequence: TAG
tgtggtgagactccacatgg

SEQ ID NO: 70261 - DNA, 20 bp, Artificial Sequence
  Description of Artificial Sequence: Synthetic oligonucleotide
  Target: ATXN1; (-) strand; PAM type: NRG; PAM sequence: TGG
tcttgtggtgagactccaca

SEQ ID NO: 70262 - DNA, 20 bp, Artificial Sequence
  Description of Artificial Sequence: Synthetic oligonucleotide
  Target: ATXN1; (-) strand; PAM type: NRG; PAM sequence: GAG
cacagcttgggtcttgtggt

SEQ ID NO: 70263 - DNA, 20 bp, Artificial Sequence
  Description of Artificial Sequence: Synthetic oligonucleotide
  Target: ATXN1; (-) strand; PAM type: NRG; PAM sequence: TGG
ggtgcacagcttgggtcttg

SEQ ID NO: 70264 - DNA, 20 bp, Artificial Sequence
  Description of Artificial Sequence: Synthetic oligonucleotide
  Target: ATXN1; (-) strand; PAM type: NRG; PAM sequence: GGG
tgacgcctggtgcacagctt

SEQ ID NO: 70265 - DNA, 20 bp, Artificial Sequence
  Description of Artificial Sequence: Synthetic oligonucleotide
  Target: ATXN1; (-) strand; PAM type: NRG; PAM sequence: TGG
ctgacgcctggtgcacagct

SEQ ID NO: 70266 - DNA, 20 bp, Artificial Sequence
  Description of Artificial Sequence: Synthetic oligonucleotide
  Target: ATXN1; (-) strand; PAM type: NRG; PAM sequence: CAG
tctctctgacgcctggtgca

SEQ ID NO: 70267 - DNA, 20 bp, Artificial Sequence
  Description of Artificial Sequence: Synthetic oligonucleotide
  Target: ATXN1; (-) strand; PAM type: NRG; PAM sequence: TGG
caccgcttctctctgacgcc

SEQ ID NO: 70268 - DNA, 20 bp, Artificial Sequence
  Description of Artificial Sequence: Synthetic oligonucleotide
  Target: ATXN1; (-) strand; PAM type: NRG; PAM sequence: TAG
aggaaactaacacaggcagg

SEQ ID NO: 70269 - DNA, 20 bp, Artificial Sequence
  Description of Artificial Sequence: Synthetic oligonucleotide
  Target: ATXN1; (-) strand; PAM type: NRG; PAM sequence: AGG
cccaggaaactaacacaggc

SEQ ID NO: 70270 - DNA, 20 bp, Artificial Sequence
  Description of Artificial Sequence: Synthetic oligonucleotide
  Target: ATXN1; (-) strand; PAM type: NRG; PAM sequence: CAG
ccccaggaaactaacacagg

SEQ ID NO: 70271 - DNA, 20 bp, Artificial Sequence
  Description of Artificial Sequence: Synthetic oligonucleotide
  Target: ATXN1; (-) strand; PAM type: NRG; PAM sequence: AGG
caaccccaggaaactaacac

SEQ ID NO: 70272 - DNA, 20 bp, Artificial Sequence
  Description of Artificial Sequence: Synthetic oligonucleotide
  Target: ATXN1; (-) strand; PAM type: NRG; PAM sequence: CAG
gcaaccccaggaaactaaca

SEQ ID NO: 70273 - DNA, 20 bp, Artificial Sequence
  Description of Artificial Sequence: Synthetic oligonucleotide
  Target: ATXN1; (-) strand; PAM type: NRG; PAM sequence: AGG
tactgtgttattgcaacccc

SEQ ID NO: 70274 - DNA, 20 bp, Artificial Sequence
  Description of Artificial Sequence: Synthetic oligonucleotide
  Target: ATXN1; (-) strand; PAM type: NRG; PAM sequence: CAG
gtactgtgttattgcaaccc

SEQ ID NO: 70275 - DNA, 20 bp, Artificial Sequence
  Description of Artificial Sequence: Synthetic oligonucleotide
  Target: ATXN1; (-) strand; PAM type: NRG; PAM sequence: TGG
tgttgaagccccccagtctg

SEQ ID NO: 70276 - DNA, 20 bp, Artificial Sequence
  Description of Artificial Sequence: Synthetic oligonucleotide
  Target: ATXN1; (-) strand; PAM type: NRG; PAM sequence: CAG
tttctattgttgaagccccc

SEQ ID NO: 70277 - DNA, 20 bp, Artificial Sequence
  Description of Artificial Sequence: Synthetic oligonucleotide
  Target: ATXN1; (-) strand; PAM type: NRG; PAM sequence: AAG
acaatgcatttctattgttg

SEQ ID NO: 70278 - DNA, 20 bp, Artificial Sequence
  Description of Artificial Sequence: Synthetic oligonucleotide
  Target: ATXN1; (-) strand; PAM type: NRG; PAM sequence: AAG
tttctagcctccaggactgt

SEQ ID NO: 70279 - DNA, 20 bp, Artificial Sequence
  Description of Artificial Sequence: Synthetic oligonucleotide
  Target: ATXN1; (-) strand; PAM type: NRG; PAM sequence: AGG
atctcggatttctagcctcc

SEQ ID NO: 70280 - DNA, 20 bp, Artificial Sequence
  Description of Artificial Sequence: Synthetic oligonucleotide
  Target: ATXN1; (-) strand; PAM type: NRG; PAM sequence: CAG
gatctcggatttctagcctc

SEQ ID NO: 70281 - DNA, 20 bp, Artificial Sequence
  Description of Artificial Sequence: Synthetic oligonucleotide
  Target: ATXN1; (-) strand; PAM type: NRG; PAM sequence: TAG
acaccttgatctcggatttc

SEQ ID NO: 70282 - DNA, 20 bp, Artificial Sequence
  Description of Artificial Sequence: Synthetic oligonucleotide
  Target: ATXN1; (-) strand; PAM type: NRG; PAM sequence: CGG
ccctgcagacaccttgatct

SEQ ID NO: 70283 - DNA, 20 bp, Artificial Sequence
  Description of Artificial Sequence: Synthetic oligonucleotide
  Target: ATXN1; (-) strand; PAM type: NRG; PAM sequence: CAG
cctggaaggaaccagccctg

SEQ ID NO: 70284 - DNA, 20 bp, Artificial Sequence
  Description of Artificial Sequence: Synthetic oligonucleotide
  Target: ATXN1; (-) strand; PAM type: NRG; PAM sequence: CAG
ttgcacctcctggaaggaac

SEQ ID NO: 70285 - DNA, 20 bp, Artificial Sequence
  Description of Artificial Sequence: Synthetic oligonucleotide
  Target: ATXN1; (-) strand; PAM type: NRG; PAM sequence: AGG
tctcctttgcacctcctgga

SEQ ID NO: 70286 - DNA, 20 bp, Artificial Sequence
  Description of Artificial Sequence: Synthetic oligonucleotide
  Target: ATXN1; (-) strand; PAM type: NRG; PAM sequence: AAG
ttctcctttgcacctcctgg

SEQ ID NO: 70287 - DNA, 20 bp, Artificial Sequence
  Description of Artificial Sequence: Synthetic oligonucleotide
  Target: ATXN1; (-) strand; PAM type: NRG; PAM sequence: TGG
agattctcctttgcacctcc

SEQ ID NO: 70288 - DNA, 20 bp, Artificial Sequence
  Description of Artificial Sequence: Synthetic oligonucleotide
  Target: ATXN1; (-) strand; PAM type: NRG; PAM sequence: CAG
gctgggagaggggcatggaa

SEQ ID NO: 70289 - DNA, 20 bp, Artificial Sequence
  Description of Artificial Sequence: Synthetic oligonucleotide
  Target: ATXN1; (-) strand; PAM type: NRG; PAM sequence: TGG
cagaagctgggagaggggca

SEQ ID NO: 70290 - DNA, 20 bp, Artificial Sequence
  Description of Artificial Sequence: Synthetic oligonucleotide
  Target: ATXN1; (-) strand; PAM type: NRG; PAM sequence: GGG
gccaccagaagctgggagag

SEQ ID NO: 70291 - DNA, 20 bp, Artificial Sequence
  Description of Artificial Sequence: Synthetic oligonucleotide
  Target: ATXN1; (-) strand; PAM type: NRG; PAM sequence: GGG
agccaccagaagctgggaga

SEQ ID NO: 70292 - DNA, 20 bp, Artificial Sequence
  Description of Artificial Sequence: Synthetic oligonucleotide
  Target: ATXN1; (-) strand; PAM type: NRG; PAM sequence: AGG
aagccaccagaagctgggag

SEQ ID NO: 70293 - DNA, 20 bp, Artificial Sequence
  Description of Artificial Sequence: Synthetic oligonucleotide
  Target: ATXN1; (-) strand; PAM type: NRG; PAM sequence: GAG
aaagccaccagaagctggga

SEQ ID NO: 70294 - DNA, 20 bp, Artificial Sequence
  Description of Artificial Sequence: Synthetic oligonucleotide
  Target: ATXN1; (-) strand; PAM type: NRG; PAM sequence: GAG
ggaaagccaccagaagctgg

SEQ ID NO: 70295 - DNA, 20 bp, Artificial Sequence
  Description of Artificial Sequence: Synthetic oligonucleotide
  Target: ATXN1; (-) strand; PAM type: NRG; PAM sequence: GGG
ccggaaagccaccagaagct

SEQ ID NO: 70296 - DNA, 20 bp, Artificial Sequence
  Description of Artificial Sequence: Synthetic oligonucleotide
  Target: ATXN1; (-) strand; PAM type: NRG; PAM sequence: TGG
tccggaaagccaccagaagc

SEQ ID NO: 70297 - DNA, 20 bp, Artificial Sequence
  Description of Artificial Sequence: Synthetic oligonucleotide
  Target: ATXN1; (-) strand; PAM type: NRG; PAM sequence: AAG
gatatccggaaagccaccag

SEQ ID NO: 70298 - DNA, 20 bp, Artificial Sequence
  Description of Artificial Sequence: Synthetic oligonucleotide
  Target: ATXN1; (-) strand; PAM type: NRG; PAM sequence: CAG
aaagatatccggaaagccac

SEQ ID NO: 70299 - DNA, 20 bp, Artificial Sequence
  Description of Artificial Sequence: Synthetic oligonucleotide
  Target: ATXN1; (-) strand; PAM type: NRG; PAM sequence: AAG
aaacaccaaagatatccgga

SEQ ID NO: 70300 - DNA, 20 bp, Artificial Sequence
  Description of Artificial Sequence: Synthetic oligonucleotide
  Target: ATXN1; (-) strand; PAM type: NRG; PAM sequence: CGG
caagaaacaccaaagatatc

SEQ ID NO: 70301 - DNA, 20 bp, Artificial Sequence
  Description of Artificial Sequence: Synthetic oligonucleotide
  Target: ATXN1; (-) strand; PAM type: NRG; PAM sequence: AAG
cccaaagccaagaaacacca

SEQ ID NO: 70302 - DNA, 20 bp, Artificial Sequence
  Description of Artificial Sequence: Synthetic oligonucleotide
  Target: ATXN1; (-) strand; PAM type: NRG; PAM sequence: AAG
gagttatgctgcccaaagcc

SEQ ID NO: 70303 - DNA, 20 bp, Artificial Sequence
  Description of Artificial Sequence: Synthetic oligonucleotide
  Target: ATXN1; (-) strand; PAM type: NRG; PAM sequence: AAG
gactggagttatgctgccca

SEQ ID NO: 70304 - DNA, 20 bp, Artificial Sequence
  Description of Artificial Sequence: Synthetic oligonucleotide
  Target: ATXN1; (-) strand; PAM type: NRG; PAM sequence: GAG
ctattaccgtgtaaagactg

SEQ ID NO: 70305 - DNA, 20 bp, Artificial Sequence
  Description of Artificial Sequence: Synthetic oligonucleotide
  Target: ATXN1; (-) strand; PAM type: NRG; PAM sequence: TGG
ggctattaccgtgtaaagac

SEQ ID NO: 70306 - DNA, 20 bp, Artificial Sequence
  Description of Artificial Sequence: Synthetic oligonucleotide
  Target: ATXN1; (-) strand; PAM type: NRG; PAM sequence: AAG
tctgaggctattaccgtgta

SEQ ID NO: 70307 - DNA, 20 bp, Artificial Sequence
  Description of Artificial Sequence: Synthetic oligonucleotide
  Target: ATXN1; (-) strand; PAM type: NRG; PAM sequence: AGG
tcagagatagcctccctctg

SEQ ID NO: 70308 - DNA, 20 bp, Artificial Sequence
  Description of Artificial Sequence: Synthetic oligonucleotide
  Target: ATXN1; (-) strand; PAM type: NRG; PAM sequence: GAG
ctcagagatagcctccctct

SEQ ID NO: 70309 - DNA, 20 bp, Artificial Sequence
  Description of Artificial Sequence: Synthetic oligonucleotide
  Target: ATXN1; (-) strand; PAM type: NRG; PAM sequence: TAG
gggaaacttgggctcagaga

SEQ ID NO: 70310 - DNA, 20 bp, Artificial Sequence
  Description of Artificial Sequence: Synthetic oligonucleotide
  Target: ATXN1; (-) strand; PAM type: NRG; PAM sequence: GAG
aaaggggaaacttgggctca

SEQ ID NO: 70311 - DNA, 20 bp, Artificial Sequence
  Description of Artificial Sequence: Synthetic oligonucleotide
  Target: ATXN1; (-) strand; PAM type: NRG; PAM sequence: CAG
aaaaaggggaaacttgggct

SEQ ID NO: 70312 - DNA, 20 bp, Artificial Sequence
  Description of Artificial Sequence: Synthetic oligonucleotide
  Target: ATXN1; (-) strand; PAM type: NRG; PAM sequence: GGG
cttgtaaaaaggggaaactt

SEQ ID NO: 70313 - DNA, 20 bp, Artificial Sequence
  Description of Artificial Sequence: Synthetic oligonucleotide
  Target: ATXN1; (-) strand; PAM type: NRG; PAM sequence: TGG
ccttgtaaaaaggggaaact

SEQ ID NO: 70314 - DNA, 20 bp, Artificial Sequence
  Description of Artificial Sequence: Synthetic oligonucleotide
  Target: ATXN1; (-) strand; PAM type: NRG; PAM sequence: GGG
actcatctccttgtaaaaag

SEQ ID NO: 70315 - DNA, 20 bp, Artificial Sequence
  Description of Artificial Sequence: Synthetic oligonucleotide
  Target: ATXN1; (-) strand; PAM type: NRG; PAM sequence: GGG
gactcatctccttgtaaaaa

SEQ ID NO: 70316 - DNA, 20 bp, Artificial Sequence
  Description of Artificial Sequence: Synthetic oligonucleotide
  Target: ATXN1; (-) strand; PAM type: NRG; PAM sequence: AGG
tgactcatctccttgtaaaa

SEQ ID NO: 70317 - DNA, 20 bp, Artificial Sequence
  Description of Artificial Sequence: Synthetic oligonucleotide
  Target: ATXN1; (-) strand; PAM type: NRG; PAM sequence: AAG
atgactcatctccttgtaaa

SEQ ID NO: 70318 - DNA, 20 bp, Artificial Sequence
  Description of Artificial Sequence: Synthetic oligonucleotide
  Target: ATXN1; (-) strand; PAM type: NRG; PAM sequence: GGG
tcagatgaggttattagagt

SEQ ID NO: 70319 - DNA, 20 bp, Artificial Sequence
  Description of Artificial Sequence: Synthetic oligonucleotide
  Target: ATXN1; (-) strand; PAM type: NRG; PAM sequence: TGG
ttcagatgaggttattagag

SEQ ID NO: 70320 - DNA, 20 bp, Artificial Sequence
  Description of Artificial Sequence: Synthetic oligonucleotide
  Target: ATXN1; (-) strand; PAM type: NRG; PAM sequence: GAG
aagttcagatgaggttatta

SEQ ID NO: 70321 - DNA, 20 bp, Artificial Sequence
  Description of Artificial Sequence: Synthetic oligonucleotide
  Target: ATXN1; (-) strand; PAM type: NRG; PAM sequence: TAG
ccaagttcagatgaggttat

SEQ ID NO: 70322 - DNA, 20 bp, Artificial Sequence
  Description of Artificial Sequence: Synthetic oligonucleotide
  Target: ATXN1; (-) strand; PAM type: NRG; PAM sequence: AGG
catatgaccaagttcagatg

SEQ ID NO: 70323 - DNA, 20 bp, Artificial Sequence
  Description of Artificial Sequence: Synthetic oligonucleotide
  Target: ATXN1; (-) strand; PAM type: NRG; PAM sequence: GAG
gcatatgaccaagttcagat

SEQ ID NO: 70324 - DNA, 20 bp, Artificial Sequence
  Description of Artificial Sequence: Synthetic oligonucleotide
  Target: ATXN1; (-) strand; PAM type: NRG; PAM sequence: CAG
attttgcatatgaccaagtt

SEQ ID NO: 70325 - DNA, 20 bp, Artificial Sequence
  Description of Artificial Sequence: Synthetic oligonucleotide
  Target: ATXN1; (-) strand; PAM type: NRG; PAM sequence: AAG
aggagattttgcatatgacc

SEQ ID NO: 70326 - DNA, 20 bp, Artificial Sequence
  Description of Artificial Sequence: Synthetic oligonucleotide
  Target: ATXN1; (-) strand; PAM type: NRG; PAM sequence: GAG
acaatggctttatttggaag

SEQ ID NO: 70327 - DNA, 20 bp, Artificial Sequence
  Description of Artificial Sequence: Synthetic oligonucleotide
  Target: ATXN1; (-) strand; PAM type: NRG; PAM sequence: AGG
gaacaatggctttatttgga

SEQ ID NO: 70328 - DNA, 20 bp, Artificial Sequence
  Description of Artificial Sequence: Synthetic oligonucleotide
  Target: ATXN1; (-) strand; PAM type: NRG; PAM sequence: AAG
tgaacaatggctttatttgg

SEQ ID NO: 70329 - DNA, 20 bp, Artificial Sequence
  Description of Artificial Sequence: Synthetic oligonucleotide
  Target: ATXN1; (-) strand; PAM type: NRG; PAM sequence: TGG
ccatgaacaatggctttatt

SEQ ID NO: 70330 - DNA, 20 bp, Artificial Sequence
  Description of Artificial Sequence: Synthetic oligonucleotide
  Target: ATXN1; (-) strand; PAM type: NRG; PAM sequence: TGG
ctcccagtgtccatgaacaa

SEQ ID NO: 70331 - DNA, 20 bp, Artificial Sequence
  Description of Artificial Sequence: Synthetic oligonucleotide
  Target: ATXN1; (-) strand; PAM type: NRG; PAM sequence: CAG
tgttgacaggctaaacctcc

SEQ ID NO: 70332 - DNA, 20 bp, Artificial Sequence
  Description of Artificial Sequence: Synthetic oligonucleotide
  Target: ATXN1; (-) strand; PAM type: NRG; PAM sequence: AGG
tcccccaccaaaatgttgac

SEQ ID NO: 70333 - DNA, 20 bp, Artificial Sequence
  Description of Artificial Sequence: Synthetic oligonucleotide
  Target: ATXN1; (-) strand; PAM type: NRG; PAM sequence: CAG
gtcccccaccaaaatgttga

SEQ ID NO: 70334 - DNA, 20 bp, Artificial Sequence
  Description of Artificial Sequence: Synthetic oligonucleotide
  Target: ATXN1; (-) strand; PAM type: NRG; PAM sequence: AGG
gcctgtaggtgaggatgagg

SEQ ID NO: 70335 - DNA, 20 bp, Artificial Sequence
  Description of Artificial Sequence: Synthetic oligonucleotide
  Target: ATXN1; (-) strand; PAM type: NRG; PAM sequence: GAG
tgcctgtaggtgaggatgag

SEQ ID NO: 70336 - DNA, 20 bp, Artificial Sequence
  Description of Artificial Sequence: Synthetic oligonucleotide
  Target: ATXN1; (-) strand; PAM type: NRG; PAM sequence: AGG
catgcctgtaggtgaggatg

SEQ ID NO: 70337 - DNA, 20 bp, Artificial Sequence
  Description of Artificial Sequence: Synthetic oligonucleotide
  Target: ATXN1; (-) strand; PAM type: NRG; PAM sequence: GAG
acatgcctgtaggtgaggat

SEQ ID NO: 70338 - DNA, 20 bp, Artificial Sequence
  Description of Artificial Sequence: Synthetic oligonucleotide
  Target: ATXN1; (-) strand; PAM type: NRG; PAM sequence: AGG
ccaacacatgcctgtaggtg

SEQ ID NO: 70339 - DNA, 20 bp, Artificial Sequence
  Description of Artificial Sequence: Synthetic oligonucleotide
  Target: ATXN1; (-) strand; PAM type: NRG; PAM sequence: GAG
cccaacacatgcctgtaggt

SEQ ID NO: 70340 - DNA, 20 bp, Artificial Sequence
  Description of Artificial Sequence: Synthetic oligonucleotide
  Target: ATXN1; (-) strand; PAM type: NRG; PAM sequence: AGG
gctacccaacacatgcctgt

SEQ ID NO: 70341 - DNA, 20 bp, Artificial Sequence
  Description of Artificial Sequence: Synthetic oligonucleotide
  Target: ATXN1; (-) strand; PAM type: NRG; PAM sequence: TAG
cgctacccaacacatgcctg

SEQ ID NO: 70342 - DNA, 20 bp, Artificial Sequence
  Description of Artificial Sequence: Synthetic oligonucleotide
  Target: ATXN1; (-) strand; PAM type: NRG; PAM sequence: TAG
aagatgcatttctcagagca

SEQ ID NO: 70343 - DNA, 20 bp, Artificial Sequence
  Description of Artificial Sequence: Synthetic oligonucleotide
  Target: ATXN1; (-) strand; PAM type: NRG; PAM sequence: GAG
acgtgaagatgcatttctca

SEQ ID NO: 70344 - DNA, 20 bp, Artificial Sequence
  Description of Artificial Sequence: Synthetic oligonucleotide
  Target: ATXN1; (-) strand; PAM type: NRG; PAM sequence: CAG
tcacgtgaagatgcatttct

SEQ ID NO: 70345 - DNA, 20 bp, Artificial Sequence
  Description of Artificial Sequence: Synthetic oligonucleotide
  Target: ATXN1; (-) strand; PAM type: NRG; PAM sequence: AAG
tcacacaacagaatcacgtg

SEQ ID NO: 70346 - DNA, 20 bp, Artificial Sequence
  Description of Artificial Sequence: Synthetic oligonucleotide
  Target: ATXN1; (-) strand; PAM type: NRG; PAM sequence: CAG
actctacgatgttcacacaa

SEQ ID NO: 70347 - DNA, 20 bp, Artificial Sequence
  Description of Artificial Sequence: Synthetic oligonucleotide
  Target: ATXN1; (-) strand; PAM type: NRG; PAM sequence: TAG
cccatctaggtttgtgtgag

SEQ ID NO: 70348 - DNA, 20 bp, Artificial Sequence
  Description of Artificial Sequence: Synthetic oligonucleotide
  Target: ATXN1; (-) strand; PAM type: NRG; PAM sequence: GAG
tgtcccatctaggtttgtgt

SEQ ID NO: 70349 - DNA, 20 bp, Artificial Sequence
  Description of Artificial Sequence: Synthetic oligonucleotide
  Target: ATXN1; (-) strand; PAM type: NRG; PAM sequence: AGG
tgtagtaggctgtcccatct

SEQ ID NO: 70350 - DNA, 20 bp, Artificial Sequence
  Description of Artificial Sequence: Synthetic oligonucleotide
  Target: ATXN1; (-) strand; PAM type: NRG; PAM sequence: TAG
gtgtagtaggctgtcccatc

SEQ ID NO: 70351 - DNA, 20 bp, Artificial Sequence
  Description of Artificial Sequence: Synthetic oligonucleotide
  Target: ATXN1; (-) strand; PAM type: NRG; PAM sequence: AGG
atgtagcctagatgtgtagt

SEQ ID NO: 70352 - DNA, 20 bp, Artificial Sequence
  Description of Artificial Sequence: Synthetic oligonucleotide
  Target: ATXN1; (-) strand; PAM type: NRG; PAM sequence: TAG
catgtagcctagatgtgtag

SEQ ID NO: 70353 - DNA, 20 bp, Artificial Sequence
  Description of Artificial Sequence: Synthetic oligonucleotide
  Target: ATXN1; (-) strand; PAM type: NRG; PAM sequence: TAG
taccatgtagcctagatgtg

SEQ ID NO: 70354 - DNA, 20 bp, Artificial Sequence
  Description of Artificial Sequence: Synthetic oligonucleotide
  Target: ATXN1; (-) strand; PAM type: NRG; PAM sequence: TAG
atacattgtaccatgtagcc

SEQ ID NO: 70355 - DNA, 20 bp, Artificial Sequence
  Description of Artificial Sequence: Synthetic oligonucleotide
  Target: ATXN1; (-) strand; PAM type: NRG; PAM sequence: TAG
aagcaatacattgtaccatg

SEQ ID NO: 70356 - DNA, 20 bp, Artificial Sequence
  Description of Artificial Sequence: Synthetic oligonucleotide
  Target: ATXN1; (-) strand; PAM type: NRG; PAM sequence: AAG
agtgtaggtttgtagccggg

SEQ ID NO: 70357 - DNA, 20 bp, Artificial Sequence
  Description of Artificial Sequence: Synthetic oligonucleotide
  Target: ATXN1; (-) strand; PAM type: NRG; PAM sequence: GGG
tgcagtgtaggtttgtagcc

SEQ ID NO: 70358 - DNA, 20 bp, Artificial Sequence
  Description of Artificial Sequence: Synthetic oligonucleotide
  Target: ATXN1; (-) strand; PAM type: NRG; PAM sequence: CGG
atgcagtgtaggtttgtagc

SEQ ID NO: 70359 - DNA, 20 bp, Artificial Sequence
  Description of Artificial Sequence: Synthetic oligonucleotide
  Target: ATXN1; (-) strand; PAM type: NRG; PAM sequence: TAG
tatcatgcagtgtaggtttg

SEQ ID NO: 70360 - DNA, 20 bp, Artificial Sequence
  Description of Artificial Sequence: Synthetic oligonucleotide
  Target: ATXN1; (-) strand; PAM type: NRG; PAM sequence: AGG
agtacagtatcatgcagtgt

SEQ ID NO: 70361 - DNA, 20 bp, Artificial Sequence
  Description of Artificial Sequence: Synthetic oligonucleotide
  Target: ATXN1; (-) strand; PAM type: NRG; PAM sequence: TAG
cagtacagtatcatgcagtg

SEQ ID NO: 70362 - DNA, 20 bp, Artificial Sequence
  Description of Artificial Sequence: Synthetic oligonucleotide
  Target: ATXN1; (-) strand; PAM type: NRG; PAM sequence: CAG
gtattcagtacagtatcatg

SEQ ID NO: 70363 - DNA, 20 bp, Artificial Sequence
  Description of Artificial Sequence: Synthetic oligonucleotide
  Target: ATXN1; (-) strand; PAM type: NRG; PAM sequence: CAG
tttgcctgcagtattcagta

SEQ ID NO: 70364 - DNA, 20 bp, Artificial Sequence
  Description of Artificial Sequence: Synthetic oligonucleotide
  Target: ATXN1; (-) strand; PAM type: NRG; PAM sequence: CAG
atacatttgcctgcagtatt

SEQ ID NO: 70365 - DNA, 20 bp, Artificial Sequence
  Description of Artificial Sequence: Synthetic oligonucleotide
  Target: ATXN1; (-) strand; PAM type: NRG; PAM sequence: CAG
cattgtaatacatttgcctg

SEQ ID NO: 70366 - DNA, 20 bp, Artificial Sequence
  Description of Artificial Sequence: Synthetic oligonucleotide
  Target: ATXN1; (-) strand; PAM type: NRG; PAM sequence: AGG
actgtatcttttctatattt

SEQ ID NO: 70367 - DNA, 20 bp, Artificial Sequence
  Description of Artificial Sequence: Synthetic oligonucleotide
  Target: ATXN1; (-) strand; PAM type: NRG; PAM sequence: TAG
gactgtatcttttctatatt

SEQ ID NO: 70368 - DNA, 20 bp, Artificial Sequence
  Description of Artificial Sequence: Synthetic oligonucleotide
  Target: ATXN1; (-) strand; PAM type: NRG; PAM sequence: AGG
tcatgggaagtgccctatac

SEQ ID NO: 70369 - DNA, 20 bp, Artificial Sequence
  Description of Artificial Sequence: Synthetic oligonucleotide
  Target: ATXN1; (-) strand; PAM type: NRG; PAM sequence: CAG
ttcatgggaagtgccctata

SEQ ID NO: 70370 - DNA, 20 bp, Artificial Sequence
  Description of Artificial Sequence: Synthetic oligonucleotide
  Target: ATXN1; (-) strand; PAM type: NRG; PAM sequence: AAG
ctgcaagctccattcatggg

SEQ ID NO: 70371 - DNA, 20 bp, Artificial Sequence
  Description of Artificial Sequence: Synthetic oligonucleotide
  Target: ATXN1; (-) strand; PAM type: NRG; PAM sequence: GGG
atcctgcaagctccattcat

SEQ ID NO: 70372 - DNA, 20 bp, Artificial Sequence
  Description of Artificial Sequence: Synthetic oligonucleotide
  Target: ATXN1; (-) strand; PAM type: NRG; PAM sequence: TGG
aatcctgcaagctccattca

SEQ ID NO: 70373 - DNA, 20 bp, Artificial Sequence
  Description of Artificial Sequence: Synthetic oligonucleotide
  Target: ATXN1; (-) strand; PAM type: NRG; PAM sequence: AAG
agagcaacttccaatcctgc

SEQ ID NO: 70374 - DNA, 20 bp, Artificial Sequence
  Description of Artificial Sequence: Synthetic oligonucleotide
  Target: ATXN1; (-) strand; PAM type: NRG; PAM sequence: GAG
cccactcactgactcaccca

SEQ ID NO: 70375 - DNA, 20 bp, Artificial Sequence
  Description of Artificial Sequence: Synthetic oligonucleotide
  Target: ATXN1; (-) strand; PAM type: NRG; PAM sequence: CAG
cacccactcactgactcacc

SEQ ID NO: 70376 - DNA, 20 bp, Artificial Sequence
  Description of Artificial Sequence: Synthetic oligonucleotide
  Target: ATXN1; (-) strand; PAM type: NRG; PAM sequence: AGG
gtagtgtacagtaatgtcct

SEQ ID NO: 70377 - DNA, 20 bp, Artificial Sequence
  Description of Artificial Sequence: Synthetic oligonucleotide
  Target: ATXN1; (-) strand; PAM type: NRG; PAM sequence: TAG
agtagtgtacagtaatgtcc

SEQ ID NO: 70378 - DNA, 20 bp, Artificial Sequence
  Description of Artificial Sequence: Synthetic oligonucleotide
  Target: ATXN1; (-) strand; PAM type: NRG; PAM sequence: CAG
ataaagtctgcagtagtgta

SEQ ID NO: 70379 - DNA, 20 bp, Artificial Sequence
  Description of Artificial Sequence: Synthetic oligonucleotide
  Target: ATXN1; (-) strand; PAM type: NRG; PAM sequence: TAG
agtgtttataaagtctgcag

SEQ ID NO: 70380 - DNA, 20 bp, Artificial Sequence
  Description of Artificial Sequence: Synthetic oligonucleotide
  Target: ATXN1; (-) strand; PAM type: NRG; PAM sequence: CAG
tacagtgtttataaagtctg

SEQ ID NO: 70381 - DNA, 20 bp, Artificial Sequence
  Description of Artificial Sequence: Synthetic oligonucleotide
  Target: ATXN1; (-) strand; PAM type: NRG; PAM sequence: AAG
aagtgtatacagtgtttata

SEQ ID NO: 70382 - DNA, 20 bp, Artificial Sequence
  Description of Artificial Sequence: Synthetic oligonucleotide
  Target: ATXN1; (-) strand; PAM type: NRG; PAM sequence: CAG
tggtgcagcctaagtgtata

SEQ ID NO: 70383 - DNA, 20 bp, Artificial Sequence
  Description of Artificial Sequence: Synthetic oligonucleotide
  Target: ATXN1; (-) strand; PAM type: NRG; PAM sequence: AAG
aaataaatttggtgcagcct

SEQ ID NO: 70384 - DNA, 20 bp, Artificial Sequence
  Description of Artificial Sequence: Synthetic oligonucleotide
  Target: ATXN1; (-) strand; PAM type: NRG; PAM sequence: CAG
tttcaaaaataaatttggtg

SEQ ID NO: 70385 - DNA, 20 bp, Artificial Sequence
  Description of Artificial Sequence: Synthetic oligonucleotide
  Target: ATXN1; (-) strand; PAM type: NRG; PAM sequence: TGG
agaaatttcaaaaataaatt

SEQ ID NO: 70386 - DNA, 20 bp, Artificial Sequence
  Description of Artificial Sequence: Synthetic oligonucleotide
  Target: ATXN1; (-) strand; PAM type: NRG; PAM sequence: AAG
gtttaatttattattgaaga

SEQ ID NO: 70387 - DNA, 20 bp, Artificial Sequence
  Description of Artificial Sequence: Synthetic oligonucleotide
  Target: ATXN1; (-) strand; PAM type: NRG; PAM sequence: AAG
ctaagtttaatttattattg

SEQ ID NO: 70388 - DNA, 20 bp, Artificial Sequence
  Description of Artificial Sequence: Synthetic oligonucleotide
  Target: ATXN1; (-) strand; PAM type: NRG; PAM sequence: AAG
taaaaaagttacagtaagct

SEQ ID NO: 70389 - DNA, 20 bp, Artificial Sequence
  Description of Artificial Sequence: Synthetic oligonucleotide
  Target: ATXN1; (-) strand; PAM type: NRG; PAM sequence: AAG
taaagtaaaaaagttacagt

SEQ ID NO: 70390 - DNA, 20 bp, Artificial Sequence
  Description of Artificial Sequence: Synthetic oligonucleotide
  Target: ATXN1; (-) strand; PAM type: NRG; PAM sequence: CAG
tttataaagtaaaaaagtta

SEQ ID NO: 70391 - DNA, 20 bp, Artificial Sequence
  Description of Artificial Sequence: Synthetic oligonucleotide
  Target: ATXN1; (-) strand; PAM type: NRG; PAM sequence: AAG
aatgtgtttataaagtaaaa

SEQ ID NO: 70392 - DNA, 20 bp, Artificial Sequence
  Description of Artificial Sequence: Synthetic oligonucleotide
  Target: ATXN1; (-) strand; PAM type: NRG; PAM sequence: AAG
ttttaaataatgtgtttata

SEQ ID NO: 70393 - DNA, 20 bp, Artificial Sequence
  Description of Artificial Sequence: Synthetic oligonucleotide
  Target: ATXN1; (-) strand; PAM type: NRG; PAM sequence: AAG
gtattattacaagagtcgaa

SEQ ID NO: 70394 - DNA, 20 bp, Artificial Sequence
  Description of Artificial Sequence: Synthetic oligonucleotide
  Target: ATXN1; (-) strand; PAM type: NRG; PAM sequence: GAG
taagctaagtattattacaa

SEQ ID NO: 70395 - DNA, 20 bp, Artificial Sequence
  Description of Artificial Sequence: Synthetic oligonucleotide
  Target: ATXN1; (-) strand; PAM type: NRG; PAM sequence: AAG
tttaagctaagtattattac

SEQ ID NO: 70396 - DNA, 20 bp, Artificial Sequence
  Description of Artificial Sequence: Synthetic oligonucleotide
  Target: ATXN1; (-) strand; PAM type: NRG; PAM sequence: AAG
agtggatgatgttttaagct

SEQ ID NO: 70397 - DNA, 20 bp, Artificial Sequence
  Description of Artificial Sequence: Synthetic oligonucleotide
  Target: ATXN1; (-) strand; PAM type: NRG; PAM sequence: AAG
tttaaagtggatgatgtttt

SEQ ID NO: 70398 - DNA, 20 bp, Artificial Sequence
  Description of Artificial Sequence: Synthetic oligonucleotide
  Target: ATXN1; (-) strand; PAM type: NRG; PAM sequence: TGG
attttcgtacaactttaaag

SEQ ID NO: 70399 - DNA, 20 bp, Artificial Sequence
  Description of Artificial Sequence: Synthetic oligonucleotide
  Target: ATXN1; (-) strand; PAM type: NRG; PAM sequence: AAG
aatattttcgtacaacttta

SEQ ID NO: 70400 - DNA, 20 bp, Artificial Sequence
  Description of Artificial Sequence: Synthetic oligonucleotide
  Target: ATXN1; (-) strand; PAM type: NRG; PAM sequence: AAG
attgaataaagatataaaag

SEQ ID NO: 70401 - DNA, 20 bp, Artificial Sequence
  Description of Artificial Sequence: Synthetic oligonucleotide
  Target: ATXN1; (-) strand; PAM type: NRG; PAM sequence: AAG
tttattgaataaagatataa

SEQ ID NO: 70402 - DNA, 20 bp, Artificial Sequence
  Description of Artificial Sequence: Synthetic oligonucleotide
  Target: ATXN1; (-) strand; PAM type: NRG; PAM sequence: AAG
agaaaaatgtttattgaata

SEQ ID NO: 70403 - DNA, 20 bp, Artificial Sequence
  Description of Artificial Sequence: Synthetic oligonucleotide
  Target: ATXN1; (-) strand; PAM type: NRG; PAM sequence: TAG
aaattttttaaaaatgaaaa

SEQ ID NO: 70404 - DNA, 20 bp, Artificial Sequence
  Description of Artificial Sequence: Synthetic oligonucleotide
  Target: ATXN1; (-) strand; PAM type: NRG; PAM sequence: AAG
tagtattgttttaaaaaaaa

SEQ ID NO: 70405 - DNA, 20 bp, Artificial Sequence
  Description of Artificial Sequence: Synthetic oligonucleotide
  Target: ATXN1; (-) strand; PAM type: NRG; PAM sequence: TAG
gtgcaccactgctcctgcct

SEQ ID NO: 70406 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 70407 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 70408 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 70409 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 70410 - DNA, 20 bp, Artificial Sequence
  Description of Artificial Sequence: Synthetic oligonucleotide
  Target: ATXN1; (-) strand; PAM type: NRG; PAM sequence: AAG
ccacccgcctcggcctccca

SEQ ID NO: 70411 - DNA, 20 bp, Artificial Sequence
  Description of Artificial Sequence: Synthetic oligonucleotide
  Target: ATXN1; (-) strand; PAM type: NRG; PAM sequence: CGG
ctcaagcaatccacccgcct

SEQ ID NO: 70412 - DNA, 20 bp, Artificial Sequence
  Description of Artificial Sequence: Synthetic oligonucleotide
  Target: ATXN1; (-) strand; PAM type: NRG; PAM sequence: AAG
ggtctcaaactcctggcctc

SEQ ID NO: 70413 - DNA, 20 bp, Artificial Sequence
  Description of Artificial Sequence: Synthetic oligonucleotide
  Target: ATXN1; (-) strand; PAM type: NRG; PAM sequence: TGG
tcaggctggtctcaaactcc

SEQ ID NO: 70414 - DNA, 20 bp, Artificial Sequence
  Description of Artificial Sequence: Synthetic oligonucleotide
  Target: ATXN1; (-) strand; PAM type: NRG; PAM sequence: TGG
ttttactctgttggtcaggc

SEQ ID NO: 70415 - DNA, 20 bp, Artificial Sequence
  Description of Artificial Sequence: Synthetic oligonucleotide
  Target: ATXN1; (-) strand; PAM type: NRG; PAM sequence: AGG
ggagttttactctgttggtc

SEQ ID NO: 70416 - DNA, 20 bp, Artificial Sequence
  Description of Artificial Sequence: Synthetic oligonucleotide
  Target: ATXN1; (-) strand; PAM type: NRG; PAM sequence: CAG
cggagttttactctgttggt

SEQ ID NO: 70417 - DNA, 20 bp, Artificial Sequence
  Description of Artificial Sequence: Synthetic oligonucleotide
  Target: ATXN1; (-) strand; PAM type: NRG; PAM sequence: TGG
gagacggagttttactctgt

SEQ ID NO: 70418 - DNA, 20 bp, Artificial Sequence
  Description of Artificial Sequence: Synthetic oligonucleotide
  Target: ATXN1; (-) strand; PAM type: NRG; PAM sequence: GAG
ttgtatttttagcagagacg

SEQ ID NO: 70419 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagcagaga

SEQ ID NO: 70420 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagca

SEQ ID NO: 70421 - DNA, 20 bp, Artificial Sequence
  Description of Artificial Sequence: Synthetic oligonucleotide
  Target: ATXN1; (-) strand; PAM type: NRG; PAM sequence: CAG
gctaatttttgtatttttag

SEQ ID NO: 70422 - DNA, 20 bp, Artificial Sequence
  Description of Artificial Sequence: Synthetic oligonucleotide
  Target: ATXN1; (-) strand; PAM type: NRG; PAM sequence: TAG
ccggctaatttttgtatttt

SEQ ID NO: 70423 - DNA, 20 bp, Artificial Sequence
  Description of Artificial Sequence: Synthetic oligonucleotide
  Target: ATXN1; (-) strand; PAM type: NRG; PAM sequence: CGG
acaggcatgcaccaccacgc

SEQ ID NO: 70424 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggattac

SEQ ID NO: 70425 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgggatta

SEQ ID NO: 70426 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagct

SEQ ID NO: 70427 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagc

SEQ ID NO: 70428 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 70429 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 70430 - DNA, 20 bp, Artificial Sequence
  Description of Artificial Sequence: Synthetic oligonucleotide
  Target: ATXN1; (-) strand; PAM type: NRG; PAM sequence: CAG
ttcaagccattctcctgcct

SEQ ID NO: 70431 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcctgggttc

SEQ ID NO: 70432 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctgcctcct

SEQ ID NO: 70433 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctctgcctcc

SEQ ID NO: 70434 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 70435 - DNA, 20 bp, Artificial Sequence
  Description of Artificial Sequence: Synthetic oligonucleotide
  Target: ATXN1; (-) strand; PAM type: NRG; PAM sequence: CAG
ttgtcgcccaggctggagtg

SEQ ID NO: 70436 - DNA, 20 bp, Artificial Sequence
  Description of Artificial Sequence: Synthetic oligonucleotide
  Target: ATXN1; (-) strand; PAM type: NRG; PAM sequence: GAG
ttactttgtcgcccaggctg

SEQ ID NO: 70437 - DNA, 20 bp, Artificial Sequence
  Description of Artificial Sequence: Synthetic oligonucleotide
  Target: ATXN1; (-) strand; PAM type: NRG; PAM sequence: TGG
ccttactttgtcgcccaggc

SEQ ID NO: 70438 - DNA, 20 bp, Artificial Sequence
  Description of Artificial Sequence: Synthetic oligonucleotide
  Target: ATXN1; (-) strand; PAM type: NRG; PAM sequence: AGG
acagccttactttgtcgccc

SEQ ID NO: 70439 - DNA, 20 bp, Artificial Sequence
  Description of Artificial Sequence: Synthetic oligonucleotide
  Target: ATXN1; (-) strand; PAM type: NRG; PAM sequence: CAG
gacagccttactttgtcgcc

SEQ ID NO: 70440 - DNA, 20 bp, Artificial Sequence
  Description of Artificial Sequence: Synthetic oligonucleotide
  Target: ATXN1; (-) strand; PAM type: NRG; PAM sequence: CAG
tatttatttatttattgaga

SEQ ID NO: 70441 - DNA, 20 bp, Artificial Sequence
  Description of Artificial Sequence: Synthetic oligonucleotide
  Target: ATXN1; (-) strand; PAM type: NRG; PAM sequence: GAG
tatgtatttatttatttatt

SEQ ID NO: 70442 - DNA, 20 bp, Artificial Sequence
  Description of Artificial Sequence: Synthetic oligonucleotide
  Target: ATXN1; (-) strand; PAM type: NRG; PAM sequence: TAG
actaatgcgtgtttgtttct

SEQ ID NO: 70443 - DNA, 20 bp, Artificial Sequence
  Description of Artificial Sequence: Synthetic oligonucleotide
  Target: ATXN1; (-) strand; PAM type: NRG; PAM sequence: TAG
atcctgaccctgtataggcc

SEQ ID NO: 70444 - DNA, 20 bp, Artificial Sequence
  Description of Artificial Sequence: Synthetic oligonucleotide
  Target: ATXN1; (-) strand; PAM type: NRG; PAM sequence: AGG
gaatgatcctgaccctgtat

SEQ ID NO: 70445 - DNA, 20 bp, Artificial Sequence
  Description of Artificial Sequence: Synthetic oligonucleotide
  Target: ATXN1; (-) strand; PAM type: NRG; PAM sequence: TAG
tgaatgatcctgaccctgta

SEQ ID NO: 70446 - DNA, 20 bp, Artificial Sequence
  Description of Artificial Sequence: Synthetic oligonucleotide
  Target: ATXN1; (-) strand; PAM type: NRG; PAM sequence: AGG
gggacaagatgtggaggtag

SEQ ID NO: 70447 - DNA, 20 bp, Artificial Sequence
  Description of Artificial Sequence: Synthetic oligonucleotide
  Target: ATXN1; (-) strand; PAM type: NRG; PAM sequence: GAG
tgggacaagatgtggaggta

SEQ ID NO: 70448 - DNA, 20 bp, Artificial Sequence
  Description of Artificial Sequence: Synthetic oligonucleotide
  Target: ATXN1; (-) strand; PAM type: NRG; PAM sequence: TAG
agtgggacaagatgtggagg

SEQ ID NO: 70449 - DNA, 20 bp, Artificial Sequence
  Description of Artificial Sequence: Synthetic oligonucleotide
  Target: ATXN1; (-) strand; PAM type: NRG; PAM sequence: AGG
ctcagtgggacaagatgtgg

SEQ ID NO: 70450 - DNA, 20 bp, Artificial Sequence
  Description of Artificial Sequence: Synthetic oligonucleotide
  Target: ATXN1; (-) strand; PAM type: NRG; PAM sequence: GAG
tctcagtgggacaagatgtg

SEQ ID NO: 70451 - DNA, 20 bp, Artificial Sequence
  Description of Artificial Sequence: Synthetic oligonucleotide
  Target: ATXN1; (-) strand; PAM type: NRG; PAM sequence: TGG
cctctcagtgggacaagatg

SEQ ID NO: 70452 - DNA, 20 bp, Artificial Sequence
  Description of Artificial Sequence: Synthetic oligonucleotide
  Target: ATXN1; (-) strand; PAM type: NRG; PAM sequence: AAG
tgaagacctctcagtgggac

SEQ ID NO: 70453 - DNA, 20 bp, Artificial Sequence
  Description of Artificial Sequence: Synthetic oligonucleotide
  Target: ATXN1; (-) strand; PAM type: NRG; PAM sequence: GGG
tgccctgaagacctctcagt

SEQ ID NO: 70454 - DNA, 20 bp, Artificial Sequence
  Description of Artificial Sequence: Synthetic oligonucleotide
  Target: ATXN1; (-) strand; PAM type: NRG; PAM sequence: TGG
ttgccctgaagacctctcag

SEQ ID NO: 70455 - DNA, 20 bp, Artificial Sequence
  Description of Artificial Sequence: Synthetic oligonucleotide
  Target: ATXN1; (-) strand; PAM type: NRG; PAM sequence: CAG
ttattgccctgaagacctct

SEQ ID NO: 70456 - DNA, 20 bp, Artificial Sequence
  Description of Artificial Sequence: Synthetic oligonucleotide
  Target: ATXN1; (-) strand; PAM type: NRG; PAM sequence: AAG
ccatgtgtgttattgccctg

SEQ ID NO: 70457 - DNA, 20 bp, Artificial Sequence
  Description of Artificial Sequence: Synthetic oligonucleotide
  Target: ATXN1; (-) strand; PAM type: NRG; PAM sequence: AGG
ctgttgtcataggagatgac

SEQ ID NO: 70458 - DNA, 20 bp, Artificial Sequence
  Description of Artificial Sequence: Synthetic oligonucleotide
  Target: ATXN1; (-) strand; PAM type: NRG; PAM sequence: CAG
actgttgtcataggagatga

SEQ ID NO: 70459 - DNA, 20 bp, Artificial Sequence
  Description of Artificial Sequence: Synthetic oligonucleotide
  Target: ATXN1; (-) strand; PAM type: NRG; PAM sequence: GAG
agaaggcactgttgtcatag

SEQ ID NO: 70460 - DNA, 20 bp, Artificial Sequence
  Description of Artificial Sequence: Synthetic oligonucleotide
  Target: ATXN1; (-) strand; PAM type: NRG; PAM sequence: AGG
gaagaaggcactgttgtcat

SEQ ID NO: 70461 - DNA, 20 bp, Artificial Sequence
  Description of Artificial Sequence: Synthetic oligonucleotide
  Target: ATXN1; (-) strand; PAM type: NRG; PAM sequence: TAG
agaagaaggcactgttgtca

SEQ ID NO: 70462 - DNA, 20 bp, Artificial Sequence
  Description of Artificial Sequence: Synthetic oligonucleotide
  Target: ATXN1; (-) strand; PAM type: NRG; PAM sequence: AGG
tccatagatgtgtaagaaga

SEQ ID NO: 70463 - DNA, 20 bp, Artificial Sequence
  Description of Artificial Sequence: Synthetic oligonucleotide
  Target: ATXN1; (-) strand; PAM type: NRG; PAM sequence: AAG
ttccatagatgtgtaagaag

SEQ ID NO: 70464 - DNA, 20 bp, Artificial Sequence
  Description of Artificial Sequence: Synthetic oligonucleotide
  Target: ATXN1; (-) strand; PAM type: NRG; PAM sequence: AAG
tccttccatagatgtgtaag

SEQ ID NO: 70465 - DNA, 20 bp, Artificial Sequence
  Description of Artificial Sequence: Synthetic oligonucleotide
  Target: ATXN1; (-) strand; PAM type: NRG; PAM sequence: AAG
aggtccttccatagatgtgt

SEQ ID NO: 70466 - DNA, 20 bp, Artificial Sequence
  Description of Artificial Sequence: Synthetic oligonucleotide
  Target: ATXN1; (-) strand; PAM type: NRG; PAM sequence: TAG
acttcaggcaggtccttcca

SEQ ID NO: 70467 - DNA, 20 bp, Artificial Sequence
  Description of Artificial Sequence: Synthetic oligonucleotide
  Target: ATXN1; (-) strand; PAM type: NRG; PAM sequence: AGG
actgcaaaccaacttcaggc

SEQ ID NO: 70468 - DNA, 20 bp, Artificial Sequence
  Description of Artificial Sequence: Synthetic oligonucleotide
  Target: ATXN1; (-) strand; PAM type: NRG; PAM sequence: CAG
aactgcaaaccaacttcagg

SEQ ID NO: 70469 - DNA, 20 bp, Artificial Sequence
  Description of Artificial Sequence: Synthetic oligonucleotide
  Target: ATXN1; (-) strand; PAM type: NRG; PAM sequence: AGG
gttaactgcaaaccaacttc

SEQ ID NO: 70470 - DNA, 20 bp, Artificial Sequence
  Description of Artificial Sequence: Synthetic oligonucleotide
  Target: ATXN1; (-) strand; PAM type: NRG; PAM sequence: CAG
agttaactgcaaaccaactt

SEQ ID NO: 70471 - DNA, 20 bp, Artificial Sequence
  Description of Artificial Sequence: Synthetic oligonucleotide
  Target: ATXN1; (-) strand; PAM type: NRG; PAM sequence: AAG
ctacttatttaaaaaaaaaa

SEQ ID NO: 70472 - DNA, 20 bp, Artificial Sequence
  Description of Artificial Sequence: Synthetic oligonucleotide
  Target: ATXN1; (-) strand; PAM type: NRG; PAM sequence: TAG
tatacttttgatcattgttt

SEQ ID NO: 70473 - DNA, 20 bp, Artificial Sequence
  Description of Artificial Sequence: Synthetic oligonucleotide
  Target: ATXN1; (-) strand; PAM type: NRG; PAM sequence: TGG
tggtaataaacaactgttat

SEQ ID NO: 70474 - DNA, 20 bp, Artificial Sequence
  Description of Artificial Sequence: Synthetic oligonucleotide
  Target: ATXN1; (-) strand; PAM type: NRG; PAM sequence: TGG
cagcacataatgcttgataa

SEQ ID NO: 70475 - DNA, 20 bp, Artificial Sequence
  Description of Artificial Sequence: Synthetic oligonucleotide
  Target: ATXN1; (-) strand; PAM type: NRG; PAM sequence: CAG
agagcacatgcaattcggta

SEQ ID NO: 70476 - DNA, 20 bp, Artificial Sequence
  Description of Artificial Sequence: Synthetic oligonucleotide
  Target: ATXN1; (-) strand; PAM type: NRG; PAM sequence: CGG
agagtagagcacatgcaatt

SEQ ID NO: 70477 - DNA, 20 bp, Artificial Sequence
  Description of Artificial Sequence: Synthetic oligonucleotide
  Target: ATXN1; (-) strand; PAM type: NRG; PAM sequence: GAG
ctgccagtcatgtaagagta

SEQ ID NO: 70478 - DNA, 20 bp, Artificial Sequence
  Description of Artificial Sequence: Synthetic oligonucleotide
  Target: ATXN1; (-) strand; PAM type: NRG; PAM sequence: TAG
tgctgccagtcatgtaagag

SEQ ID NO: 70479 - DNA, 20 bp, Artificial Sequence
  Description of Artificial Sequence: Synthetic oligonucleotide
  Target: ATXN1; (-) strand; PAM type: NRG; PAM sequence: GAG
ctgtgctgccagtcatgtaa

SEQ ID NO: 70480 - DNA, 20 bp, Artificial Sequence
  Description of Artificial Sequence: Synthetic oligonucleotide
  Target: ATXN1; (-) strand; PAM type: NRG; PAM sequence: AAG
tactgtgctgccagtcatgt

SEQ ID NO: 70481 - DNA, 20 bp, Artificial Sequence
  Description of Artificial Sequence: Synthetic oligonucleotide
  Target: ATXN1; (-) strand; PAM type: NRG; PAM sequence: CAG
ctgcaaccctactgtgctgc

SEQ ID NO: 70482 - DNA, 20 bp, Artificial Sequence
  Description of Artificial Sequence: Synthetic oligonucleotide
  Target: ATXN1; (-) strand; PAM type: NRG; PAM sequence: TAG
ttgtagccattgtaatgtcc

SEQ ID NO: 70483 - DNA, 20 bp, Artificial Sequence
  Description of Artificial Sequence: Synthetic oligonucleotide
  Target: ATXN1; (-) strand; PAM type: NRG; PAM sequence: TAG
tttatcgcctagtaatgttg

SEQ ID NO: 70484 - DNA, 20 bp, Artificial Sequence
  Description of Artificial Sequence: Synthetic oligonucleotide
  Target: ATXN1; (-) strand; PAM type: NRG; PAM sequence: TAG
gctgaagaatttttatcgcc

SEQ ID NO: 70485 - DNA, 20 bp, Artificial Sequence
  Description of Artificial Sequence: Synthetic oligonucleotide
  Target: ATXN1; (-) strand; PAM type: NRG; PAM sequence: AAG
ataagattataatgaagctg

SEQ ID NO: 70486 - DNA, 20 bp, Artificial Sequence
  Description of Artificial Sequence: Synthetic oligonucleotide
  Target: ATXN1; (-) strand; PAM type: NRG; PAM sequence: AAG
agtcccataagattataatg

SEQ ID NO: 70487 - DNA, 20 bp, Artificial Sequence
  Description of Artificial Sequence: Synthetic oligonucleotide
  Target: ATXN1; (-) strand; PAM type: NRG; PAM sequence: AAG
atatatcatgatagtcccat

SEQ ID NO: 70488 - DNA, 20 bp, Artificial Sequence
  Description of Artificial Sequence: Synthetic oligonucleotide
  Target: ATXN1; (-) strand; PAM type: NRG; PAM sequence: TAG
gtgggtcacatatatcatga

SEQ ID NO: 70489 - DNA, 20 bp, Artificial Sequence
  Description of Artificial Sequence: Synthetic oligonucleotide
  Target: ATXN1; (-) strand; PAM type: NRG; PAM sequence: GGG
acgacatttgggtcaacagt

SEQ ID NO: 70490 - DNA, 20 bp, Artificial Sequence
  Description of Artificial Sequence: Synthetic oligonucleotide
  Target: ATXN1; (-) strand; PAM type: NRG; PAM sequence: TGG
aacgacatttgggtcaacag

SEQ ID NO: 70491 - DNA, 20 bp, Artificial Sequence
  Description of Artificial Sequence: Synthetic oligonucleotide
  Target: ATXN1; (-) strand; PAM type: NRG; PAM sequence: CAG
cataacgacatttgggtcaa

SEQ ID NO: 70492 - DNA, 20 bp, Artificial Sequence
  Description of Artificial Sequence: Synthetic oligonucleotide
  Target: ATXN1; (-) strand; PAM type: NRG; PAM sequence: GGG
tgtgccgcataacgacattt

SEQ ID NO: 70493 - DNA, 20 bp, Artificial Sequence
  Description of Artificial Sequence: Synthetic oligonucleotide
  Target: ATXN1; (-) strand; PAM type: NRG; PAM sequence: TGG
atgtgccgcataacgacatt

SEQ ID NO: 70494 - DNA, 20 bp, Artificial Sequence
  Description of Artificial Sequence: Synthetic oligonucleotide
  Target: ATXN1; (-) strand; PAM type: NRG; PAM sequence: CAG
ccctcacttatggcttttta

SEQ ID NO: 70495 - DNA, 20 bp, Artificial Sequence
  Description of Artificial Sequence: Synthetic oligonucleotide
  Target: ATXN1; (-) strand; PAM type: NRG; PAM sequence: TGG
ggttccgcttccctcactta

SEQ ID NO: 70496 - DNA, 20 bp, Artificial Sequence
  Description of Artificial Sequence: Synthetic oligonucleotide
  Target: ATXN1; (-) strand; PAM type: NRG; PAM sequence: TGG
acagacacctatatgggagc

SEQ ID NO: 70497 - DNA, 20 bp, Artificial Sequence
  Description of Artificial Sequence: Synthetic oligonucleotide
  Target: ATXN1; (-) strand; PAM type: NRG; PAM sequence: GAG
gacaacagacacctatatgg

SEQ ID NO: 70498 - DNA, 20 bp, Artificial Sequence
  Description of Artificial Sequence: Synthetic oligonucleotide
  Target: ATXN1; (-) strand; PAM type: NRG; PAM sequence: GGG
gggacaacagacacctatat

SEQ ID NO: 70499 - DNA, 20 bp, Artificial Sequence
  Description of Artificial Sequence: Synthetic oligonucleotide
  Target: ATXN1; (-) strand; PAM type: NRG; PAM sequence: TGG
tgggacaacagacacctata

SEQ ID NO: 70500 - DNA, 20 bp, Artificial Sequence
  Description of Artificial Sequence: Synthetic oligonucleotide
  Target: ATXN1; (-) strand; PAM type: NRG; PAM sequence: CAG
tggtatcctctgtgggacaa

SEQ ID NO: 70501 - DNA, 20 bp, Artificial Sequence
  Description of Artificial Sequence: Synthetic oligonucleotide
  Target: ATXN1; (-) strand; PAM type: NRG; PAM sequence: GGG
gcatcggtggtatcctctgt

SEQ ID NO: 70502 - DNA, 20 bp, Artificial Sequence
  Description of Artificial Sequence: Synthetic oligonucleotide
  Target: ATXN1; (-) strand; PAM type: NRG; PAM sequence: TGG
ggcatcggtggtatcctctg

SEQ ID NO: 70503 - DNA, 20 bp, Artificial Sequence
  Description of Artificial Sequence: Synthetic oligonucleotide
  Target: ATXN1; (-) strand; PAM type: NRG; PAM sequence: TGG
tggacaacctggggcatcgg

SEQ ID NO: 70504 - DNA, 20 bp, Artificial Sequence
  Description of Artificial Sequence: Synthetic oligonucleotide
  Target: ATXN1; (-) strand; PAM type: NRG; PAM sequence: CGG
tagtggacaacctggggcat

SEQ ID NO: 70505 - DNA, 20 bp, Artificial Sequence
  Description of Artificial Sequence: Synthetic oligonucleotide
  Target: ATXN1; (-) strand; PAM type: NRG; PAM sequence: GGG
aagcagtagtggacaacctg

SEQ ID NO: 70506 - DNA, 20 bp, Artificial Sequence
  Description of Artificial Sequence: Synthetic oligonucleotide
  Target: ATXN1; (-) strand; PAM type: NRG; PAM sequence: GGG
taagcagtagtggacaacct

SEQ ID NO: 70507 - DNA, 20 bp, Artificial Sequence
  Description of Artificial Sequence: Synthetic oligonucleotide
  Target: ATXN1; (-) strand; PAM type: NRG; PAM sequence: TGG
ttaagcagtagtggacaacc

SEQ ID NO: 70508 - DNA, 20 bp, Artificial Sequence
  Description of Artificial Sequence: Synthetic oligonucleotide
  Target: ATXN1; (-) strand; PAM type: NRG; PAM sequence: TGG
atgtgccctttaagcagtag

SEQ ID NO: 70509 - DNA, 20 bp, Artificial Sequence
  Description of Artificial Sequence: Synthetic oligonucleotide
  Target: ATXN1; (-) strand; PAM type: NRG; PAM sequence: TAG
tgaatgtgccctttaagcag

SEQ ID NO: 70510 - DNA, 20 bp, Artificial Sequence
  Description of Artificial Sequence: Synthetic oligonucleotide
  Target: ATXN1; (-) strand; PAM type: NRG; PAM sequence: CAG
tcttgaatgtgccctttaag

SEQ ID NO: 70511 - DNA, 20 bp, Artificial Sequence
  Description of Artificial Sequence: Synthetic oligonucleotide
  Target: ATXN1; (-) strand; PAM type: NRG; PAM sequence: AAG
tattcttgaatgtgcccttt

SEQ ID NO: 70512 - DNA, 20 bp, Artificial Sequence
  Description of Artificial Sequence: Synthetic oligonucleotide
  Target: ATXN1; (-) strand; PAM type: NRG; PAM sequence: CAG
cgtaagccgctgcacctggc

SEQ ID NO: 70513 - DNA, 20 bp, Artificial Sequence
  Description of Artificial Sequence: Synthetic oligonucleotide
  Target: ATXN1; (-) strand; PAM type: NRG; PAM sequence: TGG
caggcgtaagccgctgcacc

SEQ ID NO: 70514 - DNA, 20 bp, Artificial Sequence
  Description of Artificial Sequence: Synthetic oligonucleotide
  Target: ATXN1; (-) strand; PAM type: NRG; PAM sequence: AAG
agtgctgggattacaggcgt

SEQ ID NO: 70515 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 70516 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 70517 - DNA, 20 bp, Artificial Sequence
  Description of Artificial Sequence: Synthetic oligonucleotide
  Target: ATXN1; (-) strand; PAM type: NRG; PAM sequence: GGG
tctctgcctcccaaagtgct

SEQ ID NO: 70518 - DNA, 20 bp, Artificial Sequence
  Description of Artificial Sequence: Synthetic oligonucleotide
  Target: ATXN1; (-) strand; PAM type: NRG; PAM sequence: TGG
atctctgcctcccaaagtgc

SEQ ID NO: 70519 - DNA, 20 bp, Artificial Sequence
  Description of Artificial Sequence: Synthetic oligonucleotide
  Target: ATXN1; (-) strand; PAM type: NRG; PAM sequence: AAG
ccgcccatctctgcctccca

SEQ ID NO: 70520 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcccagcctc

SEQ ID NO: 70521 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcccagcct

SEQ ID NO: 70522 - DNA, 20 bp, Artificial Sequence
  Description of Artificial Sequence: Synthetic oligonucleotide
  Target: ATXN1; (-) strand; PAM type: NRG; PAM sequence: CAG
tcaggctggtctcgaactcc

SEQ ID NO: 70523 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggtcaggc

SEQ ID NO: 70524 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggtc

SEQ ID NO: 70525 - DNA, 20 bp, Artificial Sequence
  Description of Artificial Sequence: Synthetic oligonucleotide
  Target: ATXN1; (-) strand; PAM type: NRG; PAM sequence: CAG
cggggtttcaccatgttggt

SEQ ID NO: 70526 - DNA, 20 bp, Artificial Sequence
  Description of Artificial Sequence: Synthetic oligonucleotide
  Target: ATXN1; (-) strand; PAM type: NRG; PAM sequence: TGG
gagacggggtttcaccatgt

SEQ ID NO: 70527 - DNA, 20 bp, Artificial Sequence
  Description of Artificial Sequence: Synthetic oligonucleotide
  Target: ATXN1; (-) strand; PAM type: NRG; PAM sequence: GGG
ttgcatttttagtagagacg

SEQ ID NO: 70528 - DNA, 20 bp, Artificial Sequence
  Description of Artificial Sequence: Synthetic oligonucleotide
  Target: ATXN1; (-) strand; PAM type: NRG; PAM sequence: GGG
tttgcatttttagtagagac

SEQ ID NO: 70529 - DNA, 20 bp, Artificial Sequence
  Description of Artificial Sequence: Synthetic oligonucleotide
  Target: ATXN1; (-) strand; PAM type: NRG; PAM sequence: CGG
ttttgcatttttagtagaga

SEQ ID NO: 70530 - DNA, 20 bp, Artificial Sequence
  Description of Artificial Sequence: Synthetic oligonucleotide
  Target: ATXN1; (-) strand; PAM type: NRG; PAM sequence: GAG
ctaattttgcatttttagta

SEQ ID NO: 70531 - DNA, 20 bp, Artificial Sequence
  Description of Artificial Sequence: Synthetic oligonucleotide
  Target: ATXN1; (-) strand; PAM type: NRG; PAM sequence: TAG
tgctaattttgcatttttag

SEQ ID NO: 70532 - DNA, 20 bp, Artificial Sequence
  Description of Artificial Sequence: Synthetic oligonucleotide
  Target: ATXN1; (-) strand; PAM type: NRG; PAM sequence: TAG
ccctgctaattttgcatttt

SEQ ID NO: 70533 - DNA, 20 bp, Artificial Sequence
  Description of Artificial Sequence: Synthetic oligonucleotide
  Target: ATXN1; (-) strand; PAM type: NRG; PAM sequence: GGG
tcctgagtagctgggattac

SEQ ID NO: 70534 - DNA, 20 bp, Artificial Sequence
  Description of Artificial Sequence: Synthetic oligonucleotide
  Target: ATXN1; (-) strand; PAM type: NRG; PAM sequence: CGG
ctcctgagtagctgggatta

SEQ ID NO: 70535 - DNA, 20 bp, Artificial Sequence
  Description of Artificial Sequence: Synthetic oligonucleotide
  Target: ATXN1; (-) strand; PAM type: NRG; PAM sequence: GGG
cctgagcctcctgagtagct

SEQ ID NO: 70536 - DNA, 20 bp, Artificial Sequence
  Description of Artificial Sequence: Synthetic oligonucleotide
  Target: ATXN1; (-) strand; PAM type: NRG; PAM sequence: TGG
gcctgagcctcctgagtagc

SEQ ID NO: 70537 - DNA, 20 bp, Artificial Sequence
  Description of Artificial Sequence: Synthetic oligonucleotide
  Target: ATXN1; (-) strand; PAM type: NRG; PAM sequence: TAG
tactgcctgagcctcctgag

SEQ ID NO: 70538 - DNA, 20 bp, Artificial Sequence
  Description of Artificial Sequence: Synthetic oligonucleotide
  Target: ATXN1; (-) strand; PAM type: NRG; PAM sequence: GAG
ttctactgcctgagcctcct

SEQ ID NO: 70539 - DNA, 20 bp, Artificial Sequence
  Description of Artificial Sequence: Synthetic oligonucleotide
  Target: ATXN1; (-) strand; PAM type: NRG; PAM sequence: GAG
ttcaagttattctactgcct

SEQ ID NO: 70540 - DNA, 20 bp, Artificial Sequence
  Description of Artificial Sequence: Synthetic oligonucleotide
  Target: ATXN1; (-) strand; PAM type: NRG; PAM sequence: AAG
caatctttgctcctgagttc

SEQ ID NO: 70541 - DNA, 20 bp, Artificial Sequence
  Description of Artificial Sequence: Synthetic oligonucleotide
  Target: ATXN1; (-) strand; PAM type: NRG; PAM sequence: GAG
tcaccacaatctttgctcct

SEQ ID NO: 70542 - DNA, 20 bp, Artificial Sequence
  Description of Artificial Sequence: Synthetic oligonucleotide
  Target: ATXN1; (-) strand; PAM type: NRG; PAM sequence: CGG
ggagtgcaatggtgcgatct

SEQ ID NO: 70543 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcaa

SEQ ID NO: 70544 - DNA, 20 bp, Artificial Sequence
  Description of Artificial Sequence: Synthetic oligonucleotide
  Target: ATXN1; (-) strand; PAM type: NRG; PAM sequence: GAG
cgctcttgttgcccaggctg

SEQ ID NO: 70545 - DNA, 20 bp, Artificial Sequence
  Description of Artificial Sequence: Synthetic oligonucleotide
  Target: ATXN1; (-) strand; PAM type: NRG; PAM sequence: TGG
ttcgctcttgttgcccaggc

SEQ ID NO: 70546 - DNA, 20 bp, Artificial Sequence
  Description of Artificial Sequence: Synthetic oligonucleotide
  Target: ATXN1; (-) strand; PAM type: NRG; PAM sequence: AGG
gagtttcgctcttgttgccc

SEQ ID NO: 70547 - DNA, 20 bp, Artificial Sequence
  Description of Artificial Sequence: Synthetic oligonucleotide
  Target: ATXN1; (-) strand; PAM type: NRG; PAM sequence: CAG
agagtttcgctcttgttgcc

SEQ ID NO: 70548 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 70549 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaga

SEQ ID NO: 70550 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 70551 - DNA, 20 bp, Artificial Sequence
  Description of Artificial Sequence: Synthetic oligonucleotide
  Target: ATXN1; (-) strand; PAM type: NRG; PAM sequence: TGG
ctcccacttatgagtgagaa

SEQ ID NO: 70552 - DNA, 20 bp, Artificial Sequence
  Description of Artificial Sequence: Synthetic oligonucleotide
  Target: ATXN1; (-) strand; PAM type: NRG; PAM sequence: GAG
ttcaactcccacttatgagt

SEQ ID NO: 70553 - DNA, 20 bp, Artificial Sequence
  Description of Artificial Sequence: Synthetic oligonucleotide
  Target: ATXN1; (-) strand; PAM type: NRG; PAM sequence: GAG
atttttcaactcccacttat

SEQ ID NO: 70554 - DNA, 20 bp, Artificial Sequence
  Description of Artificial Sequence: Synthetic oligonucleotide
  Target: ATXN1; (-) strand; PAM type: NRG; PAM sequence: CGG
ccccagtccccaacagaccc

SEQ ID NO: 70555 - DNA, 20 bp, Artificial Sequence
  Description of Artificial Sequence: Synthetic oligonucleotide
  Target: ATXN1; (-) strand; PAM type: NRG; PAM sequence: CAG
ctccccaccccagtccccaa

SEQ ID NO: 70556 - DNA, 20 bp, Artificial Sequence
  Description of Artificial Sequence: Synthetic oligonucleotide
  Target: ATXN1; (-) strand; PAM type: NRG; PAM sequence: CAG
gttccctcccctccccaccc

SEQ ID NO: 70557 - DNA, 20 bp, Artificial Sequence
  Description of Artificial Sequence: Synthetic oligonucleotide
  Target: ATXN1; (-) strand; PAM type: NRG; PAM sequence: AGG
cacctattaacctgtcatct

SEQ ID NO: 70558 - DNA, 20 bp, Artificial Sequence
  Description of Artificial Sequence: Synthetic oligonucleotide
  Target: ATXN1; (-) strand; PAM type: NRG; PAM sequence: TAG
gcacctattaacctgtcatc

SEQ ID NO: 70559 - DNA, 20 bp, Artificial Sequence
  Description of Artificial Sequence: Synthetic oligonucleotide
  Target: ATXN1; (-) strand; PAM type: NRG; PAM sequence: TGG
taggtatacatgtgttctgg

SEQ ID NO: 70560 - DNA, 20 bp, Artificial Sequence
  Description of Artificial Sequence: Synthetic oligonucleotide
  Target: ATXN1; (-) strand; PAM type: NRG; PAM sequence: TGG
gcataggtatacatgtgttc

SEQ ID NO: 70561 - DNA, 20 bp, Artificial Sequence
  Description of Artificial Sequence: Synthetic oligonucleotide
  Target: ATXN1; (-) strand; PAM type: NRG; PAM sequence: AGG
aacatgcaggtctgttgcat

SEQ ID NO: 70562 - DNA, 20 bp, Artificial Sequence
  Description of Artificial Sequence: Synthetic oligonucleotide
  Target: ATXN1; (-) strand; PAM type: NRG; PAM sequence: TAG
gaacatgcaggtctgttgca

SEQ ID NO: 70563 - DNA, 20 bp, Artificial Sequence
  Description of Artificial Sequence: Synthetic oligonucleotide
  Target: ATXN1; (-) strand; PAM type: NRG; PAM sequence: AGG
ggtacatatgtagaacatgc

SEQ ID NO: 70564 - DNA, 20 bp, Artificial Sequence
  Description of Artificial Sequence: Synthetic oligonucleotide
  Target: ATXN1; (-) strand; PAM type: NRG; PAM sequence: CAG
gggtacatatgtagaacatg

SEQ ID NO: 70565 - DNA, 20 bp, Artificial Sequence
  Description of Artificial Sequence: Synthetic oligonucleotide
  Target: ATXN1; (-) strand; PAM type: NRG; PAM sequence: TAG
taagttctggggtacatatg

SEQ ID NO: 70566 - DNA, 20 bp, Artificial Sequence
  Description of Artificial Sequence: Synthetic oligonucleotide
  Target: ATXN1; (-) strand; PAM type: NRG; PAM sequence: GGG
ttattttactttaagttctg

SEQ ID NO: 70567 - DNA, 20 bp, Artificial Sequence
  Description of Artificial Sequence: Synthetic oligonucleotide
  Target: ATXN1; (-) strand; PAM type: NRG; PAM sequence: GGG
tttattttactttaagttct

SEQ ID NO: 70568 - DNA, 20 bp, Artificial Sequence
  Description of Artificial Sequence: Synthetic oligonucleotide
  Target: ATXN1; (-) strand; PAM type: NRG; PAM sequence: TGG
atttattttactttaagttc

SEQ ID NO: 70569 - DNA, 20 bp, Artificial Sequence
  Description of Artificial Sequence: Synthetic oligonucleotide
  Target: ATXN1; (-) strand; PAM type: NRG; PAM sequence: AAG
ttatttatttattttacttt

SEQ ID NO: 70570 - DNA, 20 bp, Artificial Sequence
  Description of Artificial Sequence: Synthetic oligonucleotide
  Target: ATXN1; (-) strand; PAM type: NRG; PAM sequence: AAG
acttgctagggtgtgtccat

SEQ ID NO: 70571 - DNA, 20 bp, Artificial Sequence
  Description of Artificial Sequence: Synthetic oligonucleotide
  Target: ATXN1; (-) strand; PAM type: NRG; PAM sequence: GGG
aaaccagtgaccacttgcta

SEQ ID NO: 70572 - DNA, 20 bp, Artificial Sequence
  Description of Artificial Sequence: Synthetic oligonucleotide
  Target: ATXN1; (-) strand; PAM type: NRG; PAM sequence: AGG
aaaaccagtgaccacttgct

SEQ ID NO: 70573 - DNA, 20 bp, Artificial Sequence
  Description of Artificial Sequence: Synthetic oligonucleotide
  Target: ATXN1; (-) strand; PAM type: NRG; PAM sequence: TAG
taaaaccagtgaccacttgc

SEQ ID NO: 70574 - DNA, 20 bp, Artificial Sequence
  Description of Artificial Sequence: Synthetic oligonucleotide
  Target: ATXN1; (-) strand; PAM type: NRG; PAM sequence: CAG
ccttggtatccatgtaaaac

SEQ ID NO: 70575 - DNA, 20 bp, Artificial Sequence
  Description of Artificial Sequence: Synthetic oligonucleotide
  Target: ATXN1; (-) strand; PAM type: NRG; PAM sequence: TGG
ggaaggcaagagggaagcct

SEQ ID NO: 70576 - DNA, 20 bp, Artificial Sequence
  Description of Artificial Sequence: Synthetic oligonucleotide
  Target: ATXN1; (-) strand; PAM type: NRG; PAM sequence: AAG
caggagggaaggcaagaggg

SEQ ID NO: 70577 - DNA, 20 bp, Artificial Sequence
  Description of Artificial Sequence: Synthetic oligonucleotide
  Target: ATXN1; (-) strand; PAM type: NRG; PAM sequence: GGG
gtgcaggagggaaggcaaga

SEQ ID NO: 70578 - DNA, 20 bp, Artificial Sequence
  Description of Artificial Sequence: Synthetic oligonucleotide
  Target: ATXN1; (-) strand; PAM type: NRG; PAM sequence: AGG
ggtgcaggagggaaggcaag

SEQ ID NO: 70579 - DNA, 20 bp, Artificial Sequence
  Description of Artificial Sequence: Synthetic oligonucleotide
  Target: ATXN1; (-) strand; PAM type: NRG; PAM sequence: GAG
gggtgcaggagggaaggcaa

SEQ ID NO: 70580 - DNA, 20 bp, Artificial Sequence
  Description of Artificial Sequence: Synthetic oligonucleotide
  Target: ATXN1; (-) strand; PAM type: NRG; PAM sequence: AAG
gagggtgcaggagggaaggc

SEQ ID NO: 70581 - DNA, 20 bp, Artificial Sequence
  Description of Artificial Sequence: Synthetic oligonucleotide
  Target: ATXN1; (-) strand; PAM type: NRG; PAM sequence: AGG
ctgagagggtgcaggaggga

SEQ ID NO: 70582 - DNA, 20 bp, Artificial Sequence
  Description of Artificial Sequence: Synthetic oligonucleotide
  Target: ATXN1; (-) strand; PAM type: NRG; PAM sequence: AAG
gctgagagggtgcaggaggg

SEQ ID NO: 70583 - DNA, 20 bp, Artificial Sequence
  Description of Artificial Sequence: Synthetic oligonucleotide
  Target: ATXN1; (-) strand; PAM type: NRG; PAM sequence: GGG
agagctgagagggtgcagga

SEQ ID NO: 70584 - DNA, 20 bp, Artificial Sequence
  Description of Artificial Sequence: Synthetic oligonucleotide
  Target: ATXN1; (-) strand; PAM type: NRG; PAM sequence: AGG
cagagctgagagggtgcagg

SEQ ID NO: 70585 - DNA, 20 bp, Artificial Sequence
  Description of Artificial Sequence: Synthetic oligonucleotide
  Target: ATXN1; (-) strand; PAM type: NRG; PAM sequence: GAG
ccagagctgagagggtgcag

SEQ ID NO: 70586 - DNA, 20 bp, Artificial Sequence
  Description of Artificial Sequence: Synthetic oligonucleotide
  Target: ATXN1; (-) strand; PAM type: NRG; PAM sequence: AGG
tgccagagctgagagggtgc

SEQ ID NO: 70587 - DNA, 20 bp, Artificial Sequence
  Description of Artificial Sequence: Synthetic oligonucleotide
  Target: ATXN1; (-) strand; PAM type: NRG; PAM sequence: CAG
ttgccagagctgagagggtg

SEQ ID NO: 70588 - DNA, 20 bp, Artificial Sequence
  Description of Artificial Sequence: Synthetic oligonucleotide
  Target: ATXN1; (-) strand; PAM type: NRG; PAM sequence: GGG
ccacattgccagagctgaga

SEQ ID NO: 70589 - DNA, 20 bp, Artificial Sequence
  Description of Artificial Sequence: Synthetic oligonucleotide
  Target: ATXN1; (-) strand; PAM type: NRG; PAM sequence: AGG
gccacattgccagagctgag

SEQ ID NO: 70590 - DNA, 20 bp, Artificial Sequence
  Description of Artificial Sequence: Synthetic oligonucleotide
  Target: ATXN1; (-) strand; PAM type: NRG; PAM sequence: GAG
agccacattgccagagctga

SEQ ID NO: 70591 - DNA, 20 bp, Artificial Sequence
  Description of Artificial Sequence: Synthetic oligonucleotide
  Target: ATXN1; (-) strand; PAM type: NRG; PAM sequence: GAG
atagccacattgccagagct

SEQ ID NO: 70592 - DNA, 20 bp, Artificial Sequence
  Description of Artificial Sequence: Synthetic oligonucleotide
  Target: ATXN1; (-) strand; PAM type: NRG; PAM sequence: GAG
gtgtgatagccacattgcca

SEQ ID NO: 70593 - DNA, 20 bp, Artificial Sequence
  Description of Artificial Sequence: Synthetic oligonucleotide
  Target: ATXN1; (-) strand; PAM type: NRG; PAM sequence: CAG
ttgtgtgatagccacattgc

SEQ ID NO: 70594 - DNA, 20 bp, Artificial Sequence
  Description of Artificial Sequence: Synthetic oligonucleotide
  Target: ATXN1; (-) strand; PAM type: NRG; PAM sequence: TAG
ttgacatgcagattgtgtga

SEQ ID NO: 70595 - DNA, 20 bp, Artificial Sequence
  Description of Artificial Sequence: Synthetic oligonucleotide
  Target: ATXN1; (-) strand; PAM type: NRG; PAM sequence: CAG
gaagaggccatgttgacatg

SEQ ID NO: 70596 - DNA, 20 bp, Artificial Sequence
  Description of Artificial Sequence: Synthetic oligonucleotide
  Target: ATXN1; (-) strand; PAM type: NRG; PAM sequence: AGG
caggagcatgtggttggaag

SEQ ID NO: 70597 - DNA, 20 bp, Artificial Sequence
  Description of Artificial Sequence: Synthetic oligonucleotide
  Target: ATXN1; (-) strand; PAM type: NRG; PAM sequence: GAG
acaggagcatgtggttggaa

SEQ ID NO: 70598 - DNA, 20 bp, Artificial Sequence
  Description of Artificial Sequence: Synthetic oligonucleotide
  Target: ATXN1; (-) strand; PAM type: NRG; PAM sequence: AAG
tgacaggagcatgtggttgg

SEQ ID NO: 70599 - DNA, 20 bp, Artificial Sequence
  Description of Artificial Sequence: Synthetic oligonucleotide
  Target: ATXN1; (-) strand; PAM type: NRG; PAM sequence: TGG
agttgacaggagcatgtggt

SEQ ID NO: 70600 - DNA, 20 bp, Artificial Sequence
  Description of Artificial Sequence: Synthetic oligonucleotide
  Target: ATXN1; (-) strand; PAM type: NRG; PAM sequence: TGG
ggaaagttgacaggagcatg

SEQ ID NO: 70601 - DNA, 20 bp, Artificial Sequence
  Description of Artificial Sequence: Synthetic oligonucleotide
  Target: ATXN1; (-) strand; PAM type: NRG; PAM sequence: GAG
agaggatggaaagttgacag

SEQ ID NO: 70602 - DNA, 20 bp, Artificial Sequence
  Description of Artificial Sequence: Synthetic oligonucleotide
  Target: ATXN1; (-) strand; PAM type: NRG; PAM sequence: AGG
gaagaggatggaaagttgac

SEQ ID NO: 70603 - DNA, 20 bp, Artificial Sequence
  Description of Artificial Sequence: Synthetic oligonucleotide
  Target: ATXN1; (-) strand; PAM type: NRG; PAM sequence: CAG
agaagaggatggaaagttga

SEQ ID NO: 70604 - DNA, 20 bp, Artificial Sequence
  Description of Artificial Sequence: Synthetic oligonucleotide
  Target: ATXN1; (-) strand; PAM type: NRG; PAM sequence: AAG
aatatgcagaagaggatgga

SEQ ID NO: 70605 - DNA, 20 bp, Artificial Sequence
  Description of Artificial Sequence: Synthetic oligonucleotide
  Target: ATXN1; (-) strand; PAM type: NRG; PAM sequence: TGG
gctgaatatgcagaagagga

SEQ ID NO: 70606 - DNA, 20 bp, Artificial Sequence
  Description of Artificial Sequence: Synthetic oligonucleotide
  Target: ATXN1; (-) strand; PAM type: NRG; PAM sequence: AGG
gtgggctgaatatgcagaag

SEQ ID NO: 70607 - DNA, 20 bp, Artificial Sequence
  Description of Artificial Sequence: Synthetic oligonucleotide
  Target: ATXN1; (-) strand; PAM type: NRG; PAM sequence: GAG
tgtgggctgaatatgcagaa

SEQ ID NO: 70608 - DNA, 20 bp, Artificial Sequence
  Description of Artificial Sequence: Synthetic oligonucleotide
  Target: ATXN1; (-) strand; PAM type: NRG; PAM sequence: AAG
agtgtgggctgaatatgcag

SEQ ID NO: 70609 - DNA, 20 bp, Artificial Sequence
  Description of Artificial Sequence: Synthetic oligonucleotide
  Target: ATXN1; (-) strand; PAM type: NRG; PAM sequence: CAG
acaagtgtgggctgaatatg

SEQ ID NO: 70610 - DNA, 20 bp, Artificial Sequence
  Description of Artificial Sequence: Synthetic oligonucleotide
  Target: ATXN1; (-) strand; PAM type: NRG; PAM sequence: GGG
aaagaagaaggaacaagtgt

SEQ ID NO: 70611 - DNA, 20 bp, Artificial Sequence
  Description of Artificial Sequence: Synthetic oligonucleotide
  Target: ATXN1; (-) strand; PAM type: NRG; PAM sequence: TGG
gaaagaagaaggaacaagtg

SEQ ID NO: 70612 - DNA, 20 bp, Artificial Sequence
  Description of Artificial Sequence: Synthetic oligonucleotide
  Target: ATXN1; (-) strand; PAM type: NRG; PAM sequence: AAG
gggatgaaagaagaaggaac

SEQ ID NO: 70613 - DNA, 20 bp, Artificial Sequence
  Description of Artificial Sequence: Synthetic oligonucleotide
  Target: ATXN1; (-) strand; PAM type: NRG; PAM sequence: AGG
atacaagggatgaaagaaga

SEQ ID NO: 70614 - DNA, 20 bp, Artificial Sequence
  Description of Artificial Sequence: Synthetic oligonucleotide
  Target: ATXN1; (-) strand; PAM type: NRG; PAM sequence: AAG
tatacaagggatgaaagaag

SEQ ID NO: 70615 - DNA, 20 bp, Artificial Sequence
  Description of Artificial Sequence: Synthetic oligonucleotide
  Target: ATXN1; (-) strand; PAM type: NRG; PAM sequence: AAG
aaatatacaagggatgaaag

SEQ ID NO: 70616 - DNA, 20 bp, Artificial Sequence
  Description of Artificial Sequence: Synthetic oligonucleotide
  Target: ATXN1; (-) strand; PAM type: NRG; PAM sequence: AAG
cccaaatatacaagggatga

SEQ ID NO: 70617 - DNA, 20 bp, Artificial Sequence
  Description of Artificial Sequence: Synthetic oligonucleotide
  Target: ATXN1; (-) strand; PAM type: NRG; PAM sequence: GGG
agattgtcccaaatatacaa

SEQ ID NO: 70618 - DNA, 20 bp, Artificial Sequence
  Description of Artificial Sequence: Synthetic oligonucleotide
  Target: ATXN1; (-) strand; PAM type: NRG; PAM sequence: AGG
cagattgtcccaaatataca

SEQ ID NO: 70619 - DNA, 20 bp, Artificial Sequence
  Description of Artificial Sequence: Synthetic oligonucleotide
  Target: ATXN1; (-) strand; PAM type: NRG; PAM sequence: AAG
tcagattgtcccaaatatac

SEQ ID NO: 70620 - DNA, 20 bp, Artificial Sequence
  Description of Artificial Sequence: Synthetic oligonucleotide
  Target: ATXN1; (-) strand; PAM type: NRG; PAM sequence: CAG
ccttttctaggataccctct

SEQ ID NO: 70621 - DNA, 20 bp, Artificial Sequence
  Description of Artificial Sequence: Synthetic oligonucleotide
  Target: ATXN1; (-) strand; PAM type: NRG; PAM sequence: AGG
gtatttggattcccttttct

SEQ ID NO: 70622 - DNA, 20 bp, Artificial Sequence
  Description of Artificial Sequence: Synthetic oligonucleotide
  Target: ATXN1; (-) strand; PAM type: NRG; PAM sequence: TAG
tgtatttggattcccttttc

SEQ ID NO: 70623 - DNA, 20 bp, Artificial Sequence
  Description of Artificial Sequence: Synthetic oligonucleotide
  Target: ATXN1; (-) strand; PAM type: NRG; PAM sequence: TGG
gaaatagatcaaaatgtatt

SEQ ID NO: 70624 - DNA, 20 bp, Artificial Sequence
  Description of Artificial Sequence: Synthetic oligonucleotide
  Target: ATXN1; (-) strand; PAM type: NRG; PAM sequence: TAG
aattatgcctactgtagaaa

SEQ ID NO: 70625 - DNA, 20 bp, Artificial Sequence
  Description of Artificial Sequence: Synthetic oligonucleotide
  Target: ATXN1; (-) strand; PAM type: NRG; PAM sequence: TAG
cctaataattatgcctactg

SEQ ID NO: 70626 - DNA, 20 bp, Artificial Sequence
  Description of Artificial Sequence: Synthetic oligonucleotide
  Target: ATXN1; (-) strand; PAM type: NRG; PAM sequence: TGG
aaccatcatggtctcactta

SEQ ID NO: 70627 - DNA, 20 bp, Artificial Sequence
  Description of Artificial Sequence: Synthetic oligonucleotide
  Target: ATXN1; (-) strand; PAM type: NRG; PAM sequence: TGG
atagtcaacagtaaccatca

SEQ ID NO: 70628 - DNA, 20 bp, Artificial Sequence
  Description of Artificial Sequence: Synthetic oligonucleotide
  Target: ATXN1; (-) strand; PAM type: NRG; PAM sequence: CAG
ctacagaagagcatagtcaa

SEQ ID NO: 70629 - DNA, 20 bp, Artificial Sequence
  Description of Artificial Sequence: Synthetic oligonucleotide
  Target: ATXN1; (-) strand; PAM type: NRG; PAM sequence: TAG
tttaaaactacagaagagca

SEQ ID NO: 70630 - DNA, 20 bp, Artificial Sequence
  Description of Artificial Sequence: Synthetic oligonucleotide
  Target: ATXN1; (-) strand; PAM type: NRG; PAM sequence: GAG
gcacttttaaaactacagaa

SEQ ID NO: 70631 - DNA, 20 bp, Artificial Sequence
  Description of Artificial Sequence: Synthetic oligonucleotide
  Target: ATXN1; (-) strand; PAM type: NRG; PAM sequence: AAG
aggcacttttaaaactacag

SEQ ID NO: 70632 - DNA, 20 bp, Artificial Sequence
  Description of Artificial Sequence: Synthetic oligonucleotide
  Target: ATXN1; (-) strand; PAM type: NRG; PAM sequence: CAG
gaaaggcacttttaaaacta

SEQ ID NO: 70633 - DNA, 20 bp, Artificial Sequence
  Description of Artificial Sequence: Synthetic oligonucleotide
  Target: ATXN1; (-) strand; PAM type: NRG; PAM sequence: AGG
ctgcaactattatgcatgaa

SEQ ID NO: 70634 - DNA, 20 bp, Artificial Sequence
  Description of Artificial Sequence: Synthetic oligonucleotide
  Target: ATXN1; (-) strand; PAM type: NRG; PAM sequence: AAG
tctgcaactattatgcatga

SEQ ID NO: 70635 - DNA, 20 bp, Artificial Sequence
  Description of Artificial Sequence: Synthetic oligonucleotide
  Target: ATXN1; (-) strand; PAM type: NRG; PAM sequence: AAG
tactatttattagggttgtt

SEQ ID NO: 70636 - DNA, 20 bp, Artificial Sequence
  Description of Artificial Sequence: Synthetic oligonucleotide
  Target: ATXN1; (-) strand; PAM type: NRG; PAM sequence: GGG
aattatgttactatttatta

SEQ ID NO: 70637 - DNA, 20 bp, Artificial Sequence
  Description of Artificial Sequence: Synthetic oligonucleotide
  Target: ATXN1; (-) strand; PAM type: NRG; PAM sequence: AGG
taattatgttactatttatt

SEQ ID NO: 70638 - DNA, 20 bp, Artificial Sequence
  Description of Artificial Sequence: Synthetic oligonucleotide
  Target: ATXN1; (-) strand; PAM type: NRG; PAM sequence: TAG
ataattatgttactatttat

SEQ ID NO: 70639 - DNA, 20 bp, Artificial Sequence
  Description of Artificial Sequence: Synthetic oligonucleotide
  Target: ATXN1; (-) strand; PAM type: NRG; PAM sequence: GGG
cagtttcttttctataaatt

SEQ ID NO: 70640 - DNA, 20 bp, Artificial Sequence
  Description of Artificial Sequence: Synthetic oligonucleotide
  Target: ATXN1; (-) strand; PAM type: NRG; PAM sequence: TGG
tcagtttcttttctataaat

SEQ ID NO: 70641 - DNA, 20 bp, Artificial Sequence
  Description of Artificial Sequence: Synthetic oligonucleotide
  Target: ATXN1; (-) strand; PAM type: NRG; PAM sequence: CAG
tacctaacctttttgagctt

SEQ ID NO: 70642 - DNA, 20 bp, Artificial Sequence
  Description of Artificial Sequence: Synthetic oligonucleotide
  Target: ATXN1; (-) strand; PAM type: NRG; PAM sequence: GAG
ctgacttacctaaccttttt

SEQ ID NO: 70643 - DNA, 20 bp, Artificial Sequence
  Description of Artificial Sequence: Synthetic oligonucleotide
  Target: ATXN1; (-) strand; PAM type: NRG; PAM sequence: TGG
gtttattagctgtgtgtcca

SEQ ID NO: 70644 - DNA, 20 bp, Artificial Sequence
  Description of Artificial Sequence: Synthetic oligonucleotide
  Target: ATXN1; (-) strand; PAM type: NRG; PAM sequence: TAG
attttggctctgtggtttat

SEQ ID NO: 70645 - DNA, 20 bp, Artificial Sequence
  Description of Artificial Sequence: Synthetic oligonucleotide
  Target: ATXN1; (-) strand; PAM type: NRG; PAM sequence: TGG
agatgagtattttggctctg

SEQ ID NO: 70646 - DNA, 20 bp, Artificial Sequence
  Description of Artificial Sequence: Synthetic oligonucleotide
  Target: ATXN1; (-) strand; PAM type: NRG; PAM sequence: TGG
attcgaagagatgagtattt

SEQ ID NO: 70647 - DNA, 20 bp, Artificial Sequence
  Description of Artificial Sequence: Synthetic oligonucleotide
  Target: ATXN1; (-) strand; PAM type: NRG; PAM sequence: GAG
aacttgacattcgaagagat

SEQ ID NO: 70648 - DNA, 20 bp, Artificial Sequence
  Description of Artificial Sequence: Synthetic oligonucleotide
  Target: ATXN1; (-) strand; PAM type: NRG; PAM sequence: GAG
tatagaacttgacattcgaa

SEQ ID NO: 70649 - DNA, 20 bp, Artificial Sequence
  Description of Artificial Sequence: Synthetic oligonucleotide
  Target: ATXN1; (-) strand; PAM type: NRG; PAM sequence: AAG
tgtatagaacttgacattcg

SEQ ID NO: 70650 - DNA, 20 bp, Artificial Sequence
  Description of Artificial Sequence: Synthetic oligonucleotide
  Target: ATXN1; (-) strand; PAM type: NRG; PAM sequence: TAG
tatatgttgcaaaaaatgta

SEQ ID NO: 70651 - DNA, 20 bp, Artificial Sequence
  Description of Artificial Sequence: Synthetic oligonucleotide
  Target: ATXN1; (-) strand; PAM type: NRG; PAM sequence: CAG
tcctttttgataatctaata

SEQ ID NO: 70652 - DNA, 20 bp, Artificial Sequence
  Description of Artificial Sequence: Synthetic oligonucleotide
  Target: ATXN1; (-) strand; PAM type: NRG; PAM sequence: AAG
ctaccatattgcttatagtc

SEQ ID NO: 70653 - DNA, 20 bp, Artificial Sequence
  Description of Artificial Sequence: Synthetic oligonucleotide
  Target: ATXN1; (-) strand; PAM type: NRG; PAM sequence: TAG
tattgctaccatattgctta

SEQ ID NO: 70654 - DNA, 20 bp, Artificial Sequence
  Description of Artificial Sequence: Synthetic oligonucleotide
  Target: ATXN1; (-) strand; PAM type: NRG; PAM sequence: AGG
aaatatggaatacaaacatg

SEQ ID NO: 70655 - DNA, 20 bp, Artificial Sequence
  Description of Artificial Sequence: Synthetic oligonucleotide
  Target: ATXN1; (-) strand; PAM type: NRG; PAM sequence: GAG
caaatatggaatacaaacat

SEQ ID NO: 70656 - DNA, 20 bp, Artificial Sequence
  Description of Artificial Sequence: Synthetic oligonucleotide
  Target: ATXN1; (-) strand; PAM type: NRG; PAM sequence: TGG
ttggaaaatgttttcaaata

SEQ ID NO: 70657 - DNA, 20 bp, Artificial Sequence
  Description of Artificial Sequence: Synthetic oligonucleotide
  Target: ATXN1; (-) strand; PAM type: NRG; PAM sequence: TGG
gacctgaagttaaaacattt

SEQ ID NO: 70658 - DNA, 20 bp, Artificial Sequence
  Description of Artificial Sequence: Synthetic oligonucleotide
  Target: ATXN1; (-) strand; PAM type: NRG; PAM sequence: AAG
ataaggaaaaataagacctg

SEQ ID NO: 70659 - DNA, 20 bp, Artificial Sequence
  Description of Artificial Sequence: Synthetic oligonucleotide
  Target: ATXN1; (-) strand; PAM type: NRG; PAM sequence: AAG
tgatttttataaggaaaaat

SEQ ID NO: 70660 - DNA, 20 bp, Artificial Sequence
  Description of Artificial Sequence: Synthetic oligonucleotide
  Target: ATXN1; (-) strand; PAM type: NRG; PAM sequence: AGG
agtaactcatgatttttata

SEQ ID NO: 70661 - DNA, 20 bp, Artificial Sequence
  Description of Artificial Sequence: Synthetic oligonucleotide
  Target: ATXN1; (-) strand; PAM type: NRG; PAM sequence: AAG
gagtaactcatgatttttat

SEQ ID NO: 70662 - DNA, 20 bp, Artificial Sequence
  Description of Artificial Sequence: Synthetic oligonucleotide
  Target: ATXN1; (-) strand; PAM type: NRG; PAM sequence: GAG
catctgtaaaatggggctag

SEQ ID NO: 70663 - DNA, 20 bp, Artificial Sequence
  Description of Artificial Sequence: Synthetic oligonucleotide
  Target: ATXN1; (-) strand; PAM type: NRG; PAM sequence: AGG
atcatctgtaaaatggggct

SEQ ID NO: 70664 - DNA, 20 bp, Artificial Sequence
  Description of Artificial Sequence: Synthetic oligonucleotide
  Target: ATXN1; (-) strand; PAM type: NRG; PAM sequence: TAG
tatcatctgtaaaatggggc

SEQ ID NO: 70665 - DNA, 20 bp, Artificial Sequence
  Description of Artificial Sequence: Synthetic oligonucleotide
  Target: ATXN1; (-) strand; PAM type: NRG; PAM sequence: GGG
aatttatcatctgtaaaatg

SEQ ID NO: 70666 - DNA, 20 bp, Artificial Sequence
  Description of Artificial Sequence: Synthetic oligonucleotide
  Target: ATXN1; (-) strand; PAM type: NRG; PAM sequence: GGG
taatttatcatctgtaaaat

SEQ ID NO: 70667 - DNA, 20 bp, Artificial Sequence
  Description of Artificial Sequence: Synthetic oligonucleotide
  Target: ATXN1; (-) strand; PAM type: NRG; PAM sequence: TGG
ttaatttatcatctgtaaaa

SEQ ID NO: 70668 - DNA, 20 bp, Artificial Sequence
  Description of Artificial Sequence: Synthetic oligonucleotide
  Target: ATXN1; (-) strand; PAM type: NRG; PAM sequence: AAG
actcattagtttatttaggc

SEQ ID NO: 70669 - DNA, 20 bp, Artificial Sequence
  Description of Artificial Sequence: Synthetic oligonucleotide
  Target: ATXN1; (-) strand; PAM type: NRG; PAM sequence: AGG
gtcaactcattagtttattt

SEQ ID NO: 70670 - DNA, 20 bp, Artificial Sequence
  Description of Artificial Sequence: Synthetic oligonucleotide
  Target: ATXN1; (-) strand; PAM type: NRG; PAM sequence: TAG
tgtcaactcattagtttatt

SEQ ID NO: 70671 - DNA, 20 bp, Artificial Sequence
  Description of Artificial Sequence: Synthetic oligonucleotide
  Target: ATXN1; (-) strand; PAM type: NRG; PAM sequence: TAG
caggtccactgtcaactcat

SEQ ID NO: 70672 - DNA, 20 bp, Artificial Sequence
  Description of Artificial Sequence: Synthetic oligonucleotide
  Target: ATXN1; (-) strand; PAM type: NRG; PAM sequence: AGG
gatgcagtgattctaacttc

SEQ ID NO: 70673 - DNA, 20 bp, Artificial Sequence
  Description of Artificial Sequence: Synthetic oligonucleotide
  Target: ATXN1; (-) strand; PAM type: NRG; PAM sequence: CAG
ggatgcagtgattctaactt

SEQ ID NO: 70674 - DNA, 20 bp, Artificial Sequence
  Description of Artificial Sequence: Synthetic oligonucleotide
  Target: ATXN1; (-) strand; PAM type: NRG; PAM sequence: CAG
ctagtttttgaattaggatg

SEQ ID NO: 70675 - DNA, 20 bp, Artificial Sequence
  Description of Artificial Sequence: Synthetic oligonucleotide
  Target: ATXN1; (-) strand; PAM type: NRG; PAM sequence: AGG
gccatactagtttttgaatt

SEQ ID NO: 70676 - DNA, 20 bp, Artificial Sequence
  Description of Artificial Sequence: Synthetic oligonucleotide
  Target: ATXN1; (-) strand; PAM type: NRG; PAM sequence: TAG
agccatactagtttttgaat

SEQ ID NO: 70677 - DNA, 20 bp, Artificial Sequence
  Description of Artificial Sequence: Synthetic oligonucleotide
  Target: ATXN1; (-) strand; PAM type: NRG; PAM sequence: TAG
tcccctctgaaaagccatac

SEQ ID NO: 70678 - DNA, 20 bp, Artificial Sequence
  Description of Artificial Sequence: Synthetic oligonucleotide
  Target: ATXN1; (-) strand; PAM type: NRG; PAM sequence: AAG
gttgaattatcccctctgaa

SEQ ID NO: 70679 - DNA, 20 bp, Artificial Sequence
  Description of Artificial Sequence: Synthetic oligonucleotide
  Target: ATXN1; (-) strand; PAM type: NRG; PAM sequence: AGG
gttatgtctccaaggatgtt

SEQ ID NO: 70680 - DNA, 20 bp, Artificial Sequence
  Description of Artificial Sequence: Synthetic oligonucleotide
  Target: ATXN1; (-) strand; PAM type: NRG; PAM sequence: TAG
tgttatgtctccaaggatgt

SEQ ID NO: 70681 - DNA, 20 bp, Artificial Sequence
  Description of Artificial Sequence: Synthetic oligonucleotide
  Target: ATXN1; (-) strand; PAM type: NRG; PAM sequence: AGG
tctccagtgttatgtctcca

SEQ ID NO: 70682 - DNA, 20 bp, Artificial Sequence
  Description of Artificial Sequence: Synthetic oligonucleotide
  Target: ATXN1; (-) strand; PAM type: NRG; PAM sequence: AAG
atctccagtgttatgtctcc

SEQ ID NO: 70683 - DNA, 20 bp, Artificial Sequence
  Description of Artificial Sequence: Synthetic oligonucleotide
  Target: ATXN1; (-) strand; PAM type: NRG; PAM sequence: CAG
catttatgttattttatctc

SEQ ID NO: 70684 - DNA, 20 bp, Artificial Sequence
  Description of Artificial Sequence: Synthetic oligonucleotide
  Target: ATXN1; (-) strand; PAM type: NRG; PAM sequence: AAG
aaatatgtaggaacttatcc

SEQ ID NO: 70685 - DNA, 20 bp, Artificial Sequence
  Description of Artificial Sequence: Synthetic oligonucleotide
  Target: ATXN1; (-) strand; PAM type: NRG; PAM sequence: AGG
cttcctgcagtaaaatatgt

SEQ ID NO: 70686 - DNA, 20 bp, Artificial Sequence
  Description of Artificial Sequence: Synthetic oligonucleotide
  Target: ATXN1; (-) strand; PAM type: NRG; PAM sequence: TAG
tcttcctgcagtaaaatatg

SEQ ID NO: 70687 - DNA, 20 bp, Artificial Sequence
  Description of Artificial Sequence: Synthetic oligonucleotide
  Target: ATXN1; (-) strand; PAM type: NRG; PAM sequence: CAG
atacatgtggcttcttcctg

SEQ ID NO: 70688 - DNA, 20 bp, Artificial Sequence
  Description of Artificial Sequence: Synthetic oligonucleotide
  Target: ATXN1; (-) strand; PAM type: NRG; PAM sequence: TGG
acccatcacagaaatacatg

SEQ ID NO: 70689 - DNA, 20 bp, Artificial Sequence
  Description of Artificial Sequence: Synthetic oligonucleotide
  Target: ATXN1; (-) strand; PAM type: NRG; PAM sequence: CAG
tccgttctgcaaacccatca

SEQ ID NO: 70690 - DNA, 20 bp, Artificial Sequence
  Description of Artificial Sequence: Synthetic oligonucleotide
  Target: ATXN1; (-) strand; PAM type: NRG; PAM sequence: GGG
ctggcctccttcacagcgct

SEQ ID NO: 70691 - DNA, 20 bp, Artificial Sequence
  Description of Artificial Sequence: Synthetic oligonucleotide
  Target: ATXN1; (-) strand; PAM type: NRG; PAM sequence: TGG
actggcctccttcacagcgc

SEQ ID NO: 70692 - DNA, 20 bp, Artificial Sequence
  Description of Artificial Sequence: Synthetic oligonucleotide
  Target: ATXN1; (-) strand; PAM type: NRG; PAM sequence: CAG
gtctagactggcctccttca

SEQ ID NO: 70693 - DNA, 20 bp, Artificial Sequence
  Description of Artificial Sequence: Synthetic oligonucleotide
  Target: ATXN1; (-) strand; PAM type: NRG; PAM sequence: TGG
atatgggagcccgtctagac

SEQ ID NO: 70694 - DNA, 20 bp, Artificial Sequence
  Description of Artificial Sequence: Synthetic oligonucleotide
  Target: ATXN1; (-) strand; PAM type: NRG; PAM sequence: TAG
aagggatatgggagcccgtc

SEQ ID NO: 70695 - DNA, 20 bp, Artificial Sequence
  Description of Artificial Sequence: Synthetic oligonucleotide
  Target: ATXN1; (-) strand; PAM type: NRG; PAM sequence: GAG
atgtgttctaagggatatgg

SEQ ID NO: 70696 - DNA, 20 bp, Artificial Sequence
  Description of Artificial Sequence: Synthetic oligonucleotide
  Target: ATXN1; (-) strand; PAM type: NRG; PAM sequence: GGG
ttatgtgttctaagggatat

SEQ ID NO: 70697 - DNA, 20 bp, Artificial Sequence
  Description of Artificial Sequence: Synthetic oligonucleotide
  Target: ATXN1; (-) strand; PAM type: NRG; PAM sequence: TGG
tttatgtgttctaagggata

SEQ ID NO: 70698 - DNA, 20 bp, Artificial Sequence
  Description of Artificial Sequence: Synthetic oligonucleotide
  Target: ATXN1; (-) strand; PAM type: NRG; PAM sequence: GGG
gcttcctttatgtgttctaa

SEQ ID NO: 70699 - DNA, 20 bp, Artificial Sequence
  Description of Artificial Sequence: Synthetic oligonucleotide
  Target: ATXN1; (-) strand; PAM type: NRG; PAM sequence: AGG
agcttcctttatgtgttcta

SEQ ID NO: 70700 - DNA, 20 bp, Artificial Sequence
  Description of Artificial Sequence: Synthetic oligonucleotide
  Target: ATXN1; (-) strand; PAM type: NRG; PAM sequence: AAG
tagcttcctttatgtgttct

SEQ ID NO: 70701 - DNA, 20 bp, Artificial Sequence
  Description of Artificial Sequence: Synthetic oligonucleotide
  Target: ATXN1; (-) strand; PAM type: NRG; PAM sequence: TAG
cttgtatgacttgcctagaa

SEQ ID NO: 70702 - DNA, 20 bp, Artificial Sequence
  Description of Artificial Sequence: Synthetic oligonucleotide
  Target: ATXN1; (-) strand; PAM type: NRG; PAM sequence: TAG
caagtcttgtatgacttgcc

SEQ ID NO: 70703 - DNA, 20 bp, Artificial Sequence
  Description of Artificial Sequence: Synthetic oligonucleotide
  Target: ATXN1; (-) strand; PAM type: NRG; PAM sequence: AAG
tctctgttttcaccaatcac

SEQ ID NO: 70704 - DNA, 20 bp, Artificial Sequence
  Description of Artificial Sequence: Synthetic oligonucleotide
  Target: ATXN1; (-) strand; PAM type: NRG; PAM sequence: TAG
tgttggggcctgtcatgaat

SEQ ID NO: 70705 - DNA, 20 bp, Artificial Sequence
  Description of Artificial Sequence: Synthetic oligonucleotide
  Target: ATXN1; (-) strand; PAM type: NRG; PAM sequence: GGG
aaagaccaaagggaatgttg

SEQ ID NO: 70706 - DNA, 20 bp, Artificial Sequence
  Description of Artificial Sequence: Synthetic oligonucleotide
  Target: ATXN1; (-) strand; PAM type: NRG; PAM sequence: GGG
gaaagaccaaagggaatgtt

SEQ ID NO: 70707 - DNA, 20 bp, Artificial Sequence
  Description of Artificial Sequence: Synthetic oligonucleotide
  Target: ATXN1; (-) strand; PAM type: NRG; PAM sequence: TGG
tgaaagaccaaagggaatgt

SEQ ID NO: 70708 - DNA, 20 bp, Artificial Sequence
  Description of Artificial Sequence: Synthetic oligonucleotide
  Target: ATXN1; (-) strand; PAM type: NRG; PAM sequence: GGG
tcagatcgtgaaagaccaaa

SEQ ID NO: 70709 - DNA, 20 bp, Artificial Sequence
  Description of Artificial Sequence: Synthetic oligonucleotide
  Target: ATXN1; (-) strand; PAM type: NRG; PAM sequence: AGG
ttcagatcgtgaaagaccaa

SEQ ID NO: 70710 - DNA, 20 bp, Artificial Sequence
  Description of Artificial Sequence: Synthetic oligonucleotide
  Target: ATXN1; (-) strand; PAM type: NRG; PAM sequence: AAG
attcagatcgtgaaagacca

SEQ ID NO: 70711 - DNA, 20 bp, Artificial Sequence
  Description of Artificial Sequence: Synthetic oligonucleotide
  Target: ATXN1; (-) strand; PAM type: NRG; PAM sequence: AAG
ttcatgaattcagatcgtga

SEQ ID NO: 70712 - DNA, 20 bp, Artificial Sequence
  Description of Artificial Sequence: Synthetic oligonucleotide
  Target: ATXN1; (-) strand; PAM type: NRG; PAM sequence: CAG
gaatctttctttcatgaatt

SEQ ID NO: 70713 - DNA, 20 bp, Artificial Sequence
  Description of Artificial Sequence: Synthetic oligonucleotide
  Target: ATXN1; (-) strand; PAM type: NRG; PAM sequence: TGG
gctcagattccacttccttc

SEQ ID NO: 70714 - DNA, 20 bp, Artificial Sequence
  Description of Artificial Sequence: Synthetic oligonucleotide
  Target: ATXN1; (-) strand; PAM type: NRG; PAM sequence: CAG
ttatttctttagcattagct

SEQ ID NO: 70715 - DNA, 20 bp, Artificial Sequence
  Description of Artificial Sequence: Synthetic oligonucleotide
  Target: ATXN1; (-) strand; PAM type: NRG; PAM sequence: TAG
ctgttttatttctttagcat

SEQ ID NO: 70716 - DNA, 20 bp, Artificial Sequence
  Description of Artificial Sequence: Synthetic oligonucleotide
  Target: ATXN1; (-) strand; PAM type: NRG; PAM sequence: TAG
ctcaagctgttttatttctt

SEQ ID NO: 70717 - DNA, 20 bp, Artificial Sequence
  Description of Artificial Sequence: Synthetic oligonucleotide
  Target: ATXN1; (-) strand; PAM type: NRG; PAM sequence: AAG
gtttcttcccactttttctc

SEQ ID NO: 70718 - DNA, 20 bp, Artificial Sequence
  Description of Artificial Sequence: Synthetic oligonucleotide
  Target: ATXN1; (-) strand; PAM type: NRG; PAM sequence: TAG
caatggtctcttgaacatat

SEQ ID NO: 70719 - DNA, 20 bp, Artificial Sequence
  Description of Artificial Sequence: Synthetic oligonucleotide
  Target: ATXN1; (-) strand; PAM type: NRG; PAM sequence: TGG
acatacacctccaaccgcaa

SEQ ID NO: 70720 - DNA, 20 bp, Artificial Sequence
  Description of Artificial Sequence: Synthetic oligonucleotide
  Target: ATXN1; (-) strand; PAM type: NRG; PAM sequence: AAG
atcaactcaaattactcagc

SEQ ID NO: 70721 - DNA, 20 bp, Artificial Sequence
  Description of Artificial Sequence: Synthetic oligonucleotide
  Target: ATXN1; (-) strand; PAM type: NRG; PAM sequence: CAG
cagaatcaactcaaattact

SEQ ID NO: 70722 - DNA, 20 bp, Artificial Sequence
  Description of Artificial Sequence: Synthetic oligonucleotide
  Target: ATXN1; (-) strand; PAM type: NRG; PAM sequence: CAG
cagaagtccctcagatttta

SEQ ID NO: 70723 - DNA, 20 bp, Artificial Sequence
  Description of Artificial Sequence: Synthetic oligonucleotide
  Target: ATXN1; (-) strand; PAM type: NRG; PAM sequence: CAG
ggaaatcttcagaagtccct

SEQ ID NO: 70724 - DNA, 20 bp, Artificial Sequence
  Description of Artificial Sequence: Synthetic oligonucleotide
  Target: ATXN1; (-) strand; PAM type: NRG; PAM sequence: AAG
ccctgctcggaaatcttcag

SEQ ID NO: 70725 - DNA, 20 bp, Artificial Sequence
  Description of Artificial Sequence: Synthetic oligonucleotide
  Target: ATXN1; (-) strand; PAM type: NRG; PAM sequence: CAG
ttcccctgctcggaaatctt

SEQ ID NO: 70726 - DNA, 20 bp, Artificial Sequence
  Description of Artificial Sequence: Synthetic oligonucleotide
  Target: ATXN1; (-) strand; PAM type: NRG; PAM sequence: CGG
aatgaaagcattcccctgct

SEQ ID NO: 70727 - DNA, 20 bp, Artificial Sequence
  Description of Artificial Sequence: Synthetic oligonucleotide
  Target: ATXN1; (-) strand; PAM type: NRG; PAM sequence: AAG
acatagtacacatctaatga

SEQ ID NO: 70728 - DNA, 20 bp, Artificial Sequence
  Description of Artificial Sequence: Synthetic oligonucleotide
  Target: ATXN1; (-) strand; PAM type: NRG; PAM sequence: TAG
tcacttagaagcagtagaca

SEQ ID NO: 70729 - DNA, 20 bp, Artificial Sequence
  Description of Artificial Sequence: Synthetic oligonucleotide
  Target: ATXN1; (-) strand; PAM type: NRG; PAM sequence: TAG
agtcactcacttagaagcag

SEQ ID NO: 70730 - DNA, 20 bp, Artificial Sequence
  Description of Artificial Sequence: Synthetic oligonucleotide
  Target: ATXN1; (-) strand; PAM type: NRG; PAM sequence: CAG
cagagtcactcacttagaag

SEQ ID NO: 70731 - DNA, 20 bp, Artificial Sequence
  Description of Artificial Sequence: Synthetic oligonucleotide
  Target: ATXN1; (-) strand; PAM type: NRG; PAM sequence: AAG
tttcagagtcactcacttag

SEQ ID NO: 70732 - DNA, 20 bp, Artificial Sequence
  Description of Artificial Sequence: Synthetic oligonucleotide
  Target: ATXN1; (-) strand; PAM type: NRG; PAM sequence: TAG
ggatttcagagtcactcact

SEQ ID NO: 70733 - DNA, 20 bp, Artificial Sequence
  Description of Artificial Sequence: Synthetic oligonucleotide
  Target: ATXN1; (-) strand; PAM type: NRG; PAM sequence: GAG
ggctcgacttgtggatttca

SEQ ID NO: 70734 - DNA, 20 bp, Artificial Sequence
  Description of Artificial Sequence: Synthetic oligonucleotide
  Target: ATXN1; (-) strand; PAM type: NRG; PAM sequence: CAG
agggctcgacttgtggattt

SEQ ID NO: 70735 - DNA, 20 bp, Artificial Sequence
  Description of Artificial Sequence: Synthetic oligonucleotide
  Target: ATXN1; (-) strand; PAM type: NRG; PAM sequence: TGG
agaggtcagggctcgacttg

SEQ ID NO: 70736 - DNA, 20 bp, Artificial Sequence
  Description of Artificial Sequence: Synthetic oligonucleotide
  Target: ATXN1; (-) strand; PAM type: NRG; PAM sequence: GGG
catcttggaaagagaggtca

SEQ ID NO: 70737 - DNA, 20 bp, Artificial Sequence
  Description of Artificial Sequence: Synthetic oligonucleotide
  Target: ATXN1; (-) strand; PAM type: NRG; PAM sequence: AGG
gcatcttggaaagagaggtc

SEQ ID NO: 70738 - DNA, 20 bp, Artificial Sequence
  Description of Artificial Sequence: Synthetic oligonucleotide
  Target: ATXN1; (-) strand; PAM type: NRG; PAM sequence: CAG
tgcatcttggaaagagaggt

SEQ ID NO: 70739 - DNA, 20 bp, Artificial Sequence
  Description of Artificial Sequence: Synthetic oligonucleotide
  Target: ATXN1; (-) strand; PAM type: NRG; PAM sequence: AGG
gatctgcatcttggaaagag

SEQ ID NO: 70740 - DNA, 20 bp, Artificial Sequence
  Description of Artificial Sequence: Synthetic oligonucleotide
  Target: ATXN1; (-) strand; PAM type: NRG; PAM sequence: GAG
agatctgcatcttggaaaga

SEQ ID NO: 70741 - DNA, 20 bp, Artificial Sequence
  Description of Artificial Sequence: Synthetic oligonucleotide
  Target: ATXN1; (-) strand; PAM type: NRG; PAM sequence: GAG
acagatctgcatcttggaaa

SEQ ID NO: 70742 - DNA, 20 bp, Artificial Sequence
  Description of Artificial Sequence: Synthetic oligonucleotide
  Target: ATXN1; (-) strand; PAM type: NRG; PAM sequence: AAG
aaacagatctgcatcttgga

SEQ ID NO: 70743 - DNA, 20 bp, Artificial Sequence
  Description of Artificial Sequence: Synthetic oligonucleotide
  Target: ATXN1; (-) strand; PAM type: NRG; PAM sequence: TGG
agaaaaacagatctgcatct

SEQ ID NO: 70744 - DNA, 20 bp, Artificial Sequence
  Description of Artificial Sequence: Synthetic oligonucleotide
  Target: ATXN1; (-) strand; PAM type: NRG; PAM sequence: CAG
gcagcaggcattcagaaaaa

SEQ ID NO: 70745 - DNA, 20 bp, Artificial Sequence
  Description of Artificial Sequence: Synthetic oligonucleotide
  Target: ATXN1; (-) strand; PAM type: NRG; PAM sequence: CAG
agagacgtgcagcaggcatt

SEQ ID NO: 70746 - DNA, 20 bp, Artificial Sequence
  Description of Artificial Sequence: Synthetic oligonucleotide
  Target: ATXN1; (-) strand; PAM type: NRG; PAM sequence: AGG
gctgtgtagagacgtgcagc

SEQ ID NO: 70747 - DNA, 20 bp, Artificial Sequence
  Description of Artificial Sequence: Synthetic oligonucleotide
  Target: ATXN1; (-) strand; PAM type: NRG; PAM sequence: CAG
agctgtgtagagacgtgcag

SEQ ID NO: 70748 - DNA, 20 bp, Artificial Sequence
  Description of Artificial Sequence: Synthetic oligonucleotide
  Target: ATXN1; (-) strand; PAM type: NRG; PAM sequence: CAG
gatagctgtgtagagacgtg

SEQ ID NO: 70749 - DNA, 20 bp, Artificial Sequence
  Description of Artificial Sequence: Synthetic oligonucleotide
  Target: ATXN1; (-) strand; PAM type: NRG; PAM sequence: GAG
cacagcaggatagctgtgta

SEQ ID NO: 70750 - DNA, 20 bp, Artificial Sequence
  Description of Artificial Sequence: Synthetic oligonucleotide
  Target: ATXN1; (-) strand; PAM type: NRG; PAM sequence: TAG
gccacagcaggatagctgtg

SEQ ID NO: 70751 - DNA, 20 bp, Artificial Sequence
  Description of Artificial Sequence: Synthetic oligonucleotide
  Target: ATXN1; (-) strand; PAM type: NRG; PAM sequence: TAG
ctggaagcgccacagcagga

SEQ ID NO: 70752 - DNA, 20 bp, Artificial Sequence
  Description of Artificial Sequence: Synthetic oligonucleotide
  Target: ATXN1; (-) strand; PAM type: NRG; PAM sequence: AGG
ccagctggaagcgccacagc

SEQ ID NO: 70753 - DNA, 20 bp, Artificial Sequence
  Description of Artificial Sequence: Synthetic oligonucleotide
  Target: ATXN1; (-) strand; PAM type: NRG; PAM sequence: CAG
cccagctggaagcgccacag

SEQ ID NO: 70754 - DNA, 20 bp, Artificial Sequence
  Description of Artificial Sequence: Synthetic oligonucleotide
  Target: ATXN1; (-) strand; PAM type: NRG; PAM sequence: CAG
atgcccagctggaagcgcca

SEQ ID NO: 70755 - DNA, 20 bp, Artificial Sequence
  Description of Artificial Sequence: Synthetic oligonucleotide
  Target: ATXN1; (-) strand; PAM type: NRG; PAM sequence: AAG
gatctaacatgcccagctgg

SEQ ID NO: 70756 - DNA, 20 bp, Artificial Sequence
  Description of Artificial Sequence: Synthetic oligonucleotide
  Target: ATXN1; (-) strand; PAM type: NRG; PAM sequence: TGG
agagatctaacatgcccagc

SEQ ID NO: 70757 - DNA, 20 bp, Artificial Sequence
  Description of Artificial Sequence: Synthetic oligonucleotide
  Target: ATXN1; (-) strand; PAM type: NRG; PAM sequence: CAG
ctgtagagatctaacatgcc

SEQ ID NO: 70758 - DNA, 20 bp, Artificial Sequence
  Description of Artificial Sequence: Synthetic oligonucleotide
  Target: ATXN1; (-) strand; PAM type: NRG; PAM sequence: GAG
acagaccattagggactgta

SEQ ID NO: 70759 - DNA, 20 bp, Artificial Sequence
  Description of Artificial Sequence: Synthetic oligonucleotide
  Target: ATXN1; (-) strand; PAM type: NRG; PAM sequence: TAG
tcacagaccattagggactg

SEQ ID NO: 70760 - DNA, 20 bp, Artificial Sequence
  Description of Artificial Sequence: Synthetic oligonucleotide
  Target: ATXN1; (-) strand; PAM type: NRG; PAM sequence: GGG
gctagaatcacagaccatta

SEQ ID NO: 70761 - DNA, 20 bp, Artificial Sequence
  Description of Artificial Sequence: Synthetic oligonucleotide
  Target: ATXN1; (-) strand; PAM type: NRG; PAM sequence: AGG
tgctagaatcacagaccatt

SEQ ID NO: 70762 - DNA, 20 bp, Artificial Sequence
  Description of Artificial Sequence: Synthetic oligonucleotide
  Target: ATXN1; (-) strand; PAM type: NRG; PAM sequence: TAG
ctgctagaatcacagaccat

SEQ ID NO: 70763 - DNA, 20 bp, Artificial Sequence
  Description of Artificial Sequence: Synthetic oligonucleotide
  Target: ATXN1; (-) strand; PAM type: NRG; PAM sequence: CAG
cgtaacttctgctagaatca

SEQ ID NO: 70764 - DNA, 20 bp, Artificial Sequence
  Description of Artificial Sequence: Synthetic oligonucleotide
  Target: ATXN1; (-) strand; PAM type: NRG; PAM sequence: TAG
ttcagacccgtaacttctgc

SEQ ID NO: 70765 - DNA, 20 bp, Artificial Sequence
  Description of Artificial Sequence: Synthetic oligonucleotide
  Target: ATXN1; (-) strand; PAM type: NRG; PAM sequence: CAG
caagggaaatgtcaaatttt

SEQ ID NO: 70766 - DNA, 20 bp, Artificial Sequence
  Description of Artificial Sequence: Synthetic oligonucleotide
  Target: ATXN1; (-) strand; PAM type: NRG; PAM sequence: GGG
cttattttcagtgttttcaa

SEQ ID NO: 70767 - DNA, 20 bp, Artificial Sequence
  Description of Artificial Sequence: Synthetic oligonucleotide
  Target: ATXN1; (-) strand; PAM type: NRG; PAM sequence: AGG
ccttattttcagtgttttca

SEQ ID NO: 70768 - DNA, 20 bp, Artificial Sequence
  Description of Artificial Sequence: Synthetic oligonucleotide
  Target: ATXN1; (-) strand; PAM type: NRG; PAM sequence: AAG
tccttattttcagtgttttc

SEQ ID NO: 70769 - DNA, 20 bp, Artificial Sequence
  Description of Artificial Sequence: Synthetic oligonucleotide
  Target: ATXN1; (-) strand; PAM type: NRG; PAM sequence: CAG
acttttcttttccttatttt

SEQ ID NO: 70770 - DNA, 20 bp, Artificial Sequence
  Description of Artificial Sequence: Synthetic oligonucleotide
  Target: ATXN1; (-) strand; PAM type: NRG; PAM sequence: AAG
agacttgatttttcgattta

SEQ ID NO: 70771 - DNA, 20 bp, Artificial Sequence
  Description of Artificial Sequence: Synthetic oligonucleotide
  Target: ATXN1; (-) strand; PAM type: NRG; PAM sequence: TAG
ccagagagaaatgactaaca

SEQ ID NO: 70772 - DNA, 20 bp, Artificial Sequence
  Description of Artificial Sequence: Synthetic oligonucleotide
  Target: ATXN1; (-) strand; PAM type: NRG; PAM sequence: GAG
acagcccgagcacagccaga

SEQ ID NO: 70773 - DNA, 20 bp, Artificial Sequence
  Description of Artificial Sequence: Synthetic oligonucleotide
  Target: ATXN1; (-) strand; PAM type: NRG; PAM sequence: GAG
tcacagcccgagcacagcca

SEQ ID NO: 70774 - DNA, 20 bp, Artificial Sequence
  Description of Artificial Sequence: Synthetic oligonucleotide
  Target: ATXN1; (-) strand; PAM type: NRG; PAM sequence: CAG
tttcacagcccgagcacagc

SEQ ID NO: 70775 - DNA, 20 bp, Artificial Sequence
  Description of Artificial Sequence: Synthetic oligonucleotide
  Target: ATXN1; (-) strand; PAM type: NRG; PAM sequence: CAG
gcagtttcacagcccgagca

SEQ ID NO: 70776 - DNA, 20 bp, Artificial Sequence
  Description of Artificial Sequence: Synthetic oligonucleotide
  Target: ATXN1; (-) strand; PAM type: NRG; PAM sequence: GAG
atcttgcagtttcacagccc

SEQ ID NO: 70777 - DNA, 20 bp, Artificial Sequence
  Description of Artificial Sequence: Synthetic oligonucleotide
  Target: ATXN1; (-) strand; PAM type: NRG; PAM sequence: CAG
aggtgcatcttgcagtttca

SEQ ID NO: 70778 - DNA, 20 bp, Artificial Sequence
  Description of Artificial Sequence: Synthetic oligonucleotide
  Target: ATXN1; (-) strand; PAM type: NRG; PAM sequence: CAG
acgcacacaggtgcatcttg

SEQ ID NO: 70779 - DNA, 20 bp, Artificial Sequence
  Description of Artificial Sequence: Synthetic oligonucleotide
  Target: ATXN1; (-) strand; PAM type: NRG; PAM sequence: AGG
ccaccatcctatacgcacac

SEQ ID NO: 70780 - DNA, 20 bp, Artificial Sequence
  Description of Artificial Sequence: Synthetic oligonucleotide
  Target: ATXN1; (-) strand; PAM type: NRG; PAM sequence: CAG
tccaccatcctatacgcaca

SEQ ID NO: 70781 - DNA, 20 bp, Artificial Sequence
  Description of Artificial Sequence: Synthetic oligonucleotide
  Target: ATXN1; (-) strand; PAM type: NRG; PAM sequence: CAG
gtccttggagagtgccttag

SEQ ID NO: 70782 - DNA, 20 bp, Artificial Sequence
  Description of Artificial Sequence: Synthetic oligonucleotide
  Target: ATXN1; (-) strand; PAM type: NRG; PAM sequence: TAG
tgtgtccttggagagtgcct

SEQ ID NO: 70783 - DNA, 20 bp, Artificial Sequence
  Description of Artificial Sequence: Synthetic oligonucleotide
  Target: ATXN1; (-) strand; PAM type: NRG; PAM sequence: GAG
tgagagcatgtgtccttgga

SEQ ID NO: 70784 - DNA, 20 bp, Artificial Sequence
  Description of Artificial Sequence: Synthetic oligonucleotide
  Target: ATXN1; (-) strand; PAM type: NRG; PAM sequence: GAG
attgagagcatgtgtccttg

SEQ ID NO: 70785 - DNA, 20 bp, Artificial Sequence
  Description of Artificial Sequence: Synthetic oligonucleotide
  Target: ATXN1; (-) strand; PAM type: NRG; PAM sequence: TGG
tcattgagagcatgtgtcct

SEQ ID NO: 70786 - DNA, 20 bp, Artificial Sequence
  Description of Artificial Sequence: Synthetic oligonucleotide
  Target: ATXN1; (-) strand; PAM type: NRG; PAM sequence: GAG
ccattctgggttgtcattga

SEQ ID NO: 70787 - DNA, 20 bp, Artificial Sequence
  Description of Artificial Sequence: Synthetic oligonucleotide
  Target: ATXN1; (-) strand; PAM type: NRG; PAM sequence: GAG
aaccattctgggttgtcatt

SEQ ID NO: 70788 - DNA, 20 bp, Artificial Sequence
  Description of Artificial Sequence: Synthetic oligonucleotide
  Target: ATXN1; (-) strand; PAM type: NRG; PAM sequence: GGG
agtggcaagaaaaccattct

SEQ ID NO: 70789 - DNA, 20 bp, Artificial Sequence
  Description of Artificial Sequence: Synthetic oligonucleotide
  Target: ATXN1; (-) strand; PAM type: NRG; PAM sequence: TGG
gagtggcaagaaaaccattc

SEQ ID NO: 70790 - DNA, 20 bp, Artificial Sequence
  Description of Artificial Sequence: Synthetic oligonucleotide
  Target: ATXN1; (-) strand; PAM type: NRG; PAM sequence: AAG
gagtagcatctttgagtggc

SEQ ID NO: 70791 - DNA, 20 bp, Artificial Sequence
  Description of Artificial Sequence: Synthetic oligonucleotide
  Target: ATXN1; (-) strand; PAM type: NRG; PAM sequence: TGG
gtgtgagtagcatctttgag

SEQ ID NO: 70792 - DNA, 20 bp, Artificial Sequence
  Description of Artificial Sequence: Synthetic oligonucleotide
  Target: ATXN1; (-) strand; PAM type: NRG; PAM sequence: GAG
cacgtgtgagtagcatcttt

SEQ ID NO: 70793 - DNA, 20 bp, Artificial Sequence
  Description of Artificial Sequence: Synthetic oligonucleotide
  Target: ATXN1; (-) strand; PAM type: NRG; PAM sequence: TAG
ccagcctctccacgtgtgag

SEQ ID NO: 70794 - DNA, 20 bp, Artificial Sequence
  Description of Artificial Sequence: Synthetic oligonucleotide
  Target: ATXN1; (-) strand; PAM type: NRG; PAM sequence: GAG
gagccagcctctccacgtgt

SEQ ID NO: 70795 - DNA, 20 bp, Artificial Sequence
  Description of Artificial Sequence: Synthetic oligonucleotide
  Target: ATXN1; (-) strand; PAM type: NRG; PAM sequence: CAG
actttaattgtttctagagc

SEQ ID NO: 70796 - DNA, 20 bp, Artificial Sequence
  Description of Artificial Sequence: Synthetic oligonucleotide
  Target: ATXN1; (-) strand; PAM type: NRG; PAM sequence: GAG
ctggactttaattgtttcta

SEQ ID NO: 70797 - DNA, 20 bp, Artificial Sequence
  Description of Artificial Sequence: Synthetic oligonucleotide
  Target: ATXN1; (-) strand; PAM type: NRG; PAM sequence: TAG
ttctggactttaattgtttc

SEQ ID NO: 70798 - DNA, 20 bp, Artificial Sequence
  Description of Artificial Sequence: Synthetic oligonucleotide
  Target: ATXN1; (-) strand; PAM type: NRG; PAM sequence: TGG
gcaatttaggatccttattc

SEQ ID NO: 70799 - DNA, 20 bp, Artificial Sequence
  Description of Artificial Sequence: Synthetic oligonucleotide
  Target: ATXN1; (-) strand; PAM type: NRG; PAM sequence: AGG
tttaaaatattgagcaattt

SEQ ID NO: 70800 - DNA, 20 bp, Artificial Sequence
  Description of Artificial Sequence: Synthetic oligonucleotide
  Target: ATXN1; (-) strand; PAM type: NRG; PAM sequence: TAG
gtttaaaatattgagcaatt

SEQ ID NO: 70801 - DNA, 20 bp, Artificial Sequence
  Description of Artificial Sequence: Synthetic oligonucleotide
  Target: ATXN1; (-) strand; PAM type: NRG; PAM sequence: GAG
catagaatgtttaaaatatt

SEQ ID NO: 70802 - DNA, 20 bp, Artificial Sequence
  Description of Artificial Sequence: Synthetic oligonucleotide
  Target: ATXN1; (-) strand; PAM type: NRG; PAM sequence: TAG
tgagttggggtacagtggca

SEQ ID NO: 70803 - DNA, 20 bp, Artificial Sequence
  Description of Artificial Sequence: Synthetic oligonucleotide
  Target: ATXN1; (-) strand; PAM type: NRG; PAM sequence: TGG
aagtgtgagttggggtacag

SEQ ID NO: 70804 - DNA, 20 bp, Artificial Sequence
  Description of Artificial Sequence: Synthetic oligonucleotide
  Target: ATXN1; (-) strand; PAM type: NRG; PAM sequence: CAG
gacaagtgtgagttggggta

SEQ ID NO: 70805 - DNA, 20 bp, Artificial Sequence
  Description of Artificial Sequence: Synthetic oligonucleotide
  Target: ATXN1; (-) strand; PAM type: NRG; PAM sequence: GGG
agaaagacaagtgtgagttg

SEQ ID NO: 70806 - DNA, 20 bp, Artificial Sequence
  Description of Artificial Sequence: Synthetic oligonucleotide
  Target: ATXN1; (-) strand; PAM type: NRG; PAM sequence: GGG
tagaaagacaagtgtgagtt

SEQ ID NO: 70807 - DNA, 20 bp, Artificial Sequence
  Description of Artificial Sequence: Synthetic oligonucleotide
  Target: ATXN1; (-) strand; PAM type: NRG; PAM sequence: TGG
ttagaaagacaagtgtgagt

SEQ ID NO: 70808 - DNA, 20 bp, Artificial Sequence
  Description of Artificial Sequence: Synthetic oligonucleotide
  Target: ATXN1; (-) strand; PAM type: NRG; PAM sequence: GAG
ctggttagaaagacaagtgt

SEQ ID NO: 70809 - DNA, 20 bp, Artificial Sequence
  Description of Artificial Sequence: Synthetic oligonucleotide
  Target: ATXN1; (-) strand; PAM type: NRG; PAM sequence: AAG
agtgagctggttagaaagac

SEQ ID NO: 70810 - DNA, 20 bp, Artificial Sequence
  Description of Artificial Sequence: Synthetic oligonucleotide
  Target: ATXN1; (-) strand; PAM type: NRG; PAM sequence: AAG
catagagtgagctggttaga

SEQ ID NO: 70811 - DNA, 20 bp, Artificial Sequence
  Description of Artificial Sequence: Synthetic oligonucleotide
  Target: ATXN1; (-) strand; PAM type: NRG; PAM sequence: TAG
tagacatagagtgagctggt

SEQ ID NO: 70812 - DNA, 20 bp, Artificial Sequence
  Description of Artificial Sequence: Synthetic oligonucleotide
  Target: ATXN1; (-) strand; PAM type: NRG; PAM sequence: TGG
tcattagacatagagtgagc

SEQ ID NO: 70813 - DNA, 20 bp, Artificial Sequence
  Description of Artificial Sequence: Synthetic oligonucleotide
  Target: ATXN1; (-) strand; PAM type: NRG; PAM sequence: GAG
ttgctcattagacatagagt

SEQ ID NO: 70814 - DNA, 20 bp, Artificial Sequence
  Description of Artificial Sequence: Synthetic oligonucleotide
  Target: ATXN1; (-) strand; PAM type: NRG; PAM sequence: GAG
tgacttgctcattagacata

SEQ ID NO: 70815 - DNA, 20 bp, Artificial Sequence
  Description of Artificial Sequence: Synthetic oligonucleotide
  Target: ATXN1; (-) strand; PAM type: NRG; PAM sequence: TAG
gatgacttgctcattagaca

SEQ ID NO: 70816 - DNA, 20 bp, Artificial Sequence
  Description of Artificial Sequence: Synthetic oligonucleotide
  Target: ATXN1; (-) strand; PAM type: NRG; PAM sequence: TAG
tttagggatgacttgctcat

SEQ ID NO: 70817 - DNA, 20 bp, Artificial Sequence
  Description of Artificial Sequence: Synthetic oligonucleotide
  Target: ATXN1; (-) strand; PAM type: NRG; PAM sequence: GGG
catggcttcataaggattta

SEQ ID NO: 70818 - DNA, 20 bp, Artificial Sequence
  Description of Artificial Sequence: Synthetic oligonucleotide
  Target: ATXN1; (-) strand; PAM type: NRG; PAM sequence: AGG
acatggcttcataaggattt

SEQ ID NO: 70819 - DNA, 20 bp, Artificial Sequence
  Description of Artificial Sequence: Synthetic oligonucleotide
  Target: ATXN1; (-) strand; PAM type: NRG; PAM sequence: TAG
tacatggcttcataaggatt

SEQ ID NO: 70820 - DNA, 20 bp, Artificial Sequence
  Description of Artificial Sequence: Synthetic oligonucleotide
  Target: ATXN1; (-) strand; PAM type: NRG; PAM sequence: AGG
ccccactacatggcttcata

SEQ ID NO: 70821 - DNA, 20 bp, Artificial Sequence
  Description of Artificial Sequence: Synthetic oligonucleotide
  Target: ATXN1; (-) strand; PAM type: NRG; PAM sequence: AAG
tccccactacatggcttcat

SEQ ID NO: 70822 - DNA, 20 bp, Artificial Sequence
  Description of Artificial Sequence: Synthetic oligonucleotide
  Target: ATXN1; (-) strand; PAM type: NRG; PAM sequence: TGG
gggggacactccccactaca

SEQ ID NO: 70823 - DNA, 20 bp, Artificial Sequence
  Description of Artificial Sequence: Synthetic oligonucleotide
  Target: ATXN1; (-) strand; PAM type: NRG; PAM sequence: GGG
ttcttcacctgtctttatgg

SEQ ID NO: 70824 - DNA, 20 bp, Artificial Sequence
  Description of Artificial Sequence: Synthetic oligonucleotide
  Target: ATXN1; (-) strand; PAM type: NRG; PAM sequence: GGG
gttcttcacctgtctttatg

SEQ ID NO: 70825 - DNA, 20 bp, Artificial Sequence
  Description of Artificial Sequence: Synthetic oligonucleotide
  Target: ATXN1; (-) strand; PAM type: NRG; PAM sequence: GGG
agttcttcacctgtctttat

SEQ ID NO: 70826 - DNA, 20 bp, Artificial Sequence
  Description of Artificial Sequence: Synthetic oligonucleotide
  Target: ATXN1; (-) strand; PAM type: NRG; PAM sequence: TGG
gagttcttcacctgtcttta

SEQ ID NO: 70827 - DNA, 20 bp, Artificial Sequence
  Description of Artificial Sequence: Synthetic oligonucleotide
  Target: ATXN1; (-) strand; PAM type: NRG; PAM sequence: GAG
cctgttaaaggagtatcttg

SEQ ID NO: 70828 - DNA, 20 bp, Artificial Sequence
  Description of Artificial Sequence: Synthetic oligonucleotide
  Target: ATXN1; (-) strand; PAM type: NRG; PAM sequence: TGG
ctcctgttaaaggagtatct

SEQ ID NO: 70829 - DNA, 20 bp, Artificial Sequence
  Description of Artificial Sequence: Synthetic oligonucleotide
  Target: ATXN1; (-) strand; PAM type: NRG; PAM sequence: GAG
tacctttactcctgttaaag

SEQ ID NO: 70830 - DNA, 20 bp, Artificial Sequence
  Description of Artificial Sequence: Synthetic oligonucleotide
  Target: ATXN1; (-) strand; PAM type: NRG; PAM sequence: AGG
aatacctttactcctgttaa

SEQ ID NO: 70831 - DNA, 20 bp, Artificial Sequence
  Description of Artificial Sequence: Synthetic oligonucleotide
  Target: ATXN1; (-) strand; PAM type: NRG; PAM sequence: AAG
aaatacctttactcctgtta

SEQ ID NO: 70832 - DNA, 20 bp, Artificial Sequence
  Description of Artificial Sequence: Synthetic oligonucleotide
  Target: ATXN1; (-) strand; PAM type: NRG; PAM sequence: TAG
gcagcagaaggacattttaa

SEQ ID NO: 70833 - DNA, 20 bp, Artificial Sequence
  Description of Artificial Sequence: Synthetic oligonucleotide
  Target: ATXN1; (-) strand; PAM type: NRG; PAM sequence: AGG
ttttcttttgaagcagcaga

SEQ ID NO: 70834 - DNA, 20 bp, Artificial Sequence
  Description of Artificial Sequence: Synthetic oligonucleotide
  Target: ATXN1; (-) strand; PAM type: NRG; PAM sequence: AAG
tttttcttttgaagcagcag

SEQ ID NO: 70835 - DNA, 20 bp, Artificial Sequence
  Description of Artificial Sequence: Synthetic oligonucleotide
  Target: ATXN1; (-) strand; PAM type: NRG; PAM sequence: CAG
tattttttcttttgaagcag

SEQ ID NO: 70836 - DNA, 20 bp, Artificial Sequence
  Description of Artificial Sequence: Synthetic oligonucleotide
  Target: ATXN1; (-) strand; PAM type: NRG; PAM sequence: CAG
caatattttttcttttgaag

SEQ ID NO: 70837 - DNA, 20 bp, Artificial Sequence
  Description of Artificial Sequence: Synthetic oligonucleotide
  Target: ATXN1; (-) strand; PAM type: NRG; PAM sequence: AAG
gcacaatattttttcttttg

SEQ ID NO: 70838 - DNA, 20 bp, Artificial Sequence
  Description of Artificial Sequence: Synthetic oligonucleotide
  Target: ATXN1; (-) strand; PAM type: NRG; PAM sequence: AGG
aaaacacactgtgtgaatga

SEQ ID NO: 70839 - DNA, 20 bp, Artificial Sequence
  Description of Artificial Sequence: Synthetic oligonucleotide
  Target: ATXN1; (-) strand; PAM type: NRG; PAM sequence: AAG
caaaacacactgtgtgaatg

SEQ ID NO: 70840 - DNA, 20 bp, Artificial Sequence
  Description of Artificial Sequence: Synthetic oligonucleotide
  Target: ATXN1; (-) strand; PAM type: NRG; PAM sequence: GAG
gctatgtccagaaaagagaa

SEQ ID NO: 70841 - DNA, 20 bp, Artificial Sequence
  Description of Artificial Sequence: Synthetic oligonucleotide
  Target: ATXN1; (-) strand; PAM type: NRG; PAM sequence: AAG
aagctatgtccagaaaagag

SEQ ID NO: 70842 - DNA, 20 bp, Artificial Sequence
  Description of Artificial Sequence: Synthetic oligonucleotide
  Target: ATXN1; (-) strand; PAM type: NRG; PAM sequence: GAG
tggaagctatgtccagaaaa

SEQ ID NO: 70843 - DNA, 20 bp, Artificial Sequence
  Description of Artificial Sequence: Synthetic oligonucleotide
  Target: ATXN1; (-) strand; PAM type: NRG; PAM sequence: AAG
gttggaagctatgtccagaa

SEQ ID NO: 70844 - DNA, 20 bp, Artificial Sequence
  Description of Artificial Sequence: Synthetic oligonucleotide
  Target: ATXN1; (-) strand; PAM type: NRG; PAM sequence: CAG
ttgctgttggaagctatgtc

SEQ ID NO: 70845 - DNA, 20 bp, Artificial Sequence
  Description of Artificial Sequence: Synthetic oligonucleotide
  Target: ATXN1; (-) strand; PAM type: NRG; PAM sequence: AAG
cttctaatttttgctgttgg

SEQ ID NO: 70846 - DNA, 20 bp, Artificial Sequence
  Description of Artificial Sequence: Synthetic oligonucleotide
  Target: ATXN1; (-) strand; PAM type: NRG; PAM sequence: TGG
acacttctaatttttgctgt

SEQ ID NO: 70847 - DNA, 20 bp, Artificial Sequence
  Description of Artificial Sequence: Synthetic oligonucleotide
  Target: ATXN1; (-) strand; PAM type: NRG; PAM sequence: TGG
tataaatttagtgagtggag

SEQ ID NO: 70848 - DNA, 20 bp, Artificial Sequence
  Description of Artificial Sequence: Synthetic oligonucleotide
  Target: ATXN1; (-) strand; PAM type: NRG; PAM sequence: GAG
ttttataaatttagtgagtg

SEQ ID NO: 70849 - DNA, 20 bp, Artificial Sequence
  Description of Artificial Sequence: Synthetic oligonucleotide
  Target: ATXN1; (-) strand; PAM type: NRG; PAM sequence: TGG
tcttttataaatttagtgag

SEQ ID NO: 70850 - DNA, 20 bp, Artificial Sequence
  Description of Artificial Sequence: Synthetic oligonucleotide
  Target: ATXN1; (-) strand; PAM type: NRG; PAM sequence: GAG
gtatcttttataaatttagt

SEQ ID NO: 70851 - DNA, 20 bp, Artificial Sequence
  Description of Artificial Sequence: Synthetic oligonucleotide
  Target: ATXN1; (-) strand; PAM type: NRG; PAM sequence: TAG
ttgagtatcttttataaatt

SEQ ID NO: 70852 - DNA, 20 bp, Artificial Sequence
  Description of Artificial Sequence: Synthetic oligonucleotide
  Target: ATXN1; (-) strand; PAM type: NRG; PAM sequence: GAG
tgaaaagtgtgagtatcttt

SEQ ID NO: 70853 - DNA, 20 bp, Artificial Sequence
  Description of Artificial Sequence: Synthetic oligonucleotide
  Target: ATXN1; (-) strand; PAM type: NRG; PAM sequence: GAG
ggtagacttgtgaaaagtgt

SEQ ID NO: 70854 - DNA, 20 bp, Artificial Sequence
  Description of Artificial Sequence: Synthetic oligonucleotide
  Target: ATXN1; (-) strand; PAM type: NRG; PAM sequence: AAG
gatgggggtagacttgtgaa

SEQ ID NO: 70855 - DNA, 20 bp, Artificial Sequence
  Description of Artificial Sequence: Synthetic oligonucleotide
  Target: ATXN1; (-) strand; PAM type: NRG; PAM sequence: TAG
tggatgtgggcagatggggg

SEQ ID NO: 70856 - DNA, 20 bp, Artificial Sequence
  Description of Artificial Sequence: Synthetic oligonucleotide
  Target: ATXN1; (-) strand; PAM type: NRG; PAM sequence: GGG
tgctggatgtgggcagatgg

SEQ ID NO: 70857 - DNA, 20 bp, Artificial Sequence
  Description of Artificial Sequence: Synthetic oligonucleotide
  Target: ATXN1; (-) strand; PAM type: NRG; PAM sequence: GGG
atgctggatgtgggcagatg

SEQ ID NO: 70858 - DNA, 20 bp, Artificial Sequence
  Description of Artificial Sequence: Synthetic oligonucleotide
  Target: ATXN1; (-) strand; PAM type: NRG; PAM sequence: GGG
gatgctggatgtgggcagat

SEQ ID NO: 70859 - DNA, 20 bp, Artificial Sequence
  Description of Artificial Sequence: Synthetic oligonucleotide
  Target: ATXN1; (-) strand; PAM type: NRG; PAM sequence: TGG
agatgctggatgtgggcaga

SEQ ID NO: 70860 - DNA, 20 bp, Artificial Sequence
  Description of Artificial Sequence: Synthetic oligonucleotide
  Target: ATXN1; (-) strand; PAM type: NRG; PAM sequence: CAG
agatagatgctggatgtggg

SEQ ID NO: 70861 - DNA, 20 bp, Artificial Sequence
  Description of Artificial Sequence: Synthetic oligonucleotide
  Target: ATXN1; (-) strand; PAM type: NRG; PAM sequence: GGG
cgaagatagatgctggatgt

SEQ ID NO: 70862 - DNA, 20 bp, Artificial Sequence
  Description of Artificial Sequence: Synthetic oligonucleotide
  Target: ATXN1; (-) strand; PAM type: NRG; PAM sequence: TGG
gcgaagatagatgctggatg

SEQ ID NO: 70863 - DNA, 20 bp, Artificial Sequence
  Description of Artificial Sequence: Synthetic oligonucleotide
  Target: ATXN1; (-) strand; PAM type: NRG; PAM sequence: TGG
gtcacagcgaagatagatgc

SEQ ID NO: 70864 - DNA, 20 bp, Artificial Sequence
  Description of Artificial Sequence: Synthetic oligonucleotide
  Target: ATXN1; (-) strand; PAM type: NRG; PAM sequence: TAG
tatttctgtcacagcgaaga

SEQ ID NO: 70865 - DNA, 20 bp, Artificial Sequence
  Description of Artificial Sequence: Synthetic oligonucleotide
  Target: ATXN1; (-) strand; PAM type: NRG; PAM sequence: AAG
taattatttctgtcacagcg

SEQ ID NO: 70866 - DNA, 20 bp, Artificial Sequence
  Description of Artificial Sequence: Synthetic oligonucleotide
  Target: ATXN1; (-) strand; PAM type: NRG; PAM sequence: CAG
gatagtaattatttctgtca

SEQ ID NO: 70867 - DNA, 20 bp, Artificial Sequence
  Description of Artificial Sequence: Synthetic oligonucleotide
  Target: ATXN1; (-) strand; PAM type: NRG; PAM sequence: TAG
agtcaaggctgtacagcgga

SEQ ID NO: 70868 - DNA, 20 bp, Artificial Sequence
  Description of Artificial Sequence: Synthetic oligonucleotide
  Target: ATXN1; (-) strand; PAM type: NRG; PAM sequence: CGG
cgccagtcaaggctgtacag

SEQ ID NO: 70869 - DNA, 20 bp, Artificial Sequence
  Description of Artificial Sequence: Synthetic oligonucleotide
  Target: ATXN1; (-) strand; PAM type: NRG; PAM sequence: CAG
ctccgccagtcaaggctgta

SEQ ID NO: 70870 - DNA, 20 bp, Artificial Sequence
  Description of Artificial Sequence: Synthetic oligonucleotide
  Target: ATXN1; (-) strand; PAM type: NRG; PAM sequence: AGG
ctggccagctccgccagtca

SEQ ID NO: 70871 - DNA, 20 bp, Artificial Sequence
  Description of Artificial Sequence: Synthetic oligonucleotide
  Target: ATXN1; (-) strand; PAM type: NRG; PAM sequence: AAG
tctggccagctccgccagtc

SEQ ID NO: 70872 - DNA, 20 bp, Artificial Sequence
  Description of Artificial Sequence: Synthetic oligonucleotide
  Target: ATXN1; (-) strand; PAM type: NRG; PAM sequence: CAG
aatgttctggccagctccgc

SEQ ID NO: 70873 - DNA, 20 bp, Artificial Sequence
  Description of Artificial Sequence: Synthetic oligonucleotide
  Target: ATXN1; (-) strand; PAM type: NRG; PAM sequence: CAG
ccgtaaggcaatgttctggc

SEQ ID NO: 70874 - DNA, 20 bp, Artificial Sequence
  Description of Artificial Sequence: Synthetic oligonucleotide
  Target: ATXN1; (-) strand; PAM type: NRG; PAM sequence: TGG
acccccgtaaggcaatgttc

SEQ ID NO: 70875 - DNA, 20 bp, Artificial Sequence
  Description of Artificial Sequence: Synthetic oligonucleotide
  Target: ATXN1; (-) strand; PAM type: NRG; PAM sequence: AGG
caaggtgatacacccccgta

SEQ ID NO: 70876 - DNA, 20 bp, Artificial Sequence
  Description of Artificial Sequence: Synthetic oligonucleotide
  Target: ATXN1; (-) strand; PAM type: NRG; PAM sequence: AAG
tcaaggtgatacacccccgt

SEQ ID NO: 70877 - DNA, 20 bp, Artificial Sequence
  Description of Artificial Sequence: Synthetic oligonucleotide
  Target: ATXN1; (-) strand; PAM type: NRG; PAM sequence: AGG
cagcaggtaaacagacttca

SEQ ID NO: 70878 - DNA, 20 bp, Artificial Sequence
  Description of Artificial Sequence: Synthetic oligonucleotide
  Target: ATXN1; (-) strand; PAM type: NRG; PAM sequence: AAG
ccagcaggtaaacagacttc

SEQ ID NO: 70879 - DNA, 20 bp, Artificial Sequence
  Description of Artificial Sequence: Synthetic oligonucleotide
  Target: ATXN1; (-) strand; PAM type: NRG; PAM sequence: CAG
gacatggaccagcaggtaaa

SEQ ID NO: 70880 - DNA, 20 bp, Artificial Sequence
  Description of Artificial Sequence: Synthetic oligonucleotide
  Target: ATXN1; (-) strand; PAM type: NRG; PAM sequence: AGG
catcattgacatggaccagc

SEQ ID NO: 70881 - DNA, 20 bp, Artificial Sequence
  Description of Artificial Sequence: Synthetic oligonucleotide
  Target: ATXN1; (-) strand; PAM type: NRG; PAM sequence: CAG
acatcattgacatggaccag

SEQ ID NO: 70882 - DNA, 20 bp, Artificial Sequence
  Description of Artificial Sequence: Synthetic oligonucleotide
  Target: ATXN1; (-) strand; PAM type: NRG; PAM sequence: CAG
tgaacatcattgacatggac

SEQ ID NO: 70883 - DNA, 20 bp, Artificial Sequence
  Description of Artificial Sequence: Synthetic oligonucleotide
  Target: ATXN1; (-) strand; PAM type: NRG; PAM sequence: TGG
gcagctgaacatcattgaca

SEQ ID NO: 70884 - DNA, 20 bp, Artificial Sequence
  Description of Artificial Sequence: Synthetic oligonucleotide
  Target: ATXN1; (-) strand; PAM type: NRG; PAM sequence: CAG
agatgtggaagcgcagagtg

SEQ ID NO: 70885 - DNA, 20 bp, Artificial Sequence
  Description of Artificial Sequence: Synthetic oligonucleotide
  Target: ATXN1; (-) strand; PAM type: NRG; PAM sequence: GAG
taaacagatgtggaagcgca

SEQ ID NO: 70886 - DNA, 20 bp, Artificial Sequence
  Description of Artificial Sequence: Synthetic oligonucleotide
  Target: ATXN1; (-) strand; PAM type: NRG; PAM sequence: CAG
gttaaacagatgtggaagcg

SEQ ID NO: 70887 - DNA, 20 bp, Artificial Sequence
  Description of Artificial Sequence: Synthetic oligonucleotide
  Target: ATXN1; (-) strand; PAM type: NRG; PAM sequence: AAG
tggaagttaaacagatgtgg

SEQ ID NO: 70888 - DNA, 20 bp, Artificial Sequence
  Description of Artificial Sequence: Synthetic oligonucleotide
  Target: ATXN1; (-) strand; PAM type: NRG; PAM sequence: TGG
gagtggaagttaaacagatg

SEQ ID NO: 70889 - DNA, 20 bp, Artificial Sequence
  Description of Artificial Sequence: Synthetic oligonucleotide
  Target: ATXN1; (-) strand; PAM type: NRG; PAM sequence: CAG
gagtgtgagtggaagttaaa

SEQ ID NO: 70890 - DNA, 20 bp, Artificial Sequence
  Description of Artificial Sequence: Synthetic oligonucleotide
  Target: ATXN1; (-) strand; PAM type: NRG; PAM sequence: AAG
tttagtatgagtgtgagtgg

SEQ ID NO: 70891 - DNA, 20 bp, Artificial Sequence
  Description of Artificial Sequence: Synthetic oligonucleotide
  Target: ATXN1; (-) strand; PAM type: NRG; PAM sequence: TGG
gaatttagtatgagtgtgag

SEQ ID NO: 70892 - DNA, 20 bp, Artificial Sequence
  Description of Artificial Sequence: Synthetic oligonucleotide
  Target: ATXN1; (-) strand; PAM type: NRG; PAM sequence: GAG
gtagaatttagtatgagtgt

SEQ ID NO: 70893 - DNA, 20 bp, Artificial Sequence
  Description of Artificial Sequence: Synthetic oligonucleotide
  Target: ATXN1; (-) strand; PAM type: NRG; PAM sequence: GAG
tctggagtagaatttagtat

SEQ ID NO: 70894 - DNA, 20 bp, Artificial Sequence
  Description of Artificial Sequence: Synthetic oligonucleotide
  Target: ATXN1; (-) strand; PAM type: NRG; PAM sequence: TAG
cgttgctctggagtagaatt

SEQ ID NO: 70895 - DNA, 20 bp, Artificial Sequence
  Description of Artificial Sequence: Synthetic oligonucleotide
  Target: ATXN1; (-) strand; PAM type: NRG; PAM sequence: TAG
ccagccacgttgctctggag

SEQ ID NO: 70896 - DNA, 20 bp, Artificial Sequence
  Description of Artificial Sequence: Synthetic oligonucleotide
  Target: ATXN1; (-) strand; PAM type: NRG; PAM sequence: GAG
ggcccagccacgttgctctg

SEQ ID NO: 70897 - DNA, 20 bp, Artificial Sequence
  Description of Artificial Sequence: Synthetic oligonucleotide
  Target: ATXN1; (-) strand; PAM type: NRG; PAM sequence: TGG
gaggcccagccacgttgctc

SEQ ID NO: 70898 - DNA, 20 bp, Artificial Sequence
  Description of Artificial Sequence: Synthetic oligonucleotide
  Target: ATXN1; (-) strand; PAM type: NRG; PAM sequence: CAG
atccttagacagaagaggcc

SEQ ID NO: 70899 - DNA, 20 bp, Artificial Sequence
  Description of Artificial Sequence: Synthetic oligonucleotide
  Target: ATXN1; (-) strand; PAM type: NRG; PAM sequence: AGG
gccacatccttagacagaag

SEQ ID NO: 70900 - DNA, 20 bp, Artificial Sequence
  Description of Artificial Sequence: Synthetic oligonucleotide
  Target: ATXN1; (-) strand; PAM type: NRG; PAM sequence: GAG
agccacatccttagacagaa

SEQ ID NO: 70901 - DNA, 20 bp, Artificial Sequence
  Description of Artificial Sequence: Synthetic oligonucleotide
  Target: ATXN1; (-) strand; PAM type: NRG; PAM sequence: AAG
gcagccacatccttagacag

SEQ ID NO: 70902 - DNA, 20 bp, Artificial Sequence
  Description of Artificial Sequence: Synthetic oligonucleotide
  Target: ATXN1; (-) strand; PAM type: NRG; PAM sequence: CAG
ggagcagccacatccttaga

SEQ ID NO: 70903 - DNA, 20 bp, Artificial Sequence
  Description of Artificial Sequence: Synthetic oligonucleotide
  Target: ATXN1; (-) strand; PAM type: NRG; PAM sequence: TAG
acgtggagcagccacatcct

SEQ ID NO: 70904 - DNA, 20 bp, Artificial Sequence
  Description of Artificial Sequence: Synthetic oligonucleotide
  Target: ATXN1; (-) strand; PAM type: NRG; PAM sequence: CAG
gtcatcggaaatacgtggag

SEQ ID NO: 70905 - DNA, 20 bp, Artificial Sequence
  Description of Artificial Sequence: Synthetic oligonucleotide
  Target: ATXN1; (-) strand; PAM type: NRG; PAM sequence: GAG
tctgtcatcggaaatacgtg

SEQ ID NO: 70906 - DNA, 20 bp, Artificial Sequence
  Description of Artificial Sequence: Synthetic oligonucleotide
  Target: ATXN1; (-) strand; PAM type: NRG; PAM sequence: TGG
attctgtcatcggaaatacg

SEQ ID NO: 70907 - DNA, 20 bp, Artificial Sequence
  Description of Artificial Sequence: Synthetic oligonucleotide
  Target: ATXN1; (-) strand; PAM type: NRG; PAM sequence: CGG
atgatttgctattctgtcat

SEQ ID NO: 70908 - DNA, 20 bp, Artificial Sequence
  Description of Artificial Sequence: Synthetic oligonucleotide
  Target: ATXN1; (-) strand; PAM type: NRG; PAM sequence: TGG
gtcgaagccctttggttctc

SEQ ID NO: 70909 - DNA, 20 bp, Artificial Sequence
  Description of Artificial Sequence: Synthetic oligonucleotide
  Target: ATXN1; (-) strand; PAM type: NRG; PAM sequence: TGG
ctcctgaagtcgaagccctt

SEQ ID NO: 70910 - DNA, 20 bp, Artificial Sequence
  Description of Artificial Sequence: Synthetic oligonucleotide
  Target: ATXN1; (-) strand; PAM type: NRG; PAM sequence: AAG
aaggaggtctcctgaagtcg

SEQ ID NO: 70911 - DNA, 20 bp, Artificial Sequence
  Description of Artificial Sequence: Synthetic oligonucleotide
  Target: ATXN1; (-) strand; PAM type: NRG; PAM sequence: AAG
gcccacaaggaggtctcctg

SEQ ID NO: 70912 - DNA, 20 bp, Artificial Sequence
  Description of Artificial Sequence: Synthetic oligonucleotide
  Target: ATXN1; (-) strand; PAM type: NRG; PAM sequence: AGG
ctgtgcgattgcccacaagg

SEQ ID NO: 70913 - DNA, 20 bp, Artificial Sequence
  Description of Artificial Sequence: Synthetic oligonucleotide
  Target: ATXN1; (-) strand; PAM type: NRG; PAM sequence: GAG
tctgtgcgattgcccacaag

SEQ ID NO: 70914 - DNA, 20 bp, Artificial Sequence
  Description of Artificial Sequence: Synthetic oligonucleotide
  Target: ATXN1; (-) strand; PAM type: NRG; PAM sequence: AGG
tatctgtgcgattgcccaca

SEQ ID NO: 70915 - DNA, 20 bp, Artificial Sequence
  Description of Artificial Sequence: Synthetic oligonucleotide
  Target: ATXN1; (-) strand; PAM type: NRG; PAM sequence: AAG
gtatctgtgcgattgcccac

SEQ ID NO: 70916 - DNA, 20 bp, Artificial Sequence
  Description of Artificial Sequence: Synthetic oligonucleotide
  Target: ATXN1; (-) strand; PAM type: NRG; PAM sequence: TGG
ccgaaaagattggaaagtca

SEQ ID NO: 70917 - DNA, 20 bp, Artificial Sequence
  Description of Artificial Sequence: Synthetic oligonucleotide
  Target: ATXN1; (-) strand; PAM type: NRG; PAM sequence: AAG
acacctccgaaaagattgga

SEQ ID NO: 70918 - DNA, 20 bp, Artificial Sequence
  Description of Artificial Sequence: Synthetic oligonucleotide
  Target: ATXN1; (-) strand; PAM type: NRG; PAM sequence: TGG
aacaacacctccgaaaagat

SEQ ID NO: 70919 - DNA, 20 bp, Artificial Sequence
  Description of Artificial Sequence: Synthetic oligonucleotide
  Target: ATXN1; (-) strand; PAM type: NRG; PAM sequence: AAG
atttgaacaacacctccgaa

SEQ ID NO: 70920 - DNA, 20 bp, Artificial Sequence
  Description of Artificial Sequence: Synthetic oligonucleotide
  Target: ATXN1; (-) strand; PAM type: NRG; PAM sequence: CGG
gcgcatagcctgaacgaaag

SEQ ID NO: 70921 - DNA, 20 bp, Artificial Sequence
  Description of Artificial Sequence: Synthetic oligonucleotide
  Target: ATXN1; (-) strand; PAM type: NRG; PAM sequence: AAG
gaggcgcatagcctgaacga

SEQ ID NO: 70922 - DNA, 20 bp, Artificial Sequence
  Description of Artificial Sequence: Synthetic oligonucleotide
  Target: ATXN1; (-) strand; PAM type: NRG; PAM sequence: TAG
ggccacctcctagaggcgca

SEQ ID NO: 70923 - DNA, 20 bp, Artificial Sequence
  Description of Artificial Sequence: Synthetic oligonucleotide
  Target: ATXN1; (-) strand; PAM type: NRG; PAM sequence: AGG
gtagagaggccacctcctag

SEQ ID NO: 70924 - DNA, 20 bp, Artificial Sequence
  Description of Artificial Sequence: Synthetic oligonucleotide
  Target: ATXN1; (-) strand; PAM type: NRG; PAM sequence: GAG
cgtagagaggccacctccta

SEQ ID NO: 70925 - DNA, 20 bp, Artificial Sequence
  Description of Artificial Sequence: Synthetic oligonucleotide
  Target: ATXN1; (-) strand; PAM type: NRG; PAM sequence: TAG
cacgtagagaggccacctcc

SEQ ID NO: 70926 - DNA, 20 bp, Artificial Sequence
  Description of Artificial Sequence: Synthetic oligonucleotide
  Target: ATXN1; (-) strand; PAM type: NRG; PAM sequence: AGG
ggcagggtagccacgtagag

SEQ ID NO: 70927 - DNA, 20 bp, Artificial Sequence
  Description of Artificial Sequence: Synthetic oligonucleotide
  Target: ATXN1; (-) strand; PAM type: NRG; PAM sequence: GAG
tggcagggtagccacgtaga

SEQ ID NO: 70928 - DNA, 20 bp, Artificial Sequence
  Description of Artificial Sequence: Synthetic oligonucleotide
  Target: ATXN1; (-) strand; PAM type: NRG; PAM sequence: GAG
catggcagggtagccacgta

SEQ ID NO: 70929 - DNA, 20 bp, Artificial Sequence
  Description of Artificial Sequence: Synthetic oligonucleotide
  Target: ATXN1; (-) strand; PAM type: NRG; PAM sequence: TAG
gccatggcagggtagccacg

SEQ ID NO: 70930 - DNA, 20 bp, Artificial Sequence
  Description of Artificial Sequence: Synthetic oligonucleotide
  Target: ATXN1; (-) strand; PAM type: NRG; PAM sequence: TAG
ctggaagggccatggcaggg

SEQ ID NO: 70931 - DNA, 20 bp, Artificial Sequence
  Description of Artificial Sequence: Synthetic oligonucleotide
  Target: ATXN1; (-) strand; PAM type: NRG; PAM sequence: GGG
cagctggaagggccatggca

SEQ ID NO: 70932 - DNA, 20 bp, Artificial Sequence
  Description of Artificial Sequence: Synthetic oligonucleotide
  Target: ATXN1; (-) strand; PAM type: NRG; PAM sequence: AGG
ccagctggaagggccatggc

SEQ ID NO: 70933 - DNA, 20 bp, Artificial Sequence
  Description of Artificial Sequence: Synthetic oligonucleotide
  Target: ATXN1; (-) strand; PAM type: NRG; PAM sequence: CAG
gccagctggaagggccatgg

SEQ ID NO: 70934 - DNA, 20 bp, Artificial Sequence
  Description of Artificial Sequence: Synthetic oligonucleotide
  Target: ATXN1; (-) strand; PAM type: NRG; PAM sequence: TGG
atggccagctggaagggcca

SEQ ID NO: 70935 - DNA, 20 bp, Artificial Sequence
  Description of Artificial Sequence: Synthetic oligonucleotide
  Target: ATXN1; (-) strand; PAM type: NRG; PAM sequence: GGG
ctgccaatggccagctggaa

SEQ ID NO: 70936 - DNA, 20 bp, Artificial Sequence
  Description of Artificial Sequence: Synthetic oligonucleotide
  Target: ATXN1; (-) strand; PAM type: NRG; PAM sequence: AGG
gctgccaatggccagctgga

SEQ ID NO: 70937 - DNA, 20 bp, Artificial Sequence
  Description of Artificial Sequence: Synthetic oligonucleotide
  Target: ATXN1; (-) strand; PAM type: NRG; PAM sequence: AAG
cgctgccaatggccagctgg

SEQ ID NO: 70938 - DNA, 20 bp, Artificial Sequence
  Description of Artificial Sequence: Synthetic oligonucleotide
  Target: ATXN1; (-) strand; PAM type: NRG; PAM sequence: TGG
tggcgctgccaatggccagc

SEQ ID NO: 70939 - DNA, 20 bp, Artificial Sequence
  Description of Artificial Sequence: Synthetic oligonucleotide
  Target: ATXN1; (-) strand; PAM type: NRG; PAM sequence: CAG
gtcctggcgctgccaatggc

SEQ ID NO: 70940 - DNA, 20 bp, Artificial Sequence
  Description of Artificial Sequence: Synthetic oligonucleotide
  Target: ATXN1; (-) strand; PAM type: NRG; PAM sequence: TGG
ctgtgtcctggcgctgccaa

SEQ ID NO: 70941 - DNA, 20 bp, Artificial Sequence
  Description of Artificial Sequence: Synthetic oligonucleotide
  Target: ATXN1; (-) strand; PAM type: NRG; PAM sequence: TGG
gttttctttatgctgtgtcc

SEQ ID NO: 70942 - DNA, 20 bp, Artificial Sequence
  Description of Artificial Sequence: Synthetic oligonucleotide
  Target: ATXN1; (-) strand; PAM type: NRG; PAM sequence: CAG
atcttataagacccaaacca

SEQ ID NO: 70943 - DNA, 20 bp, Artificial Sequence
  Description of Artificial Sequence: Synthetic oligonucleotide
  Target: ATXN1; (-) strand; PAM type: NRG; PAM sequence: AAG
ttggctgtcagtgatcttat

SEQ ID NO: 70944 - DNA, 20 bp, Artificial Sequence
  Description of Artificial Sequence: Synthetic oligonucleotide
  Target: ATXN1; (-) strand; PAM type: NRG; PAM sequence: CAG
tggaatgtatgcttggctgt

SEQ ID NO: 70945 - DNA, 20 bp, Artificial Sequence
  Description of Artificial Sequence: Synthetic oligonucleotide
  Target: ATXN1; (-) strand; PAM type: NRG; PAM sequence: TGG
cagtatttggaatgtatgct

SEQ ID NO: 70946 - DNA, 20 bp, Artificial Sequence
  Description of Artificial Sequence: Synthetic oligonucleotide
  Target: ATXN1; (-) strand; PAM type: NRG; PAM sequence: TGG
cctttgagtcatacagtatt

SEQ ID NO: 70947 - DNA, 20 bp, Artificial Sequence
  Description of Artificial Sequence: Synthetic oligonucleotide
  Target: ATXN1; (-) strand; PAM type: NRG; PAM sequence: CAG
gagatagcctttgagtcata

SEQ ID NO: 70948 - DNA, 20 bp, Artificial Sequence
  Description of Artificial Sequence: Synthetic oligonucleotide
  Target: ATXN1; (-) strand; PAM type: NRG; PAM sequence: GAG
aagtgttcgagatagccttt

SEQ ID NO: 70949 - DNA, 20 bp, Artificial Sequence
  Description of Artificial Sequence: Synthetic oligonucleotide
  Target: ATXN1; (-) strand; PAM type: NRG; PAM sequence: TAG
tttgtaataagtgttcgaga

SEQ ID NO: 70950 - DNA, 20 bp, Artificial Sequence
  Description of Artificial Sequence: Synthetic oligonucleotide
  Target: ATXN1; (-) strand; PAM type: NRG; PAM sequence: GAG
cacatttgtaataagtgttc

SEQ ID NO: 70951 - DNA, 20 bp, Artificial Sequence
  Description of Artificial Sequence: Synthetic oligonucleotide
  Target: ATXN1; (-) strand; PAM type: NRG; PAM sequence: AAG
gagtattacacatttgtaat

SEQ ID NO: 70952 - DNA, 20 bp, Artificial Sequence
  Description of Artificial Sequence: Synthetic oligonucleotide
  Target: ATXN1; (-) strand; PAM type: NRG; PAM sequence: GAG
ttaatctagaaggaaaaatg

SEQ ID NO: 70953 - DNA, 20 bp, Artificial Sequence
  Description of Artificial Sequence: Synthetic oligonucleotide
  Target: ATXN1; (-) strand; PAM type: NRG; PAM sequence: TGG
ctttaatctagaaggaaaaa

SEQ ID NO: 70954 - DNA, 20 bp, Artificial Sequence
  Description of Artificial Sequence: Synthetic oligonucleotide
  Target: ATXN1; (-) strand; PAM type: NRG; PAM sequence: AGG
gggatagtctttaatctaga

SEQ ID NO: 70955 - DNA, 20 bp, Artificial Sequence
  Description of Artificial Sequence: Synthetic oligonucleotide
  Target: ATXN1; (-) strand; PAM type: NRG; PAM sequence: AAG
agggatagtctttaatctag

SEQ ID NO: 70956 - DNA, 20 bp, Artificial Sequence
  Description of Artificial Sequence: Synthetic oligonucleotide
  Target: ATXN1; (-) strand; PAM type: NRG; PAM sequence: TAG
gaaagggatagtctttaatc

SEQ ID NO: 70957 - DNA, 20 bp, Artificial Sequence
  Description of Artificial Sequence: Synthetic oligonucleotide
  Target: ATXN1; (-) strand; PAM type: NRG; PAM sequence: TAG
aaataacgccatgaaaggga

SEQ ID NO: 70958 - DNA, 20 bp, Artificial Sequence
  Description of Artificial Sequence: Synthetic oligonucleotide
  Target: ATXN1; (-) strand; PAM type: NRG; PAM sequence: GGG
ggtgaaataacgccatgaaa

SEQ ID NO: 70959 - DNA, 20 bp, Artificial Sequence
  Description of Artificial Sequence: Synthetic oligonucleotide
  Target: ATXN1; (-) strand; PAM type: NRG; PAM sequence: AGG
gggtgaaataacgccatgaa

SEQ ID NO: 70960 - DNA, 20 bp, Artificial Sequence
  Description of Artificial Sequence: Synthetic oligonucleotide
  Target: ATXN1; (-) strand; PAM type: NRG; PAM sequence: AAG
ggggtgaaataacgccatga

SEQ ID NO: 70961 - DNA, 20 bp, Artificial Sequence
  Description of Artificial Sequence: Synthetic oligonucleotide
  Target: ATXN1; (-) strand; PAM type: NRG; PAM sequence: GGG
atctaccttagagaggtttg

SEQ ID NO: 70962 - DNA, 20 bp, Artificial Sequence
  Description of Artificial Sequence: Synthetic oligonucleotide
  Target: ATXN1; (-) strand; PAM type: NRG; PAM sequence: GGG
gatctaccttagagaggttt

SEQ ID NO: 70963 - DNA, 20 bp, Artificial Sequence
  Description of Artificial Sequence: Synthetic oligonucleotide
  Target: ATXN1; (-) strand; PAM type: NRG; PAM sequence: TGG
agatctaccttagagaggtt

SEQ ID NO: 70964 - DNA, 20 bp, Artificial Sequence
  Description of Artificial Sequence: Synthetic oligonucleotide
  Target: ATXN1; (-) strand; PAM type: NRG; PAM sequence: AGG
gagcaagatctaccttagag

SEQ ID NO: 70965 - DNA, 20 bp, Artificial Sequence
  Description of Artificial Sequence: Synthetic oligonucleotide
  Target: ATXN1; (-) strand; PAM type: NRG; PAM sequence: GAG
ggagcaagatctaccttaga

SEQ ID NO: 70966 - DNA, 20 bp, Artificial Sequence
  Description of Artificial Sequence: Synthetic oligonucleotide
  Target: ATXN1; (-) strand; PAM type: NRG; PAM sequence: GAG
caggagcaagatctacctta

SEQ ID NO: 70967 - DNA, 20 bp, Artificial Sequence
  Description of Artificial Sequence: Synthetic oligonucleotide
  Target: ATXN1; (-) strand; PAM type: NRG; PAM sequence: TAG
gacaggagcaagatctacct

SEQ ID NO: 70968 - DNA, 20 bp, Artificial Sequence
  Description of Artificial Sequence: Synthetic oligonucleotide
  Target: ATXN1; (-) strand; PAM type: NRG; PAM sequence: AAG
tcctgaacccggacaggagc

SEQ ID NO: 70969 - DNA, 20 bp, Artificial Sequence
  Description of Artificial Sequence: Synthetic oligonucleotide
  Target: ATXN1; (-) strand; PAM type: NRG; PAM sequence: GAG
agtttcctgaacccggacag

SEQ ID NO: 70970 - DNA, 20 bp, Artificial Sequence
  Description of Artificial Sequence: Synthetic oligonucleotide
  Target: ATXN1; (-) strand; PAM type: NRG; PAM sequence: AGG
agagtttcctgaacccggac

SEQ ID NO: 70971 - DNA, 20 bp, Artificial Sequence
  Description of Artificial Sequence: Synthetic oligonucleotide
  Target: ATXN1; (-) strand; PAM type: NRG; PAM sequence: CAG
aagagtttcctgaacccgga

SEQ ID NO: 70972 - DNA, 20 bp, Artificial Sequence
  Description of Artificial Sequence: Synthetic oligonucleotide
  Target: ATXN1; (-) strand; PAM type: NRG; PAM sequence: CGG
ggtcaagagtttcctgaacc

SEQ ID NO: 70973 - DNA, 20 bp, Artificial Sequence
  Description of Artificial Sequence: Synthetic oligonucleotide
  Target: ATXN1; (-) strand; PAM type: NRG; PAM sequence: GAG
aggacttccatgagggtcaa

SEQ ID NO: 70974 - DNA, 20 bp, Artificial Sequence
  Description of Artificial Sequence: Synthetic oligonucleotide
  Target: ATXN1; (-) strand; PAM type: NRG; PAM sequence: AAG
gcaggacttccatgagggtc

SEQ ID NO: 70975 - DNA, 20 bp, Artificial Sequence
  Description of Artificial Sequence: Synthetic oligonucleotide
  Target: ATXN1; (-) strand; PAM type: NRG; PAM sequence: GGG
gccatgcaggacttccatga

SEQ ID NO: 70976 - DNA, 20 bp, Artificial Sequence
  Description of Artificial Sequence: Synthetic oligonucleotide
  Target: ATXN1; (-) strand; PAM type: NRG; PAM sequence: AGG
ggccatgcaggacttccatg

SEQ ID NO: 70977 - DNA, 20 bp, Artificial Sequence
  Description of Artificial Sequence: Synthetic oligonucleotide
  Target: ATXN1; (-) strand; PAM type: NRG; PAM sequence: GAG
aggccatgcaggacttccat

SEQ ID NO: 70978 - DNA, 20 bp, Artificial Sequence
  Description of Artificial Sequence: Synthetic oligonucleotide
  Target: ATXN1; (-) strand; PAM type: NRG; PAM sequence: AGG
cctcacttggaaggccatgc

SEQ ID NO: 70979 - DNA, 20 bp, Artificial Sequence
  Description of Artificial Sequence: Synthetic oligonucleotide
  Target: ATXN1; (-) strand; PAM type: NRG; PAM sequence: CAG
ccctcacttggaaggccatg

SEQ ID NO: 70980 - DNA, 20 bp, Artificial Sequence
  Description of Artificial Sequence: Synthetic oligonucleotide
  Target: ATXN1; (-) strand; PAM type: NRG; PAM sequence: AGG
acaactgaccctcacttgga

SEQ ID NO: 70981 - DNA, 20 bp, Artificial Sequence
  Description of Artificial Sequence: Synthetic oligonucleotide
  Target: ATXN1; (-) strand; PAM type: NRG; PAM sequence: AAG
gacaactgaccctcacttgg

SEQ ID NO: 70982 - DNA, 20 bp, Artificial Sequence
  Description of Artificial Sequence: Synthetic oligonucleotide
  Target: ATXN1; (-) strand; PAM type: NRG; PAM sequence: TGG
agtgacaactgaccctcact

SEQ ID NO: 70983 - DNA, 20 bp, Artificial Sequence
  Description of Artificial Sequence: Synthetic oligonucleotide
  Target: ATXN1; (-) strand; PAM type: NRG; PAM sequence: GAG
agtatggtggaagcatcctg

SEQ ID NO: 70984 - DNA, 20 bp, Artificial Sequence
  Description of Artificial Sequence: Synthetic oligonucleotide
  Target: ATXN1; (-) strand; PAM type: NRG; PAM sequence: TGG
aaagtatggtggaagcatcc

SEQ ID NO: 70985 - DNA, 20 bp, Artificial Sequence
  Description of Artificial Sequence: Synthetic oligonucleotide
  Target: ATXN1; (-) strand; PAM type: NRG; PAM sequence: AAG
ggaaatacaaagtatggtgg

SEQ ID NO: 70986 - DNA, 20 bp, Artificial Sequence
  Description of Artificial Sequence: Synthetic oligonucleotide
  Target: ATXN1; (-) strand; PAM type: NRG; PAM sequence: TGG
gacggaaatacaaagtatgg

SEQ ID NO: 70987 - DNA, 20 bp, Artificial Sequence
  Description of Artificial Sequence: Synthetic oligonucleotide
  Target: ATXN1; (-) strand; PAM type: NRG; PAM sequence: TGG
tgagacggaaatacaaagta

SEQ ID NO: 70988 - DNA, 20 bp, Artificial Sequence
  Description of Artificial Sequence: Synthetic oligonucleotide
  Target: ATXN1; (-) strand; PAM type: NRG; PAM sequence: AAG
tactgtgagacggaaataca

SEQ ID NO: 70989 - DNA, 20 bp, Artificial Sequence
  Description of Artificial Sequence: Synthetic oligonucleotide
  Target: ATXN1; (-) strand; PAM type: NRG; PAM sequence: CGG
ctgagaaaggtactgtgaga

SEQ ID NO: 70990 - DNA, 20 bp, Artificial Sequence
  Description of Artificial Sequence: Synthetic oligonucleotide
  Target: ATXN1; (-) strand; PAM type: NRG; PAM sequence: GAG
tgcactgagaaaggtactgt

SEQ ID NO: 70991 - DNA, 20 bp, Artificial Sequence
  Description of Artificial Sequence: Synthetic oligonucleotide
  Target: ATXN1; (-) strand; PAM type: NRG; PAM sequence: AGG
caattaccgtgcactgagaa

SEQ ID NO: 70992 - DNA, 20 bp, Artificial Sequence
  Description of Artificial Sequence: Synthetic oligonucleotide
  Target: ATXN1; (-) strand; PAM type: NRG; PAM sequence: AAG
tcaattaccgtgcactgaga

SEQ ID NO: 70993 - DNA, 20 bp, Artificial Sequence
  Description of Artificial Sequence: Synthetic oligonucleotide
  Target: ATXN1; (-) strand; PAM type: NRG; PAM sequence: GAG
ctagtcaattaccgtgcact

SEQ ID NO: 70994 - DNA, 20 bp, Artificial Sequence
  Description of Artificial Sequence: Synthetic oligonucleotide
  Target: ATXN1; (-) strand; PAM type: NRG; PAM sequence: TAG
gagagtggatagaacatatc

SEQ ID NO: 70995 - DNA, 20 bp, Artificial Sequence
  Description of Artificial Sequence: Synthetic oligonucleotide
  Target: ATXN1; (-) strand; PAM type: NRG; PAM sequence: TAG
agttattataggagagtgga

SEQ ID NO: 70996 - DNA, 20 bp, Artificial Sequence
  Description of Artificial Sequence: Synthetic oligonucleotide
  Target: ATXN1; (-) strand; PAM type: NRG; PAM sequence: TGG
ttatagttattataggagag

SEQ ID NO: 70997 - DNA, 20 bp, Artificial Sequence
  Description of Artificial Sequence: Synthetic oligonucleotide
  Target: ATXN1; (-) strand; PAM type: NRG; PAM sequence: GAG
acattatagttattatagga

SEQ ID NO: 70998 - DNA, 20 bp, Artificial Sequence
  Description of Artificial Sequence: Synthetic oligonucleotide
  Target: ATXN1; (-) strand; PAM type: NRG; PAM sequence: GAG
ctacattatagttattatag

SEQ ID NO: 70999 - DNA, 20 bp, Artificial Sequence
  Description of Artificial Sequence: Synthetic oligonucleotide
  Target: ATXN1; (-) strand; PAM type: NRG; PAM sequence: AGG
cactacattatagttattat

SEQ ID NO: 71000 - DNA, 20 bp, Artificial Sequence
  Description of Artificial Sequence: Synthetic oligonucleotide
  Target: ATXN1; (-) strand; PAM type: NRG; PAM sequence: TAG
gcactacattatagttatta

SEQ ID NO: 71001 - DNA, 20 bp, Artificial Sequence
  Description of Artificial Sequence: Synthetic oligonucleotide
  Target: ATXN1; (-) strand; PAM type: NRG; PAM sequence: TAG
acccacatggcactacatta

SEQ ID NO: 71002 - DNA, 20 bp, Artificial Sequence
  Description of Artificial Sequence: Synthetic oligonucleotide
  Target: ATXN1; (-) strand; PAM type: NRG; PAM sequence: TGG
aaaaatggcccctacccaca

SEQ ID NO: 71003 - DNA, 20 bp, Artificial Sequence
  Description of Artificial Sequence: Synthetic oligonucleotide
  Target: ATXN1; (-) strand; PAM type: NRG; PAM sequence: TGG
taaggtagacaagataaaaa

SEQ ID NO: 71004 - DNA, 20 bp, Artificial Sequence
  Description of Artificial Sequence: Synthetic oligonucleotide
  Target: ATXN1; (-) strand; PAM type: NRG; PAM sequence: AAG
ctgaagatactaaggtagac

SEQ ID NO: 71005 - DNA, 20 bp, Artificial Sequence
  Description of Artificial Sequence: Synthetic oligonucleotide
  Target: ATXN1; (-) strand; PAM type: NRG; PAM sequence: TAG
aagttctgaagatactaagg

SEQ ID NO: 71006 - DNA, 20 bp, Artificial Sequence
  Description of Artificial Sequence: Synthetic oligonucleotide
  Target: ATXN1; (-) strand; PAM type: NRG; PAM sequence: AGG
gctaagttctgaagatacta

SEQ ID NO: 71007 - DNA, 20 bp, Artificial Sequence
  Description of Artificial Sequence: Synthetic oligonucleotide
  Target: ATXN1; (-) strand; PAM type: NRG; PAM sequence: AAG
tgctaagttctgaagatact

SEQ ID NO: 71008 - DNA, 20 bp, Artificial Sequence
  Description of Artificial Sequence: Synthetic oligonucleotide
  Target: ATXN1; (-) strand; PAM type: NRG; PAM sequence: AAG
aagcagagtgctaagttctg

SEQ ID NO: 71009 - DNA, 20 bp, Artificial Sequence
  Description of Artificial Sequence: Synthetic oligonucleotide
  Target: ATXN1; (-) strand; PAM type: NRG; PAM sequence: AAG
catgtaccaagcagagtgct

SEQ ID NO: 71010 - DNA, 20 bp, Artificial Sequence
  Description of Artificial Sequence: Synthetic oligonucleotide
  Target: ATXN1; (-) strand; PAM type: NRG; PAM sequence: GAG
agtctgccatgtaccaagca

SEQ ID NO: 71011 - DNA, 20 bp, Artificial Sequence
  Description of Artificial Sequence: Synthetic oligonucleotide
  Target: ATXN1; (-) strand; PAM type: NRG; PAM sequence: CAG
agagtctgccatgtaccaag

SEQ ID NO: 71012 - DNA, 20 bp, Artificial Sequence
  Description of Artificial Sequence: Synthetic oligonucleotide
  Target: ATXN1; (-) strand; PAM type: NRG; PAM sequence: AAG
ttgagagtctgccatgtacc

SEQ ID NO: 71013 - DNA, 20 bp, Artificial Sequence
  Description of Artificial Sequence: Synthetic oligonucleotide
  Target: ATXN1; (-) strand; PAM type: NRG; PAM sequence: GAG
ctgtcaactgatatttttga

SEQ ID NO: 71014 - DNA, 20 bp, Artificial Sequence
  Description of Artificial Sequence: Synthetic oligonucleotide
  Target: ATXN1; (-) strand; PAM type: NRG; PAM sequence: GAG
gtctgtcaactgatattttt

SEQ ID NO: 71015 - DNA, 20 bp, Artificial Sequence
  Description of Artificial Sequence: Synthetic oligonucleotide
  Target: ATXN1; (-) strand; PAM type: NRG; PAM sequence: CAG
ccacggattctattttcaat

SEQ ID NO: 71016 - DNA, 20 bp, Artificial Sequence
  Description of Artificial Sequence: Synthetic oligonucleotide
  Target: ATXN1; (-) strand; PAM type: NRG; PAM sequence: CGG
atagccattattcagaacca

SEQ ID NO: 71017 - DNA, 20 bp, Artificial Sequence
  Description of Artificial Sequence: Synthetic oligonucleotide
  Target: ATXN1; (-) strand; PAM type: NRG; PAM sequence: CAG
gtgagtaaatagccattatt

SEQ ID NO: 71018 - DNA, 20 bp, Artificial Sequence
  Description of Artificial Sequence: Synthetic oligonucleotide
  Target: ATXN1; (-) strand; PAM type: NRG; PAM sequence: TAG
gctggactggggtgagtaaa

SEQ ID NO: 71019 - DNA, 20 bp, Artificial Sequence
  Description of Artificial Sequence: Synthetic oligonucleotide
  Target: ATXN1; (-) strand; PAM type: NRG; PAM sequence: GAG
tatgcatgctggactggggt

SEQ ID NO: 71020 - DNA, 20 bp, Artificial Sequence
  Description of Artificial Sequence: Synthetic oligonucleotide
  Target: ATXN1; (-) strand; PAM type: NRG; PAM sequence: GGG
gtggtatgcatgctggactg

SEQ ID NO: 71021 - DNA, 20 bp, Artificial Sequence
  Description of Artificial Sequence: Synthetic oligonucleotide
  Target: ATXN1; (-) strand; PAM type: NRG; PAM sequence: GGG
agtggtatgcatgctggact

SEQ ID NO: 71022 - DNA, 20 bp, Artificial Sequence
  Description of Artificial Sequence: Synthetic oligonucleotide
  Target: ATXN1; (-) strand; PAM type: NRG; PAM sequence: TGG
cagtggtatgcatgctggac

SEQ ID NO: 71023 - DNA, 20 bp, Artificial Sequence
  Description of Artificial Sequence: Synthetic oligonucleotide
  Target: ATXN1; (-) strand; PAM type: NRG; PAM sequence: TGG
acagacagtggtatgcatgc

SEQ ID NO: 71024 - DNA, 20 bp, Artificial Sequence
  Description of Artificial Sequence: Synthetic oligonucleotide
  Target: ATXN1; (-) strand; PAM type: NRG; PAM sequence: TGG
gcccatgcggtaacagacag

SEQ ID NO: 71025 - DNA, 20 bp, Artificial Sequence
  Description of Artificial Sequence: Synthetic oligonucleotide
  Target: ATXN1; (-) strand; PAM type: NRG; PAM sequence: CAG
agggcccatgcggtaacaga

SEQ ID NO: 71026 - DNA, 20 bp, Artificial Sequence
  Description of Artificial Sequence: Synthetic oligonucleotide
  Target: ATXN1; (-) strand; PAM type: NRG; PAM sequence: CAG
ggtgagggcccatgcggtaa

SEQ ID NO: 71027 - DNA, 20 bp, Artificial Sequence
  Description of Artificial Sequence: Synthetic oligonucleotide
  Target: ATXN1; (-) strand; PAM type: NRG; PAM sequence: CGG
ggccatggtgagggcccatg

SEQ ID NO: 71028 - DNA, 20 bp, Artificial Sequence
  Description of Artificial Sequence: Synthetic oligonucleotide
  Target: ATXN1; (-) strand; PAM type: NRG; PAM sequence: GGG
gctgttgagggccatggtga

SEQ ID NO: 71029 - DNA, 20 bp, Artificial Sequence
  Description of Artificial Sequence: Synthetic oligonucleotide
  Target: ATXN1; (-) strand; PAM type: NRG; PAM sequence: AGG
ggctgttgagggccatggtg

SEQ ID NO: 71030 - DNA, 20 bp, Artificial Sequence
  Description of Artificial Sequence: Synthetic oligonucleotide
  Target: ATXN1; (-) strand; PAM type: NRG; PAM sequence: GAG
gggctgttgagggccatggt

SEQ ID NO: 71031 - DNA, 20 bp, Artificial Sequence
  Description of Artificial Sequence: Synthetic oligonucleotide
  Target: ATXN1; (-) strand; PAM type: NRG; PAM sequence: TGG
ccatgggctgttgagggcca

SEQ ID NO: 71032 - DNA, 20 bp, Artificial Sequence
  Description of Artificial Sequence: Synthetic oligonucleotide
  Target: ATXN1; (-) strand; PAM type: NRG; PAM sequence: GGG
ctgtggccatgggctgttga

SEQ ID NO: 71033 - DNA, 20 bp, Artificial Sequence
  Description of Artificial Sequence: Synthetic oligonucleotide
  Target: ATXN1; (-) strand; PAM type: NRG; PAM sequence: AGG
gctgtggccatgggctgttg

SEQ ID NO: 71034 - DNA, 20 bp, Artificial Sequence
  Description of Artificial Sequence: Synthetic oligonucleotide
  Target: ATXN1; (-) strand; PAM type: NRG; PAM sequence: GAG
agctgtggccatgggctgtt

SEQ ID NO: 71035 - DNA, 20 bp, Artificial Sequence
  Description of Artificial Sequence: Synthetic oligonucleotide
  Target: ATXN1; (-) strand; PAM type: NRG; PAM sequence: GGG
caggcaatagctgtggccat

SEQ ID NO: 71036 - DNA, 20 bp, Artificial Sequence
  Description of Artificial Sequence: Synthetic oligonucleotide
  Target: ATXN1; (-) strand; PAM type: NRG; PAM sequence: TGG
ccaggcaatagctgtggcca

SEQ ID NO: 71037 - DNA, 20 bp, Artificial Sequence
  Description of Artificial Sequence: Synthetic oligonucleotide
  Target: ATXN1; (-) strand; PAM type: NRG; PAM sequence: TGG
tcagtcccaggcaatagctg

SEQ ID NO: 71038 - DNA, 20 bp, Artificial Sequence
  Description of Artificial Sequence: Synthetic oligonucleotide
  Target: ATXN1; (-) strand; PAM type: NRG; PAM sequence: TAG
ggatggtcagtcccaggcaa

SEQ ID NO: 71039 - DNA, 20 bp, Artificial Sequence
  Description of Artificial Sequence: Synthetic oligonucleotide
  Target: ATXN1; (-) strand; PAM type: NRG; PAM sequence: AGG
tagtagggatggtcagtccc

SEQ ID NO: 71040 - DNA, 20 bp, Artificial Sequence
  Description of Artificial Sequence: Synthetic oligonucleotide
  Target: ATXN1; (-) strand; PAM type: NRG; PAM sequence: CAG
ctagtagggatggtcagtcc

SEQ ID NO: 71041 - DNA, 20 bp, Artificial Sequence
  Description of Artificial Sequence: Synthetic oligonucleotide
  Target: ATXN1; (-) strand; PAM type: NRG; PAM sequence: CAG
acattcctagtagggatggt

SEQ ID NO: 71042 - DNA, 20 bp, Artificial Sequence
  Description of Artificial Sequence: Synthetic oligonucleotide
  Target: ATXN1; (-) strand; PAM type: NRG; PAM sequence: TGG
tgacacattcctagtaggga

SEQ ID NO: 71043 - DNA, 20 bp, Artificial Sequence
  Description of Artificial Sequence: Synthetic oligonucleotide
  Target: ATXN1; (-) strand; PAM type: NRG; PAM sequence: GGG
ggcgtgacacattcctagta

SEQ ID NO: 71044 - DNA, 20 bp, Artificial Sequence
  Description of Artificial Sequence: Synthetic oligonucleotide
  Target: ATXN1; (-) strand; PAM type: NRG; PAM sequence: AGG
gggcgtgacacattcctagt

SEQ ID NO: 71045 - DNA, 20 bp, Artificial Sequence
  Description of Artificial Sequence: Synthetic oligonucleotide
  Target: ATXN1; (-) strand; PAM type: NRG; PAM sequence: TAG
ggggcgtgacacattcctag

SEQ ID NO: 71046 - DNA, 20 bp, Artificial Sequence
  Description of Artificial Sequence: Synthetic oligonucleotide
  Target: ATXN1; (-) strand; PAM type: NRG; PAM sequence: TAG
ttaggggcgtgacacattcc

SEQ ID NO: 71047 - DNA, 20 bp, Artificial Sequence
  Description of Artificial Sequence: Synthetic oligonucleotide
  Target: ATXN1; (-) strand; PAM type: NRG; PAM sequence: GGG
aaactcacagtctcatttag

SEQ ID NO: 71048 - DNA, 20 bp, Artificial Sequence
  Description of Artificial Sequence: Synthetic oligonucleotide
  Target: ATXN1; (-) strand; PAM type: NRG; PAM sequence: GGG
aaaactcacagtctcattta

SEQ ID NO: 71049 - DNA, 20 bp, Artificial Sequence
  Description of Artificial Sequence: Synthetic oligonucleotide
  Target: ATXN1; (-) strand; PAM type: NRG; PAM sequence: AGG
gaaaactcacagtctcattt

SEQ ID NO: 71050 - DNA, 20 bp, Artificial Sequence
  Description of Artificial Sequence: Synthetic oligonucleotide
  Target: ATXN1; (-) strand; PAM type: NRG; PAM sequence: TAG
agaaaactcacagtctcatt

SEQ ID NO: 71051 - DNA, 20 bp, Artificial Sequence
  Description of Artificial Sequence: Synthetic oligonucleotide
  Target: ATXN1; (-) strand; PAM type: NRG; PAM sequence: CAG
ctttaagcagagaaaactca

SEQ ID NO: 71052 - DNA, 20 bp, Artificial Sequence
  Description of Artificial Sequence: Synthetic oligonucleotide
  Target: ATXN1; (-) strand; PAM type: NRG; PAM sequence: GAG
tttctgattgtctttaagca

SEQ ID NO: 71053 - DNA, 20 bp, Artificial Sequence
  Description of Artificial Sequence: Synthetic oligonucleotide
  Target: ATXN1; (-) strand; PAM type: NRG; PAM sequence: CAG
ggtttctgattgtctttaag

SEQ ID NO: 71054 - DNA, 20 bp, Artificial Sequence
  Description of Artificial Sequence: Synthetic oligonucleotide
  Target: ATXN1; (-) strand; PAM type: NRG; PAM sequence: AAG
tttggtttctgattgtcttt

SEQ ID NO: 71055 - DNA, 20 bp, Artificial Sequence
  Description of Artificial Sequence: Synthetic oligonucleotide
  Target: ATXN1; (-) strand; PAM type: NRG; PAM sequence: TGG
gagaaagctataatagcttt

SEQ ID NO: 71056 - DNA, 20 bp, Artificial Sequence
  Description of Artificial Sequence: Synthetic oligonucleotide
  Target: ATXN1; (-) strand; PAM type: NRG; PAM sequence: TAG
ctggaaggagaaagctataa

SEQ ID NO: 71057 - DNA, 20 bp, Artificial Sequence
  Description of Artificial Sequence: Synthetic oligonucleotide
  Target: ATXN1; (-) strand; PAM type: NRG; PAM sequence: AAG
cttggatctctggaaggaga

SEQ ID NO: 71058 - DNA, 20 bp, Artificial Sequence
  Description of Artificial Sequence: Synthetic oligonucleotide
  Target: ATXN1; (-) strand; PAM type: NRG; PAM sequence: GAG
gccccttggatctctggaag

SEQ ID NO: 71059 - DNA, 20 bp, Artificial Sequence
  Description of Artificial Sequence: Synthetic oligonucleotide
  Target: ATXN1; (-) strand; PAM type: NRG; PAM sequence: AGG
aggccccttggatctctgga

SEQ ID NO: 71060 - DNA, 20 bp, Artificial Sequence
  Description of Artificial Sequence: Synthetic oligonucleotide
  Target: ATXN1; (-) strand; PAM type: NRG; PAM sequence: AAG
gaggccccttggatctctgg

SEQ ID NO: 71061 - DNA, 20 bp, Artificial Sequence
  Description of Artificial Sequence: Synthetic oligonucleotide
  Target: ATXN1; (-) strand; PAM type: NRG; PAM sequence: TGG
tttgaggccccttggatctc

SEQ ID NO: 71062 - DNA, 20 bp, Artificial Sequence
  Description of Artificial Sequence: Synthetic oligonucleotide
  Target: ATXN1; (-) strand; PAM type: NRG; PAM sequence: TGG
taagattttttgaggcccct

SEQ ID NO: 71063 - DNA, 20 bp, Artificial Sequence
  Description of Artificial Sequence: Synthetic oligonucleotide
  Target: ATXN1; (-) strand; PAM type: NRG; PAM sequence: AGG
ccctattttaagattttttg

SEQ ID NO: 71064 - DNA, 20 bp, Artificial Sequence
  Description of Artificial Sequence: Synthetic oligonucleotide
  Target: ATXN1; (-) strand; PAM type: NRG; PAM sequence: GAG
tccctattttaagatttttt

SEQ ID NO: 71065 - DNA, 20 bp, Artificial Sequence
  Description of Artificial Sequence: Synthetic oligonucleotide
  Target: ATXN1; (-) strand; PAM type: NRG; PAM sequence: AAG
ttcaaagctttccctatttt

SEQ ID NO: 71066 - DNA, 20 bp, Artificial Sequence
  Description of Artificial Sequence: Synthetic oligonucleotide
  Target: ATXN1; (-) strand; PAM type: NRG; PAM sequence: AAG
tttgcctatactgcctttca

SEQ ID NO: 71067 - DNA, 20 bp, Artificial Sequence
  Description of Artificial Sequence: Synthetic oligonucleotide
  Target: ATXN1; (-) strand; PAM type: NRG; PAM sequence: AGG
ttcccacccctaaatgcttt

SEQ ID NO: 71068 - DNA, 20 bp, Artificial Sequence
  Description of Artificial Sequence: Synthetic oligonucleotide
  Target: ATXN1; (-) strand; PAM type: NRG; PAM sequence: TAG
gttcccacccctaaatgctt

SEQ ID NO: 71069 - DNA, 20 bp, Artificial Sequence
  Description of Artificial Sequence: Synthetic oligonucleotide
  Target: ATXN1; (-) strand; PAM type: NRG; PAM sequence: GGG
caaagatgtttatgtacaaa

SEQ ID NO: 71070 - DNA, 20 bp, Artificial Sequence
  Description of Artificial Sequence: Synthetic oligonucleotide
  Target: ATXN1; (-) strand; PAM type: NRG; PAM sequence: AGG
tcaaagatgtttatgtacaa

SEQ ID NO: 71071 - DNA, 20 bp, Artificial Sequence
  Description of Artificial Sequence: Synthetic oligonucleotide
  Target: ATXN1; (-) strand; PAM type: NRG; PAM sequence: AAG
ttcaaagatgtttatgtaca

SEQ ID NO: 71072 - DNA, 20 bp, Artificial Sequence
  Description of Artificial Sequence: Synthetic oligonucleotide
  Target: ATXN1; (-) strand; PAM type: NRG; PAM sequence: AAG
cagtgctgccctgtccttca

SEQ ID NO: 71073 - DNA, 20 bp, Artificial Sequence
  Description of Artificial Sequence: Synthetic oligonucleotide
  Target: ATXN1; (-) strand; PAM type: NRG; PAM sequence: CAG
tccatgaaaatggagactca

SEQ ID NO: 71074 - DNA, 20 bp, Artificial Sequence
  Description of Artificial Sequence: Synthetic oligonucleotide
  Target: ATXN1; (-) strand; PAM type: NRG; PAM sequence: GAG
cctagcactccatgaaaatg

SEQ ID NO: 71075 - DNA, 20 bp, Artificial Sequence
  Description of Artificial Sequence: Synthetic oligonucleotide
  Target: ATXN1; (-) strand; PAM type: NRG; PAM sequence: TGG
agcctagcactccatgaaaa

SEQ ID NO: 71076 - DNA, 20 bp, Artificial Sequence
  Description of Artificial Sequence: Synthetic oligonucleotide
  Target: ATXN1; (-) strand; PAM type: NRG; PAM sequence: TAG
ttctttaaaatatgctagcc

SEQ ID NO: 71077 - DNA, 20 bp, Artificial Sequence
  Description of Artificial Sequence: Synthetic oligonucleotide
  Target: ATXN1; (-) strand; PAM type: NRG; PAM sequence: TAG
tcttcttctttaaaatatgc

SEQ ID NO: 71078 - DNA, 20 bp, Artificial Sequence
  Description of Artificial Sequence: Synthetic oligonucleotide
  Target: ATXN1; (-) strand; PAM type: NRG; PAM sequence: AAG
tgcaagtatctgtgtcataa

SEQ ID NO: 71079 - DNA, 20 bp, Artificial Sequence
  Description of Artificial Sequence: Synthetic oligonucleotide
  Target: ATXN1; (-) strand; PAM type: NRG; PAM sequence: AAG
ctacttacaatttatggtgc

SEQ ID NO: 71080 - DNA, 20 bp, Artificial Sequence
  Description of Artificial Sequence: Synthetic oligonucleotide
  Target: ATXN1; (-) strand; PAM type: NRG; PAM sequence: TGG
cctaatctacttacaattta

SEQ ID NO: 71081 - DNA, 20 bp, Artificial Sequence
  Description of Artificial Sequence: Synthetic oligonucleotide
  Target: ATXN1; (-) strand; PAM type: NRG; PAM sequence: TAG
aacgattgtgtgttgtggca

SEQ ID NO: 71082 - DNA, 20 bp, Artificial Sequence
  Description of Artificial Sequence: Synthetic oligonucleotide
  Target: ATXN1; (-) strand; PAM type: NRG; PAM sequence: TGG
tcttaaacgattgtgtgttg

SEQ ID NO: 71083 - DNA, 20 bp, Artificial Sequence
  Description of Artificial Sequence: Synthetic oligonucleotide
  Target: ATXN1; (-) strand; PAM type: NRG; PAM sequence: TAG
ttgtgtggagttgatcattt

SEQ ID NO: 71084 - DNA, 20 bp, Artificial Sequence
  Description of Artificial Sequence: Synthetic oligonucleotide
  Target: ATXN1; (-) strand; PAM type: NRG; PAM sequence: GAG
tagtagattattcttgtgtg

SEQ ID NO: 71085 - DNA, 20 bp, Artificial Sequence
  Description of Artificial Sequence: Synthetic oligonucleotide
  Target: ATXN1; (-) strand; PAM type: NRG; PAM sequence: TGG
attagtagattattcttgtg

SEQ ID NO: 71086 - DNA, 20 bp, Artificial Sequence
  Description of Artificial Sequence: Synthetic oligonucleotide
  Target: ATXN1; (-) strand; PAM type: NRG; PAM sequence: TAG
atcacttgttataccattag

SEQ ID NO: 71087 - DNA, 20 bp, Artificial Sequence
  Description of Artificial Sequence: Synthetic oligonucleotide
  Target: ATXN1; (-) strand; PAM type: NRG; PAM sequence: TAG
tgaatcacttgttataccat

SEQ ID NO: 71088 - DNA, 20 bp, Artificial Sequence
  Description of Artificial Sequence: Synthetic oligonucleotide
  Target: ATXN1; (-) strand; PAM type: NRG; PAM sequence: AGG
acaaaagttattgttttgcc

SEQ ID NO: 71089 - DNA, 20 bp, Artificial Sequence
  Description of Artificial Sequence: Synthetic oligonucleotide
  Target: ATXN1; (-) strand; PAM type: NRG; PAM sequence: CAG
aacaaaagttattgttttgc

SEQ ID NO: 71090 - DNA, 20 bp, Artificial Sequence
  Description of Artificial Sequence: Synthetic oligonucleotide
  Target: ATXN1; (-) strand; PAM type: NRG; PAM sequence: AAG
ctcttgatggccttgaacaa

SEQ ID NO: 71091 - DNA, 20 bp, Artificial Sequence
  Description of Artificial Sequence: Synthetic oligonucleotide
  Target: ATXN1; (-) strand; PAM type: NRG; PAM sequence: TGG
ttttagggaaaacctcttga

SEQ ID NO: 71092 - DNA, 20 bp, Artificial Sequence
  Description of Artificial Sequence: Synthetic oligonucleotide
  Target: ATXN1; (-) strand; PAM type: NRG; PAM sequence: GGG
aaacgcatagtagattttta

SEQ ID NO: 71093 - DNA, 20 bp, Artificial Sequence
  Description of Artificial Sequence: Synthetic oligonucleotide
  Target: ATXN1; (-) strand; PAM type: NRG; PAM sequence: AGG
taaacgcatagtagattttt

SEQ ID NO: 71094 - DNA, 20 bp, Artificial Sequence
  Description of Artificial Sequence: Synthetic oligonucleotide
  Target: ATXN1; (-) strand; PAM type: NRG; PAM sequence: TAG
ctaaacgcatagtagatttt

SEQ ID NO: 71095 - DNA, 20 bp, Artificial Sequence
  Description of Artificial Sequence: Synthetic oligonucleotide
  Target: ATXN1; (-) strand; PAM type: NRG; PAM sequence: TAG
gcacagggctaaacgcatag

SEQ ID NO: 71096 - DNA, 20 bp, Artificial Sequence
  Description of Artificial Sequence: Synthetic oligonucleotide
  Target: ATXN1; (-) strand; PAM type: NRG; PAM sequence: TAG
ttagcacagggctaaacgca

SEQ ID NO: 71097 - DNA, 20 bp, Artificial Sequence
  Description of Artificial Sequence: Synthetic oligonucleotide
  Target: ATXN1; (-) strand; PAM type: NRG; PAM sequence: GGG
tttccacaaatcttagcaca

SEQ ID NO: 71098 - DNA, 20 bp, Artificial Sequence
  Description of Artificial Sequence: Synthetic oligonucleotide
  Target: ATXN1; (-) strand; PAM type: NRG; PAM sequence: AGG
ttttccacaaatcttagcac

SEQ ID NO: 71099 - DNA, 20 bp, Artificial Sequence
  Description of Artificial Sequence: Synthetic oligonucleotide
  Target: ATXN1; (-) strand; PAM type: NRG; PAM sequence: CAG
attttccacaaatcttagca

SEQ ID NO: 71100 - DNA, 20 bp, Artificial Sequence
  Description of Artificial Sequence: Synthetic oligonucleotide
  Target: ATXN1; (-) strand; PAM type: NRG; PAM sequence: TAG
tccatattttccacaaatct

SEQ ID NO: 71101 - DNA, 20 bp, Artificial Sequence
  Description of Artificial Sequence: Synthetic oligonucleotide
  Target: ATXN1; (-) strand; PAM type: NRG; PAM sequence: GGG
aggaaatgagctctggccca

SEQ ID NO: 71102 - DNA, 20 bp, Artificial Sequence
  Description of Artificial Sequence: Synthetic oligonucleotide
  Target: ATXN1; (-) strand; PAM type: NRG; PAM sequence: AGG
gaggaaatgagctctggccc

SEQ ID NO: 71103 - DNA, 20 bp, Artificial Sequence
  Description of Artificial Sequence: Synthetic oligonucleotide
  Target: ATXN1; (-) strand; PAM type: NRG; PAM sequence: CAG
ggaggaaatgagctctggcc

SEQ ID NO: 71104 - DNA, 20 bp, Artificial Sequence
  Description of Artificial Sequence: Synthetic oligonucleotide
  Target: ATXN1; (-) strand; PAM type: NRG; PAM sequence: TGG
attggggaggaaatgagctc

SEQ ID NO: 71105 - DNA, 20 bp, Artificial Sequence
  Description of Artificial Sequence: Synthetic oligonucleotide
  Target: ATXN1; (-) strand; PAM type: NRG; PAM sequence: GAG
ttagagattggggaggaaat

SEQ ID NO: 71106 - DNA, 20 bp, Artificial Sequence
  Description of Artificial Sequence: Synthetic oligonucleotide
  Target: ATXN1; (-) strand; PAM type: NRG; PAM sequence: AGG
ggtgggtttagagattgggg

SEQ ID NO: 71107 - DNA, 20 bp, Artificial Sequence
  Description of Artificial Sequence: Synthetic oligonucleotide
  Target: ATXN1; (-) strand; PAM type: NRG; PAM sequence: GAG
gggtgggtttagagattggg

SEQ ID NO: 71108 - DNA, 20 bp, Artificial Sequence
  Description of Artificial Sequence: Synthetic oligonucleotide
  Target: ATXN1; (-) strand; PAM type: NRG; PAM sequence: GGG
tcgggtgggtttagagattg

SEQ ID NO: 71109 - DNA, 20 bp, Artificial Sequence
  Description of Artificial Sequence: Synthetic oligonucleotide
  Target: ATXN1; (-) strand; PAM type: NRG; PAM sequence: GGG
ctcgggtgggtttagagatt

SEQ ID NO: 71110 - DNA, 20 bp, Artificial Sequence
  Description of Artificial Sequence: Synthetic oligonucleotide
  Target: ATXN1; (-) strand; PAM type: NRG; PAM sequence: TGG
tctcgggtgggtttagagat

SEQ ID NO: 71111 - DNA, 20 bp, Artificial Sequence
  Description of Artificial Sequence: Synthetic oligonucleotide
  Target: ATXN1; (-) strand; PAM type: NRG; PAM sequence: GAG
atgtctctcgggtgggttta

SEQ ID NO: 71112 - DNA, 20 bp, Artificial Sequence
  Description of Artificial Sequence: Synthetic oligonucleotide
  Target: ATXN1; (-) strand; PAM type: NRG; PAM sequence: TAG
taatgtctctcgggtgggtt

SEQ ID NO: 71113 - DNA, 20 bp, Artificial Sequence
  Description of Artificial Sequence: Synthetic oligonucleotide
  Target: ATXN1; (-) strand; PAM type: NRG; PAM sequence: GGG
gacagtaatgtctctcgggt

SEQ ID NO: 71114 - DNA, 20 bp, Artificial Sequence
  Description of Artificial Sequence: Synthetic oligonucleotide
  Target: ATXN1; (-) strand; PAM type: NRG; PAM sequence: TGG
tgacagtaatgtctctcggg

SEQ ID NO: 71115 - DNA, 20 bp, Artificial Sequence
  Description of Artificial Sequence: Synthetic oligonucleotide
  Target: ATXN1; (-) strand; PAM type: NRG; PAM sequence: GGG
atgtgacagtaatgtctctc

SEQ ID NO: 71116 - DNA, 20 bp, Artificial Sequence
  Description of Artificial Sequence: Synthetic oligonucleotide
  Target: ATXN1; (-) strand; PAM type: NRG; PAM sequence: CGG
aatgtgacagtaatgtctct

SEQ ID NO: 71117 - DNA, 20 bp, Artificial Sequence
  Description of Artificial Sequence: Synthetic oligonucleotide
  Target: ATXN1; (-) strand; PAM type: NRG; PAM sequence: CAG
tttgcattttggaaatgtga

SEQ ID NO: 71118 - DNA, 20 bp, Artificial Sequence
  Description of Artificial Sequence: Synthetic oligonucleotide
  Target: ATXN1; (-) strand; PAM type: NRG; PAM sequence: TGG
acagcatttcatttgcattt

SEQ ID NO: 71119 - DNA, 20 bp, Artificial Sequence
  Description of Artificial Sequence: Synthetic oligonucleotide
  Target: ATXN1; (-) strand; PAM type: NRG; PAM sequence: CAG
aaagctgtagacatgaggga

SEQ ID NO: 71120 - DNA, 20 bp, Artificial Sequence
  Description of Artificial Sequence: Synthetic oligonucleotide
  Target: ATXN1; (-) strand; PAM type: NRG; PAM sequence: GGG
taaaaaagctgtagacatga

SEQ ID NO: 71121 - DNA, 20 bp, Artificial Sequence
  Description of Artificial Sequence: Synthetic oligonucleotide
  Target: ATXN1; (-) strand; PAM type: NRG; PAM sequence: AGG
ataaaaaagctgtagacatg

SEQ ID NO: 71122 - DNA, 20 bp, Artificial Sequence
  Description of Artificial Sequence: Synthetic oligonucleotide
  Target: ATXN1; (-) strand; PAM type: NRG; PAM sequence: GAG
aataaaaaagctgtagacat

SEQ ID NO: 71123 - DNA, 20 bp, Artificial Sequence
  Description of Artificial Sequence: Synthetic oligonucleotide
  Target: ATXN1; (-) strand; PAM type: NRG; PAM sequence: TAG
ctcaaaaaataaaaaagctg

SEQ ID NO: 71124 - DNA, 20 bp, Artificial Sequence
  Description of Artificial Sequence: Synthetic oligonucleotide
  Target: ATXN1; (-) strand; PAM type: NRG; PAM sequence: AAG
ctccatctcaaaaaataaaa

SEQ ID NO: 71125 - DNA, 20 bp, Artificial Sequence
  Description of Artificial Sequence: Synthetic oligonucleotide
  Target: ATXN1; (-) strand; PAM type: NRG; PAM sequence: AAG
tgcactccagcctgggcgac

SEQ ID NO: 71126 - DNA, 20 bp, Artificial Sequence
  Description of Artificial Sequence: Synthetic oligonucleotide
  Target: ATXN1; (-) strand; PAM type: NRG; PAM sequence: GGG
gcaccattgcactccagcct

SEQ ID NO: 71127 - DNA, 20 bp, Artificial Sequence
  Description of Artificial Sequence: Synthetic oligonucleotide
  Target: ATXN1; (-) strand; PAM type: NRG; PAM sequence: TGG
cgcaccattgcactccagcc

SEQ ID NO: 71128 - DNA, 20 bp, Artificial Sequence
  Description of Artificial Sequence: Synthetic oligonucleotide
  Target: ATXN1; (-) strand; PAM type: NRG; PAM sequence: CAG
aagaccgcaccattgcactc

SEQ ID NO: 71129 - DNA, 20 bp, Artificial Sequence
  Description of Artificial Sequence: Synthetic oligonucleotide
  Target: ATXN1; (-) strand; PAM type: NRG; PAM sequence: AAG
gctggaggttgcagtgagcc

SEQ ID NO: 71130 - DNA, 20 bp, Artificial Sequence
  Description of Artificial Sequence: Synthetic oligonucleotide
  Target: ATXN1; (-) strand; PAM type: NRG; PAM sequence: GAG
tgggagctggaggttgcagt

SEQ ID NO: 71131 - DNA, 20 bp, Artificial Sequence
  Description of Artificial Sequence: Synthetic oligonucleotide
  Target: ATXN1; (-) strand; PAM type: NRG; PAM sequence: CAG
aatctgggagctggaggttg

SEQ ID NO: 71132 - DNA, 20 bp, Artificial Sequence
  Description of Artificial Sequence: Synthetic oligonucleotide
  Target: ATXN1; (-) strand; PAM type: NRG; PAM sequence: AGG
tgcttgaatctgggagctgg

SEQ ID NO: 71133 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaatctgggagctg

SEQ ID NO: 71134 - DNA, 20 bp, Artificial Sequence
  Description of Artificial Sequence: Synthetic oligonucleotide
  Target: ATXN1; (-) strand; PAM type: NRG; PAM sequence: TGG
aattgcttgaatctgggagc

SEQ ID NO: 71135 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcttgaatctgg

SEQ ID NO: 71136 - DNA, 20 bp, Artificial Sequence
  Description of Artificial Sequence: Synthetic oligonucleotide
  Target: ATXN1; (-) strand; PAM type: NRG; PAM sequence: GGG
caggagaattgcttgaatct

SEQ ID NO: 71137 - DNA, 20 bp, Artificial Sequence
  Description of Artificial Sequence: Synthetic oligonucleotide
  Target: ATXN1; (-) strand; PAM type: NRG; PAM sequence: TGG
gcaggagaattgcttgaatc

SEQ ID NO: 71138 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcag

SEQ ID NO: 71139 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgaggc

SEQ ID NO: 71140 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 71141 - DNA, 20 bp, Artificial Sequence
  Description of Artificial Sequence: Synthetic oligonucleotide
  Target: ATXN1; (-) strand; PAM type: NRG; PAM sequence: AGG
ctcagctactcaggaggctg

SEQ ID NO: 71142 - DNA, 20 bp, Artificial Sequence
  Description of Artificial Sequence: Synthetic oligonucleotide
  Target: ATXN1; (-) strand; PAM type: NRG; PAM sequence: GAG
tctcagctactcaggaggct

SEQ ID NO: 71143 - DNA, 20 bp, Artificial Sequence
  Description of Artificial Sequence: Synthetic oligonucleotide
  Target: ATXN1; (-) strand; PAM type: NRG; PAM sequence: AGG
tgtaatctcagctactcagg

SEQ ID NO: 71144 - DNA, 20 bp, Artificial Sequence
  Description of Artificial Sequence: Synthetic oligonucleotide
  Target: ATXN1; (-) strand; PAM type: NRG; PAM sequence: GAG
ctgtaatctcagctactcag

SEQ ID NO: 71145 - DNA, 20 bp, Artificial Sequence
  Description of Artificial Sequence: Synthetic oligonucleotide
  Target: ATXN1; (-) strand; PAM type: NRG; PAM sequence: AGG
gcctgtaatctcagctactc

SEQ ID NO: 71146 - DNA, 20 bp, Artificial Sequence
  Description of Artificial Sequence: Synthetic oligonucleotide
  Target: ATXN1; (-) strand; PAM type: NRG; PAM sequence: CAG
cgcctgtaatctcagctact

SEQ ID NO: 71147 - DNA, 20 bp, Artificial Sequence
  Description of Artificial Sequence: Synthetic oligonucleotide
  Target: ATXN1; (-) strand; PAM type: NRG; PAM sequence: CAG
gtggcgggcgcctgtaatct

SEQ ID NO: 71148 - DNA, 20 bp, Artificial Sequence
  Description of Artificial Sequence: Synthetic oligonucleotide
  Target: ATXN1; (-) strand; PAM type: NRG; PAM sequence: GGG
aattagccgggcgtggtggc

SEQ ID NO: 71149 - DNA, 20 bp, Artificial Sequence
  Description of Artificial Sequence: Synthetic oligonucleotide
  Target: ATXN1; (-) strand; PAM type: NRG; PAM sequence: CGG
aaattagccgggcgtggtgg

SEQ ID NO: 71150 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccgggcgtgg

SEQ ID NO: 71151 - DNA, 20 bp, Artificial Sequence
  Description of Artificial Sequence: Synthetic oligonucleotide
  Target: ATXN1; (-) strand; PAM type: NRG; PAM sequence: TGG
acaaaaaaattagccgggcg

SEQ ID NO: 71152 - DNA, 20 bp, Artificial Sequence
  Description of Artificial Sequence: Synthetic oligonucleotide
  Target: ATXN1; (-) strand; PAM type: NRG; PAM sequence: GGG
aaaatacaaaaaaattagcc

SEQ ID NO: 71153 - DNA, 20 bp, Artificial Sequence
  Description of Artificial Sequence: Synthetic oligonucleotide
  Target: ATXN1; (-) strand; PAM type: NRG; PAM sequence: CGG
aaaaatacaaaaaaattagc

SEQ ID NO: 71154 - DNA, 20 bp, Artificial Sequence
  Description of Artificial Sequence: Synthetic oligonucleotide
  Target: ATXN1; (-) strand; PAM type: NRG; PAM sequence: TAG
tactaaaaatacaaaaaaat

SEQ ID NO: 71155 - DNA, 20 bp, Artificial Sequence
  Description of Artificial Sequence: Synthetic oligonucleotide
  Target: ATXN1; (-) strand; PAM type: NRG; PAM sequence: TGG
cgagactagcctggccaaca

SEQ ID NO: 71156 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagactagcc

SEQ ID NO: 71157 - DNA, 20 bp, Artificial Sequence
  Description of Artificial Sequence: Synthetic oligonucleotide
  Target: ATXN1; (-) strand; PAM type: NRG; PAM sequence: TAG
tgaggtcaggagttcgagac

SEQ ID NO: 71158 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttc

SEQ ID NO: 71159 - DNA, 20 bp, Artificial Sequence
  Description of Artificial Sequence: Synthetic oligonucleotide
  Target: ATXN1; (-) strand; PAM type: NRG; PAM sequence: GAG
ggtgcatcacctgaggtcag

SEQ ID NO: 71160 - DNA, 20 bp, Artificial Sequence
  Description of Artificial Sequence: Synthetic oligonucleotide
  Target: ATXN1; (-) strand; PAM type: NRG; PAM sequence: AGG
tgggtgcatcacctgaggtc

SEQ ID NO: 71161 - DNA, 20 bp, Artificial Sequence
  Description of Artificial Sequence: Synthetic oligonucleotide
  Target: ATXN1; (-) strand; PAM type: NRG; PAM sequence: CAG
gtgggtgcatcacctgaggt

SEQ ID NO: 71162 - DNA, 20 bp, Artificial Sequence
  Description of Artificial Sequence: Synthetic oligonucleotide
  Target: ATXN1; (-) strand; PAM type: NRG; PAM sequence: AGG
tgaggtgggtgcatcacctg

SEQ ID NO: 71163 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggtgcatcacct

SEQ ID NO: 71164 - DNA, 20 bp, Artificial Sequence
  Description of Artificial Sequence: Synthetic oligonucleotide
  Target: ATXN1; (-) strand; PAM type: NRG; PAM sequence: GGG
gcactttgggacgctgaggt

SEQ ID NO: 71165 - DNA, 20 bp, Artificial Sequence
  Description of Artificial Sequence: Synthetic oligonucleotide
  Target: ATXN1; (-) strand; PAM type: NRG; PAM sequence: TGG
agcactttgggacgctgagg

SEQ ID NO: 71166 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggacgctg

SEQ ID NO: 71167 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggacgct

SEQ ID NO: 71168 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 71169 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagcactt

SEQ ID NO: 71170 - DNA, 20 bp, Artificial Sequence
  Description of Artificial Sequence: Synthetic oligonucleotide
  Target: ATXN1; (-) strand; PAM type: NRG; PAM sequence: CAG
gtggcatgtgcctgtaatcc

SEQ ID NO: 71171 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccgggcgtgg

SEQ ID NO: 71172 - DNA, 20 bp, Artificial Sequence
  Description of Artificial Sequence: Synthetic oligonucleotide
  Target: ATXN1; (-) strand; PAM type: NRG; PAM sequence: TGG
acaaaaaaattagccgggcg

SEQ ID NO: 71173 - DNA, 20 bp, Artificial Sequence
  Description of Artificial Sequence: Synthetic oligonucleotide
  Target: ATXN1; (-) strand; PAM type: NRG; PAM sequence: GGG
aaaatacaaaaaaattagcc

SEQ ID NO: 71174 - DNA, 20 bp, Artificial Sequence
  Description of Artificial Sequence: Synthetic oligonucleotide
  Target: ATXN1; (-) strand; PAM type: NRG; PAM sequence: CGG
aaaaatacaaaaaaattagc

SEQ ID NO: 71175 - DNA, 20 bp, Artificial Sequence
  Description of Artificial Sequence: Synthetic oligonucleotide
  Target: ATXN1; (-) strand; PAM type: NRG; PAM sequence: TAG
tactaaaaatacaaaaaaat

SEQ ID NO: 71176 - DNA, 20 bp, Artificial Sequence
  Description of Artificial Sequence: Synthetic oligonucleotide
  Target: ATXN1; (-) strand; PAM type: NRG; PAM sequence: TGG
cgagaccagcctagccaaca

SEQ ID NO: 71177 - DNA, 20 bp, Artificial Sequence
  Description of Artificial Sequence: Synthetic oligonucleotide
  Target: ATXN1; (-) strand; PAM type: NRG; PAM sequence: TAG
tcaggagttcgagaccagcc

SEQ ID NO: 71178 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttcgagac

SEQ ID NO: 71179 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttc

SEQ ID NO: 71180 - DNA, 20 bp, Artificial Sequence
  Description of Artificial Sequence: Synthetic oligonucleotide
  Target: ATXN1; (-) strand; PAM type: NRG; PAM sequence: GAG
ggtgcatcacctgaggtcag

SEQ ID NO: 71181 - DNA, 20 bp, Artificial Sequence
  Description of Artificial Sequence: Synthetic oligonucleotide
  Target: ATXN1; (-) strand; PAM type: NRG; PAM sequence: AGG
cgggtgcatcacctgaggtc

SEQ ID NO: 71182 - DNA, 20 bp, Artificial Sequence
  Description of Artificial Sequence: Synthetic oligonucleotide
  Target: ATXN1; (-) strand; PAM type: NRG; PAM sequence: CAG
gcgggtgcatcacctgaggt

SEQ ID NO: 71183 - DNA, 20 bp, Artificial Sequence
  Description of Artificial Sequence: Synthetic oligonucleotide
  Target: ATXN1; (-) strand; PAM type: NRG; PAM sequence: AGG
tgaggcgggtgcatcacctg

SEQ ID NO: 71184 - DNA, 20 bp, Artificial Sequence
  Description of Artificial Sequence: Synthetic oligonucleotide
  Target: ATXN1; (-) strand; PAM type: NRG; PAM sequence: GAG
ctgaggcgggtgcatcacct

SEQ ID NO: 71185 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggctgaggc

SEQ ID NO: 71186 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaggctgagg

SEQ ID NO: 71187 - DNA, 20 bp, Artificial Sequence
  Description of Artificial Sequence: Synthetic oligonucleotide
  Target: ATXN1; (-) strand; PAM type: NRG; PAM sequence: AGG
ctcagcactttgggaggctg

SEQ ID NO: 71188 - DNA, 20 bp, Artificial Sequence
  Description of Artificial Sequence: Synthetic oligonucleotide
  Target: ATXN1; (-) strand; PAM type: NRG; PAM sequence: GAG
tctcagcactttgggaggct

SEQ ID NO: 71189 - DNA, 20 bp, Artificial Sequence
  Description of Artificial Sequence: Synthetic oligonucleotide
  Target: ATXN1; (-) strand; PAM type: NRG; PAM sequence: AGG
tgtaatctcagcactttggg

SEQ ID NO: 71190 - DNA, 20 bp, Artificial Sequence
  Description of Artificial Sequence: Synthetic oligonucleotide
  Target: ATXN1; (-) strand; PAM type: NRG; PAM sequence: GAG
ttgtaatctcagcactttgg

SEQ ID NO: 71191 - DNA, 20 bp, Artificial Sequence
  Description of Artificial Sequence: Synthetic oligonucleotide
  Target: ATXN1; (-) strand; PAM type: NRG; PAM sequence: GGG
gcttgtaatctcagcacttt

SEQ ID NO: 71192 - DNA, 20 bp, Artificial Sequence
  Description of Artificial Sequence: Synthetic oligonucleotide
  Target: ATXN1; (-) strand; PAM type: NRG; PAM sequence: TGG
tgcttgtaatctcagcactt

SEQ ID NO: 71193 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcttgtaatct

SEQ ID NO: 71194 - DNA, 20 bp, Artificial Sequence
  Description of Artificial Sequence: Synthetic oligonucleotide
  Target: ATXN1; (-) strand; PAM type: NRG; PAM sequence: TGG
gtagacatggccaggcatag

SEQ ID NO: 71195 - DNA, 20 bp, Artificial Sequence
  Description of Artificial Sequence: Synthetic oligonucleotide
  Target: ATXN1; (-) strand; PAM type: NRG; PAM sequence: TAG
gctgtagacatggccaggca

SEQ ID NO: 71196 - DNA, 20 bp, Artificial Sequence
  Description of Artificial Sequence: Synthetic oligonucleotide
  Target: ATXN1; (-) strand; PAM type: NRG; PAM sequence: AGG
taaaggctgtagacatggcc

SEQ ID NO: 71197 - DNA, 20 bp, Artificial Sequence
  Description of Artificial Sequence: Synthetic oligonucleotide
  Target: ATXN1; (-) strand; PAM type: NRG; PAM sequence: CAG
ttaaaggctgtagacatggc

SEQ ID NO: 71198 - DNA, 20 bp, Artificial Sequence
  Description of Artificial Sequence: Synthetic oligonucleotide
  Target: ATXN1; (-) strand; PAM type: NRG; PAM sequence: TGG
gtcgttaaaggctgtagaca

SEQ ID NO: 71199 - DNA, 20 bp, Artificial Sequence
  Description of Artificial Sequence: Synthetic oligonucleotide
  Target: ATXN1; (-) strand; PAM type: NRG; PAM sequence: TAG
tggagagtcgttaaaggctg

SEQ ID NO: 71200 - DNA, 20 bp, Artificial Sequence
  Description of Artificial Sequence: Synthetic oligonucleotide
  Target: ATXN1; (-) strand; PAM type: NRG; PAM sequence: AGG
cgatgatggagagtcgttaa

SEQ ID NO: 71201 - DNA, 20 bp, Artificial Sequence
  Description of Artificial Sequence: Synthetic oligonucleotide
  Target: ATXN1; (-) strand; PAM type: NRG; PAM sequence: AAG
acgatgatggagagtcgtta

SEQ ID NO: 71202 - DNA, 20 bp, Artificial Sequence
  Description of Artificial Sequence: Synthetic oligonucleotide
  Target: ATXN1; (-) strand; PAM type: NRG; PAM sequence: GAG
actatagtcacgatgatgga

SEQ ID NO: 71203 - DNA, 20 bp, Artificial Sequence
  Description of Artificial Sequence: Synthetic oligonucleotide
  Target: ATXN1; (-) strand; PAM type: NRG; PAM sequence: GAG
agactatagtcacgatgatg

SEQ ID NO: 71204 - DNA, 20 bp, Artificial Sequence
  Description of Artificial Sequence: Synthetic oligonucleotide
  Target: ATXN1; (-) strand; PAM type: NRG; PAM sequence: TGG
tcagactatagtcacgatga

SEQ ID NO: 71205 - DNA, 20 bp, Artificial Sequence
  Description of Artificial Sequence: Synthetic oligonucleotide
  Target: ATXN1; (-) strand; PAM type: NRG; PAM sequence: TAG
cgtgtatcctgttcagacta

SEQ ID NO: 71206 - DNA, 20 bp, Artificial Sequence
  Description of Artificial Sequence: Synthetic oligonucleotide
  Target: ATXN1; (-) strand; PAM type: NRG; PAM sequence: CAG
ggggactcgtgtatcctgtt

SEQ ID NO: 71207 - DNA, 20 bp, Artificial Sequence
  Description of Artificial Sequence: Synthetic oligonucleotide
  Target: ATXN1; (-) strand; PAM type: NRG; PAM sequence: GGG
agccagcgtgggattgagtg

SEQ ID NO: 71208 - DNA, 20 bp, Artificial Sequence
  Description of Artificial Sequence: Synthetic oligonucleotide
  Target: ATXN1; (-) strand; PAM type: NRG; PAM sequence: GGG
gagccagcgtgggattgagt

SEQ ID NO: 71209 - DNA, 20 bp, Artificial Sequence
  Description of Artificial Sequence: Synthetic oligonucleotide
  Target: ATXN1; (-) strand; PAM type: NRG; PAM sequence: TGG
tgagccagcgtgggattgag

SEQ ID NO: 71210 - DNA, 20 bp, Artificial Sequence
  Description of Artificial Sequence: Synthetic oligonucleotide
  Target: ATXN1; (-) strand; PAM type: NRG; PAM sequence: GAG
agatgagccagcgtgggatt

SEQ ID NO: 71211 - DNA, 20 bp, Artificial Sequence
  Description of Artificial Sequence: Synthetic oligonucleotide
  Target: ATXN1; (-) strand; PAM type: NRG; PAM sequence: GGG
caggacagatgagccagcgt

SEQ ID NO: 71212 - DNA, 20 bp, Artificial Sequence
  Description of Artificial Sequence: Synthetic oligonucleotide
  Target: ATXN1; (-) strand; PAM type: NRG; PAM sequence: TGG
acaggacagatgagccagcg

SEQ ID NO: 71213 - DNA, 20 bp, Artificial Sequence
  Description of Artificial Sequence: Synthetic oligonucleotide
  Target: ATXN1; (-) strand; PAM type: NRG; PAM sequence: CAG
ttgagacaggacagatgagc

SEQ ID NO: 71214 - DNA, 20 bp, Artificial Sequence
  Description of Artificial Sequence: Synthetic oligonucleotide
  Target: ATXN1; (-) strand; PAM type: NRG; PAM sequence: GAG
ctcattgagacaggacagat

SEQ ID NO: 71215 - DNA, 20 bp, Artificial Sequence
  Description of Artificial Sequence: Synthetic oligonucleotide
  Target: ATXN1; (-) strand; PAM type: NRG; PAM sequence: CAG
tttcactcattgagacagga

SEQ ID NO: 71216 - DNA, 20 bp, Artificial Sequence
  Description of Artificial Sequence: Synthetic oligonucleotide
  Target: ATXN1; (-) strand; PAM type: NRG; PAM sequence: AGG
ggagtttcactcattgagac

SEQ ID NO: 71217 - DNA, 20 bp, Artificial Sequence
  Description of Artificial Sequence: Synthetic oligonucleotide
  Target: ATXN1; (-) strand; PAM type: NRG; PAM sequence: CAG
gggagtttcactcattgaga

SEQ ID NO: 71218 - DNA, 20 bp, Artificial Sequence
  Description of Artificial Sequence: Synthetic oligonucleotide
  Target: ATXN1; (-) strand; PAM type: NRG; PAM sequence: GAG
gatggggagtttcactcatt

SEQ ID NO: 71219 - DNA, 20 bp, Artificial Sequence
  Description of Artificial Sequence: Synthetic oligonucleotide
  Target: ATXN1; (-) strand; PAM type: NRG; PAM sequence: GAG
gtcccagggtatgagatggg

SEQ ID NO: 71220 - DNA, 20 bp, Artificial Sequence
  Description of Artificial Sequence: Synthetic oligonucleotide
  Target: ATXN1; (-) strand; PAM type: NRG; PAM sequence: GGG
cagtcccagggtatgagatg

SEQ ID NO: 71221 - DNA, 20 bp, Artificial Sequence
  Description of Artificial Sequence: Synthetic oligonucleotide
  Target: ATXN1; (-) strand; PAM type: NRG; PAM sequence: GGG
tcagtcccagggtatgagat

SEQ ID NO: 71222 - DNA, 20 bp, Artificial Sequence
  Description of Artificial Sequence: Synthetic oligonucleotide
  Target: ATXN1; (-) strand; PAM type: NRG; PAM sequence: TGG
ctcagtcccagggtatgaga

SEQ ID NO: 71223 - DNA, 20 bp, Artificial Sequence
  Description of Artificial Sequence: Synthetic oligonucleotide
  Target: ATXN1; (-) strand; PAM type: NRG; PAM sequence: GAG
atggctcagtcccagggtat

SEQ ID NO: 71224 - DNA, 20 bp, Artificial Sequence
  Description of Artificial Sequence: Synthetic oligonucleotide
  Target: ATXN1; (-) strand; PAM type: NRG; PAM sequence: GGG
tagagcatggctcagtccca

SEQ ID NO: 71225 - DNA, 20 bp, Artificial Sequence
  Description of Artificial Sequence: Synthetic oligonucleotide
  Target: ATXN1; (-) strand; PAM type: NRG; PAM sequence: AGG
gtagagcatggctcagtccc

SEQ ID NO: 71226 - DNA, 20 bp, Artificial Sequence
  Description of Artificial Sequence: Synthetic oligonucleotide
  Target: ATXN1; (-) strand; PAM type: NRG; PAM sequence: CAG
agtagagcatggctcagtcc

SEQ ID NO: 71227 - DNA, 20 bp, Artificial Sequence
  Description of Artificial Sequence: Synthetic oligonucleotide
  Target: ATXN1; (-) strand; PAM type: NRG; PAM sequence: CAG
aactgtagtagagcatggct

SEQ ID NO: 71228 - DNA, 20 bp, Artificial Sequence
  Description of Artificial Sequence: Synthetic oligonucleotide
  Target: ATXN1; (-) strand; PAM type: NRG; PAM sequence: TGG
cagggaactgtagtagagca

SEQ ID NO: 71229 - DNA, 20 bp, Artificial Sequence
  Description of Artificial Sequence: Synthetic oligonucleotide
  Target: ATXN1; (-) strand; PAM type: NRG; PAM sequence: GAG
aaacccagggaactgtagta

SEQ ID NO: 71230 - DNA, 20 bp, Artificial Sequence
  Description of Artificial Sequence: Synthetic oligonucleotide
  Target: ATXN1; (-) strand; PAM type: NRG; PAM sequence: TAG
tgaaacccagggaactgtag

SEQ ID NO: 71231 - DNA, 20 bp, Artificial Sequence
  Description of Artificial Sequence: Synthetic oligonucleotide
  Target: ATXN1; (-) strand; PAM type: NRG; PAM sequence: TAG
ctttgaaacccagggaactg

SEQ ID NO: 71232 - DNA, 20 bp, Artificial Sequence
  Description of Artificial Sequence: Synthetic oligonucleotide
  Target: ATXN1; (-) strand; PAM type: NRG; PAM sequence: GGG
ggaggaatctttgaaaccca

SEQ ID NO: 71233 - DNA, 20 bp, Artificial Sequence
  Description of Artificial Sequence: Synthetic oligonucleotide
  Target: ATXN1; (-) strand; PAM type: NRG; PAM sequence: AGG
tggaggaatctttgaaaccc

SEQ ID NO: 71234 - DNA, 20 bp, Artificial Sequence
  Description of Artificial Sequence: Synthetic oligonucleotide
  Target: ATXN1; (-) strand; PAM type: NRG; PAM sequence: CAG
gtggaggaatctttgaaacc

SEQ ID NO: 71235 - DNA, 20 bp, Artificial Sequence
  Description of Artificial Sequence: Synthetic oligonucleotide
  Target: ATXN1; (-) strand; PAM type: NRG; PAM sequence: AGG
tttcaaaggcatgggtgtgg

SEQ ID NO: 71236 - DNA, 20 bp, Artificial Sequence
  Description of Artificial Sequence: Synthetic oligonucleotide
  Target: ATXN1; (-) strand; PAM type: NRG; PAM sequence: GAG
ttttcaaaggcatgggtgtg

SEQ ID NO: 71237 - DNA, 20 bp, Artificial Sequence
  Description of Artificial Sequence: Synthetic oligonucleotide
  Target: ATXN1; (-) strand; PAM type: NRG; PAM sequence: TGG
cattttcaaaggcatgggtg

SEQ ID NO: 71238 - DNA, 20 bp, Artificial Sequence
  Description of Artificial Sequence: Synthetic oligonucleotide
  Target: ATXN1; (-) strand; PAM type: NRG; PAM sequence: GGG
ggcagcattttcaaaggcat

SEQ ID NO: 71239 - DNA, 20 bp, Artificial Sequence
  Description of Artificial Sequence: Synthetic oligonucleotide
  Target: ATXN1; (-) strand; PAM type: NRG; PAM sequence: TGG
gggcagcattttcaaaggca

SEQ ID NO: 71240 - DNA, 20 bp, Artificial Sequence
  Description of Artificial Sequence: Synthetic oligonucleotide
  Target: ATXN1; (-) strand; PAM type: NRG; PAM sequence: AGG
tagaagggcagcattttcaa

SEQ ID NO: 71241 - DNA, 20 bp, Artificial Sequence
  Description of Artificial Sequence: Synthetic oligonucleotide
  Target: ATXN1; (-) strand; PAM type: NRG; PAM sequence: AAG
atagaagggcagcattttca

SEQ ID NO: 71242 - DNA, 20 bp, Artificial Sequence
  Description of Artificial Sequence: Synthetic oligonucleotide
  Target: ATXN1; (-) strand; PAM type: NRG; PAM sequence: CAG
tgcttctaagcatagaaggg

SEQ ID NO: 71243 - DNA, 20 bp, Artificial Sequence
  Description of Artificial Sequence: Synthetic oligonucleotide
  Target: ATXN1; (-) strand; PAM type: NRG; PAM sequence: GGG
aagtgcttctaagcatagaa

SEQ ID NO: 71244 - DNA, 20 bp, Artificial Sequence
  Description of Artificial Sequence: Synthetic oligonucleotide
  Target: ATXN1; (-) strand; PAM type: NRG; PAM sequence: AGG
gaagtgcttctaagcataga

SEQ ID NO: 71245 - DNA, 20 bp, Artificial Sequence
  Description of Artificial Sequence: Synthetic oligonucleotide
  Target: ATXN1; (-) strand; PAM type: NRG; PAM sequence: AAG
ggaagtgcttctaagcatag

SEQ ID NO: 71246 - DNA, 20 bp, Artificial Sequence
  Description of Artificial Sequence: Synthetic oligonucleotide
  Target: ATXN1; (-) strand; PAM type: NRG; PAM sequence: TAG
ttgggaagtgcttctaagca

SEQ ID NO: 71247 - DNA, 20 bp, Artificial Sequence
  Description of Artificial Sequence: Synthetic oligonucleotide
  Target: ATXN1; (-) strand; PAM type: NRG; PAM sequence: AAG
tgttcttgggaagtgcttct

SEQ ID NO: 71248 - DNA, 20 bp, Artificial Sequence
  Description of Artificial Sequence: Synthetic oligonucleotide
  Target: ATXN1; (-) strand; PAM type: NRG; PAM sequence: AAG
acaggaagcatgttcttggg

SEQ ID NO: 71249 - DNA, 20 bp, Artificial Sequence
  Description of Artificial Sequence: Synthetic oligonucleotide
  Target: ATXN1; (-) strand; PAM type: NRG; PAM sequence: GGG
taaacaggaagcatgttctt

SEQ ID NO: 71250 - DNA, 20 bp, Artificial Sequence
  Description of Artificial Sequence: Synthetic oligonucleotide
  Target: ATXN1; (-) strand; PAM type: NRG; PAM sequence: TGG
ataaacaggaagcatgttct

SEQ ID NO: 71251 - DNA, 20 bp, Artificial Sequence
  Description of Artificial Sequence: Synthetic oligonucleotide
  Target: ATXN1; (-) strand; PAM type: NRG; PAM sequence: AAG
gattatgtacaataaacagg

SEQ ID NO: 71252 - DNA, 20 bp, Artificial Sequence
  Description of Artificial Sequence: Synthetic oligonucleotide
  Target: ATXN1; (-) strand; PAM type: NRG; PAM sequence: AGG
atggattatgtacaataaac

SEQ ID NO: 71253 - DNA, 20 bp, Artificial Sequence
  Description of Artificial Sequence: Synthetic oligonucleotide
  Target: ATXN1; (-) strand; PAM type: NRG; PAM sequence: CAG
gatggattatgtacaataaa

SEQ ID NO: 71254 - DNA, 20 bp, Artificial Sequence
  Description of Artificial Sequence: Synthetic oligonucleotide
  Target: ATXN1; (-) strand; PAM type: NRG; PAM sequence: TGG
ctccgagatgatggttgaga

SEQ ID NO: 71255 - DNA, 20 bp, Artificial Sequence
  Description of Artificial Sequence: Synthetic oligonucleotide
  Target: ATXN1; (-) strand; PAM type: NRG; PAM sequence: GAG
agacctccgagatgatggtt

SEQ ID NO: 71256 - DNA, 20 bp, Artificial Sequence
  Description of Artificial Sequence: Synthetic oligonucleotide
  Target: ATXN1; (-) strand; PAM type: NRG; PAM sequence: TGG
aggaaagacctccgagatga

SEQ ID NO: 71257 - DNA, 20 bp, Artificial Sequence
  Description of Artificial Sequence: Synthetic oligonucleotide
  Target: ATXN1; (-) strand; PAM type: NRG; PAM sequence: GAG
tgtttgtaggaaagacctcc

SEQ ID NO: 71258 - DNA, 20 bp, Artificial Sequence
  Description of Artificial Sequence: Synthetic oligonucleotide
  Target: ATXN1; (-) strand; PAM type: NRG; PAM sequence: AAG
atgaaggagtgtttgtagga

SEQ ID NO: 71259 - DNA, 20 bp, Artificial Sequence
  Description of Artificial Sequence: Synthetic oligonucleotide
  Target: ATXN1; (-) strand; PAM type: NRG; PAM sequence: AGG
aaggatgaaggagtgtttgt

SEQ ID NO: 71260 - DNA, 20 bp, Artificial Sequence
  Description of Artificial Sequence: Synthetic oligonucleotide
  Target: ATXN1; (-) strand; PAM type: NRG; PAM sequence: TAG
caaggatgaaggagtgtttg

SEQ ID NO: 71261 - DNA, 20 bp, Artificial Sequence
  Description of Artificial Sequence: Synthetic oligonucleotide
  Target: ATXN1; (-) strand; PAM type: NRG; PAM sequence: GAG
catcaggaccaaggatgaag

SEQ ID NO: 71262 - DNA, 20 bp, Artificial Sequence
  Description of Artificial Sequence: Synthetic oligonucleotide
  Target: ATXN1; (-) strand; PAM type: NRG; PAM sequence: AGG
cacatcaggaccaaggatga

SEQ ID NO: 71263 - DNA, 20 bp, Artificial Sequence
  Description of Artificial Sequence: Synthetic oligonucleotide
  Target: ATXN1; (-) strand; PAM type: NRG; PAM sequence: AAG
tcacatcaggaccaaggatg

SEQ ID NO: 71264 - DNA, 20 bp, Artificial Sequence
  Description of Artificial Sequence: Synthetic oligonucleotide
  Target: ATXN1; (-) strand; PAM type: NRG; PAM sequence: AGG
agagtatcacatcaggacca

SEQ ID NO: 71265 - DNA, 20 bp, Artificial Sequence
  Description of Artificial Sequence: Synthetic oligonucleotide
  Target: ATXN1; (-) strand; PAM type: NRG; PAM sequence: AAG
aagagtatcacatcaggacc

SEQ ID NO: 71266 - DNA, 20 bp, Artificial Sequence
  Description of Artificial Sequence: Synthetic oligonucleotide
  Target: ATXN1; (-) strand; PAM type: NRG; PAM sequence: AGG
gatggaaagagtatcacatc

SEQ ID NO: 71267 - DNA, 20 bp, Artificial Sequence
  Description of Artificial Sequence: Synthetic oligonucleotide
  Target: ATXN1; (-) strand; PAM type: NRG; PAM sequence: CAG
ggatggaaagagtatcacat

SEQ ID NO: 71268 - DNA, 20 bp, Artificial Sequence
  Description of Artificial Sequence: Synthetic oligonucleotide
  Target: ATXN1; (-) strand; PAM type: NRG; PAM sequence: GAG
caggaagcaagggatggaaa

SEQ ID NO: 71269 - DNA, 20 bp, Artificial Sequence
  Description of Artificial Sequence: Synthetic oligonucleotide
  Target: ATXN1; (-) strand; PAM type: NRG; PAM sequence: AAG
cacaggaagcaagggatgga

SEQ ID NO: 71270 - DNA, 20 bp, Artificial Sequence
  Description of Artificial Sequence: Synthetic oligonucleotide
  Target: ATXN1; (-) strand; PAM type: NRG; PAM sequence: TGG
ggagcacaggaagcaaggga

SEQ ID NO: 71271 - DNA, 20 bp, Artificial Sequence
  Description of Artificial Sequence: Synthetic oligonucleotide
  Target: ATXN1; (-) strand; PAM type: NRG; PAM sequence: GGG
aagtggagcacaggaagcaa

SEQ ID NO: 71272 - DNA, 20 bp, Artificial Sequence
  Description of Artificial Sequence: Synthetic oligonucleotide
  Target: ATXN1; (-) strand; PAM type: NRG; PAM sequence: AGG
taagtggagcacaggaagca

SEQ ID NO: 71273 - DNA, 20 bp, Artificial Sequence
  Description of Artificial Sequence: Synthetic oligonucleotide
  Target: ATXN1; (-) strand; PAM type: NRG; PAM sequence: AAG
gtaagtggagcacaggaagc

SEQ ID NO: 71274 - DNA, 20 bp, Artificial Sequence
  Description of Artificial Sequence: Synthetic oligonucleotide
  Target: ATXN1; (-) strand; PAM type: NRG; PAM sequence: AAG
gtttgtaagtggagcacagg

SEQ ID NO: 71275 - DNA, 20 bp, Artificial Sequence
  Description of Artificial Sequence: Synthetic oligonucleotide
  Target: ATXN1; (-) strand; PAM type: NRG; PAM sequence: AGG
agtgtttgtaagtggagcac

SEQ ID NO: 71276 - DNA, 20 bp, Artificial Sequence
  Description of Artificial Sequence: Synthetic oligonucleotide
  Target: ATXN1; (-) strand; PAM type: NRG; PAM sequence: CAG
cagtgtttgtaagtggagca

SEQ ID NO: 71277 - DNA, 20 bp, Artificial Sequence
  Description of Artificial Sequence: Synthetic oligonucleotide
  Target: ATXN1; (-) strand; PAM type: NRG; PAM sequence: GAG
tcaggcagtgtttgtaagtg

SEQ ID NO: 71278 - DNA, 20 bp, Artificial Sequence
  Description of Artificial Sequence: Synthetic oligonucleotide
  Target: ATXN1; (-) strand; PAM type: NRG; PAM sequence: TGG
gctcaggcagtgtttgtaag

SEQ ID NO: 71279 - DNA, 20 bp, Artificial Sequence
  Description of Artificial Sequence: Synthetic oligonucleotide
  Target: ATXN1; (-) strand; PAM type: NRG; PAM sequence: AAG
gttgctcaggcagtgtttgt

SEQ ID NO: 71280 - DNA, 20 bp, Artificial Sequence
  Description of Artificial Sequence: Synthetic oligonucleotide
  Target: ATXN1; (-) strand; PAM type: NRG; PAM sequence: CAG
gtagagagcagttgctcagg

SEQ ID NO: 71281 - DNA, 20 bp, Artificial Sequence
  Description of Artificial Sequence: Synthetic oligonucleotide
  Target: ATXN1; (-) strand; PAM type: NRG; PAM sequence: AGG
cttgtagagagcagttgctc

SEQ ID NO: 71282 - DNA, 20 bp, Artificial Sequence
  Description of Artificial Sequence: Synthetic oligonucleotide
  Target: ATXN1; (-) strand; PAM type: NRG; PAM sequence: CAG
gcttgtagagagcagttgct

SEQ ID NO: 71283 - DNA, 20 bp, Artificial Sequence
  Description of Artificial Sequence: Synthetic oligonucleotide
  Target: ATXN1; (-) strand; PAM type: NRG; PAM sequence: CAG
cacatggggcttgtagagag

SEQ ID NO: 71284 - DNA, 20 bp, Artificial Sequence
  Description of Artificial Sequence: Synthetic oligonucleotide
  Target: ATXN1; (-) strand; PAM type: NRG; PAM sequence: GAG
cctcacatggggcttgtaga

SEQ ID NO: 71285 - DNA, 20 bp, Artificial Sequence
  Description of Artificial Sequence: Synthetic oligonucleotide
  Target: ATXN1; (-) strand; PAM type: NRG; PAM sequence: GAG
cacctcacatggggcttgta

SEQ ID NO: 71286 - DNA, 20 bp, Artificial Sequence
  Description of Artificial Sequence: Synthetic oligonucleotide
  Target: ATXN1; (-) strand; PAM type: NRG; PAM sequence: TAG
agcacctcacatggggcttg

SEQ ID NO: 71287 - DNA, 20 bp, Artificial Sequence
  Description of Artificial Sequence: Synthetic oligonucleotide
  Target: ATXN1; (-) strand; PAM type: NRG; PAM sequence: GGG
tacatctagcacctcacatg

SEQ ID NO: 71288 - DNA, 20 bp, Artificial Sequence
  Description of Artificial Sequence: Synthetic oligonucleotide
  Target: ATXN1; (-) strand; PAM type: NRG; PAM sequence: GGG
gtacatctagcacctcacat

SEQ ID NO: 71289 - DNA, 20 bp, Artificial Sequence
  Description of Artificial Sequence: Synthetic oligonucleotide
  Target: ATXN1; (-) strand; PAM type: NRG; PAM sequence: TGG
tgtacatctagcacctcaca

SEQ ID NO: 71290 - DNA, 20 bp, Artificial Sequence
  Description of Artificial Sequence: Synthetic oligonucleotide
  Target: ATXN1; (-) strand; PAM type: NRG; PAM sequence: TAG
cttatgagatgttgtacatc

SEQ ID NO: 71291 - DNA, 20 bp, Artificial Sequence
  Description of Artificial Sequence: Synthetic oligonucleotide
  Target: ATXN1; (-) strand; PAM type: NRG; PAM sequence: GAG
cggcttttgtatgtacttat

SEQ ID NO: 71292 - DNA, 20 bp, Artificial Sequence
  Description of Artificial Sequence: Synthetic oligonucleotide
  Target: ATXN1; (-) strand; PAM type: NRG; PAM sequence: CGG
caagtaatgcctacagttca

SEQ ID NO: 71293 - DNA, 20 bp, Artificial Sequence
  Description of Artificial Sequence: Synthetic oligonucleotide
  Target: ATXN1; (-) strand; PAM type: NRG; PAM sequence: CAG
tcatctgcaagtaatgccta

SEQ ID NO: 71294 - DNA, 20 bp, Artificial Sequence
  Description of Artificial Sequence: Synthetic oligonucleotide
  Target: ATXN1; (-) strand; PAM type: NRG; PAM sequence: AAG
gagcctagtttgtcatctgc

SEQ ID NO: 71295 - DNA, 20 bp, Artificial Sequence
  Description of Artificial Sequence: Synthetic oligonucleotide
  Target: ATXN1; (-) strand; PAM type: NRG; PAM sequence: TAG
ctactgaacttttctgagcc

SEQ ID NO: 71296 - DNA, 20 bp, Artificial Sequence
  Description of Artificial Sequence: Synthetic oligonucleotide
  Target: ATXN1; (-) strand; PAM type: NRG; PAM sequence: GAG
ccaagctactgaacttttct

SEQ ID NO: 71297 - DNA, 20 bp, Artificial Sequence
  Description of Artificial Sequence: Synthetic oligonucleotide
  Target: ATXN1; (-) strand; PAM type: NRG; PAM sequence: AAG
ctggctgtgtgaacttgacc

SEQ ID NO: 71298 - DNA, 20 bp, Artificial Sequence
  Description of Artificial Sequence: Synthetic oligonucleotide
  Target: ATXN1; (-) strand; PAM type: NRG; PAM sequence: TGG
gccaaaagcatggagctcac

SEQ ID NO: 71299 - DNA, 20 bp, Artificial Sequence
  Description of Artificial Sequence: Synthetic oligonucleotide
  Target: ATXN1; (-) strand; PAM type: NRG; PAM sequence: GAG
gcctcagagccaaaagcatg

SEQ ID NO: 71300 - DNA, 20 bp, Artificial Sequence
  Description of Artificial Sequence: Synthetic oligonucleotide
  Target: ATXN1; (-) strand; PAM type: NRG; PAM sequence: TGG
gggcctcagagccaaaagca

SEQ ID NO: 71301 - DNA, 20 bp, Artificial Sequence
  Description of Artificial Sequence: Synthetic oligonucleotide
  Target: ATXN1; (-) strand; PAM type: NRG; PAM sequence: AAG
aaccagggcctcagagccaa

SEQ ID NO: 71302 - DNA, 20 bp, Artificial Sequence
  Description of Artificial Sequence: Synthetic oligonucleotide
  Target: ATXN1; (-) strand; PAM type: NRG; PAM sequence: GAG
agaagccaaccagggcctca

SEQ ID NO: 71303 - DNA, 20 bp, Artificial Sequence
  Description of Artificial Sequence: Synthetic oligonucleotide
  Target: ATXN1; (-) strand; PAM type: NRG; PAM sequence: CAG
ggagaagccaaccagggcct

SEQ ID NO: 71304 - DNA, 20 bp, Artificial Sequence
  Description of Artificial Sequence: Synthetic oligonucleotide
  Target: ATXN1; (-) strand; PAM type: NRG; PAM sequence: GGG
tgtttaggagaagccaacca

SEQ ID NO: 71305 - DNA, 20 bp, Artificial Sequence
  Description of Artificial Sequence: Synthetic oligonucleotide
  Target: ATXN1; (-) strand; PAM type: NRG; PAM sequence: AGG
gtgtttaggagaagccaacc

SEQ ID NO: 71306 - DNA, 20 bp, Artificial Sequence
  Description of Artificial Sequence: Synthetic oligonucleotide
  Target: ATXN1; (-) strand; PAM type: NRG; PAM sequence: CAG
tgtgtttaggagaagccaac

SEQ ID NO: 71307 - DNA, 20 bp, Artificial Sequence
  Description of Artificial Sequence: Synthetic oligonucleotide
  Target: ATXN1; (-) strand; PAM type: NRG; PAM sequence: AAG
ttaggtggtgtgtttaggag

SEQ ID NO: 71308 - DNA, 20 bp, Artificial Sequence
  Description of Artificial Sequence: Synthetic oligonucleotide
  Target: ATXN1; (-) strand; PAM type: NRG; PAM sequence: GAG
ttgttaggtggtgtgtttag

SEQ ID NO: 71309 - DNA, 20 bp, Artificial Sequence
  Description of Artificial Sequence: Synthetic oligonucleotide
  Target: ATXN1; (-) strand; PAM type: NRG; PAM sequence: AGG
cattgttaggtggtgtgttt

SEQ ID NO: 71310 - DNA, 20 bp, Artificial Sequence
  Description of Artificial Sequence: Synthetic oligonucleotide
  Target: ATXN1; (-) strand; PAM type: NRG; PAM sequence: TAG
gcattgttaggtggtgtgtt

SEQ ID NO: 71311 - DNA, 20 bp, Artificial Sequence
  Description of Artificial Sequence: Synthetic oligonucleotide
  Target: ATXN1; (-) strand; PAM type: NRG; PAM sequence: TGG
catatggtagcattgttagg

SEQ ID NO: 71312 - DNA, 20 bp, Artificial Sequence
  Description of Artificial Sequence: Synthetic oligonucleotide
  Target: ATXN1; (-) strand; PAM type: NRG; PAM sequence: AGG
tgacatatggtagcattgtt

SEQ ID NO: 71313 - DNA, 20 bp, Artificial Sequence
  Description of Artificial Sequence: Synthetic oligonucleotide
  Target: ATXN1; (-) strand; PAM type: NRG; PAM sequence: TAG
ttgacatatggtagcattgt

SEQ ID NO: 71314 - DNA, 20 bp, Artificial Sequence
  Description of Artificial Sequence: Synthetic oligonucleotide
  Target: ATXN1; (-) strand; PAM type: NRG; PAM sequence: TAG
gtgttgagtttgacatatgg

SEQ ID NO: 71315 - DNA, 20 bp, Artificial Sequence
  Description of Artificial Sequence: Synthetic oligonucleotide
  Target: ATXN1; (-) strand; PAM type: NRG; PAM sequence: TGG
ttagtgttgagtttgacata

SEQ ID NO: 71316 - DNA, 20 bp, Artificial Sequence
  Description of Artificial Sequence: Synthetic oligonucleotide
  Target: ATXN1; (-) strand; PAM type: NRG; PAM sequence: GAG
ggcgagtctgccttagtgtt

SEQ ID NO: 71317 - DNA, 20 bp, Artificial Sequence
  Description of Artificial Sequence: Synthetic oligonucleotide
  Target: ATXN1; (-) strand; PAM type: NRG; PAM sequence: TAG
tgtcttaggcgagtctgcct

SEQ ID NO: 71318 - DNA, 20 bp, Artificial Sequence
  Description of Artificial Sequence: Synthetic oligonucleotide
  Target: ATXN1; (-) strand; PAM type: NRG; PAM sequence: GAG
tctgggtgggtgtcttaggc

SEQ ID NO: 71319 - DNA, 20 bp, Artificial Sequence
  Description of Artificial Sequence: Synthetic oligonucleotide
  Target: ATXN1; (-) strand; PAM type: NRG; PAM sequence: AGG
gggctctgggtgggtgtctt

SEQ ID NO: 71320 - DNA, 20 bp, Artificial Sequence
  Description of Artificial Sequence: Synthetic oligonucleotide
  Target: ATXN1; (-) strand; PAM type: NRG; PAM sequence: TAG
tgggctctgggtgggtgtct

SEQ ID NO: 71321 - DNA, 20 bp, Artificial Sequence
  Description of Artificial Sequence: Synthetic oligonucleotide
  Target: ATXN1; (-) strand; PAM type: NRG; PAM sequence: GGG
ggaaccactgggctctgggt

SEQ ID NO: 71322 - DNA, 20 bp, Artificial Sequence
  Description of Artificial Sequence: Synthetic oligonucleotide
  Target: ATXN1; (-) strand; PAM type: NRG; PAM sequence: TGG
aggaaccactgggctctggg

SEQ ID NO: 71323 - DNA, 20 bp, Artificial Sequence
  Description of Artificial Sequence: Synthetic oligonucleotide
  Target: ATXN1; (-) strand; PAM type: NRG; PAM sequence: GGG
tgtaggaaccactgggctct

SEQ ID NO: 71324 - DNA, 20 bp, Artificial Sequence
  Description of Artificial Sequence: Synthetic oligonucleotide
  Target: ATXN1; (-) strand; PAM type: NRG; PAM sequence: TGG
ttgtaggaaccactgggctc

SEQ ID NO: 71325 - DNA, 20 bp, Artificial Sequence
  Description of Artificial Sequence: Synthetic oligonucleotide
  Target: ATXN1; (-) strand; PAM type: NRG; PAM sequence: GGG
ttccgattgtaggaaccact

SEQ ID NO: 71326 - DNA, 20 bp, Artificial Sequence
  Description of Artificial Sequence: Synthetic oligonucleotide
  Target: ATXN1; (-) strand; PAM type: NRG; PAM sequence: TGG
tttccgattgtaggaaccac

SEQ ID NO: 71327 - DNA, 20 bp, Artificial Sequence
  Description of Artificial Sequence: Synthetic oligonucleotide
  Target: ATXN1; (-) strand; PAM type: NRG; PAM sequence: AGG
ttatgtgattttccgattgt

SEQ ID NO: 71328 - DNA, 20 bp, Artificial Sequence
  Description of Artificial Sequence: Synthetic oligonucleotide
  Target: ATXN1; (-) strand; PAM type: NRG; PAM sequence: TAG
tttatgtgattttccgattg

SEQ ID NO: 71329 - DNA, 20 bp, Artificial Sequence
  Description of Artificial Sequence: Synthetic oligonucleotide
  Target: ATXN1; (-) strand; PAM type: NRG; PAM sequence: CGG
agaggtgtctatttgacagc

SEQ ID NO: 71330 - DNA, 20 bp, Artificial Sequence
  Description of Artificial Sequence: Synthetic oligonucleotide
  Target: ATXN1; (-) strand; PAM type: NRG; PAM sequence: CAG
ctgcagaggtgtctatttga

SEQ ID NO: 71331 - DNA, 20 bp, Artificial Sequence
  Description of Artificial Sequence: Synthetic oligonucleotide
  Target: ATXN1; (-) strand; PAM type: NRG; PAM sequence: AGG
cacacacccctggcctgcag

SEQ ID NO: 71332 - DNA, 20 bp, Artificial Sequence
  Description of Artificial Sequence: Synthetic oligonucleotide
  Target: ATXN1; (-) strand; PAM type: NRG; PAM sequence: GAG
acacacacccctggcctgca

SEQ ID NO: 71333 - DNA, 20 bp, Artificial Sequence
  Description of Artificial Sequence: Synthetic oligonucleotide
  Target: ATXN1; (-) strand; PAM type: NRG; PAM sequence: CAG
acacacacacccctggcctg

SEQ ID NO: 71334 - DNA, 20 bp, Artificial Sequence
  Description of Artificial Sequence: Synthetic oligonucleotide
  Target: ATXN1; (-) strand; PAM type: NRG; PAM sequence: TGG
gttttagacacacacacccc

SEQ ID NO: 71335 - DNA, 20 bp, Artificial Sequence
  Description of Artificial Sequence: Synthetic oligonucleotide
  Target: ATXN1; (-) strand; PAM type: NRG; PAM sequence: TAG
tgtggccacccagttggttt

SEQ ID NO: 71336 - DNA, 20 bp, Artificial Sequence
  Description of Artificial Sequence: Synthetic oligonucleotide
  Target: ATXN1; (-) strand; PAM type: NRG; PAM sequence: TGG
gaacaatgtggccacccagt

SEQ ID NO: 71337 - DNA, 20 bp, Artificial Sequence
  Description of Artificial Sequence: Synthetic oligonucleotide
  Target: ATXN1; (-) strand; PAM type: NRG; PAM sequence: CAG
tgcagaacaatgtggccacc

SEQ ID NO: 71338 - DNA, 20 bp, Artificial Sequence
  Description of Artificial Sequence: Synthetic oligonucleotide
  Target: ATXN1; (-) strand; PAM type: NRG; PAM sequence: TGG
aaacagactgcagaacaatg

SEQ ID NO: 71339 - DNA, 20 bp, Artificial Sequence
  Description of Artificial Sequence: Synthetic oligonucleotide
  Target: ATXN1; (-) strand; PAM type: NRG; PAM sequence: CAG
actggaaggcaaacagactg

SEQ ID NO: 71340 - DNA, 20 bp, Artificial Sequence
  Description of Artificial Sequence: Synthetic oligonucleotide
  Target: ATXN1; (-) strand; PAM type: NRG; PAM sequence: CAG
agaaagcactggaaggcaaa

SEQ ID NO: 71341 - DNA, 20 bp, Artificial Sequence
  Description of Artificial Sequence: Synthetic oligonucleotide
  Target: ATXN1; (-) strand; PAM type: NRG; PAM sequence: AGG
gcaggaaagaaagcactgga

SEQ ID NO: 71342 - DNA, 20 bp, Artificial Sequence
  Description of Artificial Sequence: Synthetic oligonucleotide
  Target: ATXN1; (-) strand; PAM type: NRG; PAM sequence: AAG
ggcaggaaagaaagcactgg

SEQ ID NO: 71343 - DNA, 20 bp, Artificial Sequence
  Description of Artificial Sequence: Synthetic oligonucleotide
  Target: ATXN1; (-) strand; PAM type: NRG; PAM sequence: TGG
acaggcaggaaagaaagcac

SEQ ID NO: 71344 - DNA, 20 bp, Artificial Sequence
  Description of Artificial Sequence: Synthetic oligonucleotide
  Target: ATXN1; (-) strand; PAM type: NRG; PAM sequence: AAG
tgcatgacaggcaggaaaga

SEQ ID NO: 71345 - DNA, 20 bp, Artificial Sequence
  Description of Artificial Sequence: Synthetic oligonucleotide
  Target: ATXN1; (-) strand; PAM type: NRG; PAM sequence: AAG
tatctgcatgacaggcagga

SEQ ID NO: 71346 - DNA, 20 bp, Artificial Sequence
  Description of Artificial Sequence: Synthetic oligonucleotide
  Target: ATXN1; (-) strand; PAM type: NRG; PAM sequence: AGG
caattatctgcatgacaggc

SEQ ID NO: 71347 - DNA, 20 bp, Artificial Sequence
  Description of Artificial Sequence: Synthetic oligonucleotide
  Target: ATXN1; (-) strand; PAM type: NRG; PAM sequence: CAG
acaattatctgcatgacagg

SEQ ID NO: 71348 - DNA, 20 bp, Artificial Sequence
  Description of Artificial Sequence: Synthetic oligonucleotide
  Target: ATXN1; (-) strand; PAM type: NRG; PAM sequence: AGG
tacacaattatctgcatgac

SEQ ID NO: 71349 - DNA, 20 bp, Artificial Sequence
  Description of Artificial Sequence: Synthetic oligonucleotide
  Target: ATXN1; (-) strand; PAM type: NRG; PAM sequence: CAG
ctacacaattatctgcatga

SEQ ID NO: 71350 - DNA, 20 bp, Artificial Sequence
  Description of Artificial Sequence: Synthetic oligonucleotide
  Target: ATXN1; (-) strand; PAM type: NRG; PAM sequence: GGG
actgatgcgtcctgttgctt

SEQ ID NO: 71351 - DNA, 20 bp, Artificial Sequence
  Description of Artificial Sequence: Synthetic oligonucleotide
  Target: ATXN1; (-) strand; PAM type: NRG; PAM sequence: TGG
aactgatgcgtcctgttgct

SEQ ID NO: 71352 - DNA, 20 bp, Artificial Sequence
  Description of Artificial Sequence: Synthetic oligonucleotide
  Target: ATXN1; (-) strand; PAM type: NRG; PAM sequence: GGG
taggctgactccataaatta

SEQ ID NO: 71353 - DNA, 20 bp, Artificial Sequence
  Description of Artificial Sequence: Synthetic oligonucleotide
  Target: ATXN1; (-) strand; PAM type: NRG; PAM sequence: AGG
ttaggctgactccataaatt

SEQ ID NO: 71354 - DNA, 20 bp, Artificial Sequence
  Description of Artificial Sequence: Synthetic oligonucleotide
  Target: ATXN1; (-) strand; PAM type: NRG; PAM sequence: TAG
tttaggctgactccataaat

SEQ ID NO: 71355 - DNA, 20 bp, Artificial Sequence
  Description of Artificial Sequence: Synthetic oligonucleotide
  Target: ATXN1; (-) strand; PAM type: NRG; PAM sequence: AGG
gtcataaacaaaaggagttt

SEQ ID NO: 71356 - DNA, 20 bp, Artificial Sequence
  Description of Artificial Sequence: Synthetic oligonucleotide
  Target: ATXN1; (-) strand; PAM type: NRG; PAM sequence: TAG
ggtcataaacaaaaggagtt

SEQ ID NO: 71357 - DNA, 20 bp, Artificial Sequence
  Description of Artificial Sequence: Synthetic oligonucleotide
  Target: ATXN1; (-) strand; PAM type: NRG; PAM sequence: GAG
gttgtggtcataaacaaaag

SEQ ID NO: 71358 - DNA, 20 bp, Artificial Sequence
  Description of Artificial Sequence: Synthetic oligonucleotide
  Target: ATXN1; (-) strand; PAM type: NRG; PAM sequence: AGG
gtgttgtggtcataaacaaa

SEQ ID NO: 71359 - DNA, 20 bp, Artificial Sequence
  Description of Artificial Sequence: Synthetic oligonucleotide
  Target: ATXN1; (-) strand; PAM type: NRG; PAM sequence: AAG
tgtgttgtggtcataaacaa

SEQ ID NO: 71360 - DNA, 20 bp, Artificial Sequence
  Description of Artificial Sequence: Synthetic oligonucleotide
  Target: ATXN1; (-) strand; PAM type: NRG; PAM sequence: TGG
catacagagttagtgtgttg

SEQ ID NO: 71361 - DNA, 20 bp, Artificial Sequence
  Description of Artificial Sequence: Synthetic oligonucleotide
  Target: ATXN1; (-) strand; PAM type: NRG; PAM sequence: TAG
aaacatctaacatacagagt

SEQ ID NO: 71362 - DNA, 20 bp, Artificial Sequence
  Description of Artificial Sequence: Synthetic oligonucleotide
  Target: ATXN1; (-) strand; PAM type: NRG; PAM sequence: GAG
ttggaaacatctaacataca

SEQ ID NO: 71363 - DNA, 20 bp, Artificial Sequence
  Description of Artificial Sequence: Synthetic oligonucleotide
  Target: ATXN1; (-) strand; PAM type: NRG; PAM sequence: CAG
tgttggaaacatctaacata

SEQ ID NO: 71364 - DNA, 20 bp, Artificial Sequence
  Description of Artificial Sequence: Synthetic oligonucleotide
  Target: ATXN1; (-) strand; PAM type: NRG; PAM sequence: TGG
attgaggctttgatgcttgt

SEQ ID NO: 71365 - DNA, 20 bp, Artificial Sequence
  Description of Artificial Sequence: Synthetic oligonucleotide
  Target: ATXN1; (-) strand; PAM type: NRG; PAM sequence: AGG
acaaaagacagtaacaattg

SEQ ID NO: 71366 - DNA, 20 bp, Artificial Sequence
  Description of Artificial Sequence: Synthetic oligonucleotide
  Target: ATXN1; (-) strand; PAM type: NRG; PAM sequence: GAG
aacaaaagacagtaacaatt

SEQ ID NO: 71367 - DNA, 20 bp, Artificial Sequence
  Description of Artificial Sequence: Synthetic oligonucleotide
  Target: ATXN1; (-) strand; PAM type: NRG; PAM sequence: CAG
ctggaaaacaaaacaaaaga

SEQ ID NO: 71368 - DNA, 20 bp, Artificial Sequence
  Description of Artificial Sequence: Synthetic oligonucleotide
  Target: ATXN1; (-) strand; PAM type: NRG; PAM sequence: AAG
agaactggaaaacaaaacaa

SEQ ID NO: 71369 - DNA, 20 bp, Artificial Sequence
  Description of Artificial Sequence: Synthetic oligonucleotide
  Target: ATXN1; (-) strand; PAM type: NRG; PAM sequence: TGG
gtcccttgcattagcagaac

SEQ ID NO: 71370 - DNA, 20 bp, Artificial Sequence
  Description of Artificial Sequence: Synthetic oligonucleotide
  Target: ATXN1; (-) strand; PAM type: NRG; PAM sequence: CAG
caggctgtcccttgcattag

SEQ ID NO: 71371 - DNA, 20 bp, Artificial Sequence
  Description of Artificial Sequence: Synthetic oligonucleotide
  Target: ATXN1; (-) strand; PAM type: NRG; PAM sequence: TAG
ggacaggctgtcccttgcat

SEQ ID NO: 71372 - DNA, 20 bp, Artificial Sequence
  Description of Artificial Sequence: Synthetic oligonucleotide
  Target: ATXN1; (-) strand; PAM type: NRG; PAM sequence: AGG
ctagtaataaataccaggac

SEQ ID NO: 71373 - DNA, 20 bp, Artificial Sequence
  Description of Artificial Sequence: Synthetic oligonucleotide
  Target: ATXN1; (-) strand; PAM type: NRG; PAM sequence: CAG
tctagtaataaataccagga

SEQ ID NO: 71374 - DNA, 20 bp, Artificial Sequence
  Description of Artificial Sequence: Synthetic oligonucleotide
  Target: ATXN1; (-) strand; PAM type: NRG; PAM sequence: AGG
ttactctagtaataaatacc

SEQ ID NO: 71375 - DNA, 20 bp, Artificial Sequence
  Description of Artificial Sequence: Synthetic oligonucleotide
  Target: ATXN1; (-) strand; PAM type: NRG; PAM sequence: CAG
attactctagtaataaatac

SEQ ID NO: 71376 - DNA, 20 bp, Artificial Sequence
  Description of Artificial Sequence: Synthetic oligonucleotide
  Target: ATXN1; (-) strand; PAM type: NRG; PAM sequence: TAG
ccccaaacctgacattactc

SEQ ID NO: 71377 - DNA, 20 bp, Artificial Sequence
  Description of Artificial Sequence: Synthetic oligonucleotide
  Target: ATXN1; (-) strand; PAM type: NRG; PAM sequence: GAG
aaactagagaggtattttat

SEQ ID NO: 71378 - DNA, 20 bp, Artificial Sequence
  Description of Artificial Sequence: Synthetic oligonucleotide
  Target: ATXN1; (-) strand; PAM type: NRG; PAM sequence: AGG
caaagaaagccaaactagag

SEQ ID NO: 71379 - DNA, 20 bp, Artificial Sequence
  Description of Artificial Sequence: Synthetic oligonucleotide
  Target: ATXN1; (-) strand; PAM type: NRG; PAM sequence: GAG
gcaaagaaagccaaactaga

SEQ ID NO: 71380 - DNA, 20 bp, Artificial Sequence
  Description of Artificial Sequence: Synthetic oligonucleotide
  Target: ATXN1; (-) strand; PAM type: NRG; PAM sequence: GAG
ttgcaaagaaagccaaacta

SEQ ID NO: 71381 - DNA, 20 bp, Artificial Sequence
  Description of Artificial Sequence: Synthetic oligonucleotide
  Target: ATXN1; (-) strand; PAM type: NRG; PAM sequence: TAG
tcttgcaaagaaagccaaac

SEQ ID NO: 71382 - DNA, 20 bp, Artificial Sequence
  Description of Artificial Sequence: Synthetic oligonucleotide
  Target: ATXN1; (-) strand; PAM type: NRG; PAM sequence: AAG
gttttgatctcttgcaaaga

SEQ ID NO: 71383 - DNA, 20 bp, Artificial Sequence
  Description of Artificial Sequence: Synthetic oligonucleotide
  Target: ATXN1; (-) strand; PAM type: NRG; PAM sequence: AAG
gaatgttttgatctcttgca

SEQ ID NO: 71384 - DNA, 20 bp, Artificial Sequence
  Description of Artificial Sequence: Synthetic oligonucleotide
  Target: ATXN1; (-) strand; PAM type: NRG; PAM sequence: AAG
gatggtgccattaaagaaaa

SEQ ID NO: 71385 - DNA, 20 bp, Artificial Sequence
  Description of Artificial Sequence: Synthetic oligonucleotide
  Target: ATXN1; (-) strand; PAM type: NRG; PAM sequence: AAG
tctttttgatggtgccatta

SEQ ID NO: 71386 - DNA, 20 bp, Artificial Sequence
  Description of Artificial Sequence: Synthetic oligonucleotide
  Target: ATXN1; (-) strand; PAM type: NRG; PAM sequence: TGG
tatatgttgattctttttga

SEQ ID NO: 71387 - DNA, 20 bp, Artificial Sequence
  Description of Artificial Sequence: Synthetic oligonucleotide
  Target: ATXN1; (-) strand; PAM type: NRG; PAM sequence: AAG
tgagaaaccacaagaggaaa

SEQ ID NO: 71388 - DNA, 20 bp, Artificial Sequence
  Description of Artificial Sequence: Synthetic oligonucleotide
  Target: ATXN1; (-) strand; PAM type: NRG; PAM sequence: AGG
aaatactgagaaaccacaag

SEQ ID NO: 71389 - DNA, 20 bp, Artificial Sequence
  Description of Artificial Sequence: Synthetic oligonucleotide
  Target: ATXN1; (-) strand; PAM type: NRG; PAM sequence: GAG
caaatactgagaaaccacaa

SEQ ID NO: 71390 - DNA, 20 bp, Artificial Sequence
  Description of Artificial Sequence: Synthetic oligonucleotide
  Target: ATXN1; (-) strand; PAM type: NRG; PAM sequence: AAG
tccaaatactgagaaaccac

SEQ ID NO: 71391 - DNA, 20 bp, Artificial Sequence
  Description of Artificial Sequence: Synthetic oligonucleotide
  Target: ATXN1; (-) strand; PAM type: NRG; PAM sequence: GAG
aatacagagttccaaatact

SEQ ID NO: 71392 - DNA, 20 bp, Artificial Sequence
  Description of Artificial Sequence: Synthetic oligonucleotide
  Target: ATXN1; (-) strand; PAM type: NRG; PAM sequence: GAG
aagcaaaagataataataca

SEQ ID NO: 71393 - DNA, 20 bp, Artificial Sequence
  Description of Artificial Sequence: Synthetic oligonucleotide
  Target: ATXN1; (-) strand; PAM type: NRG; PAM sequence: CAG
gtaagcaaaagataataata

SEQ ID NO: 71394 - DNA, 20 bp, Artificial Sequence
  Description of Artificial Sequence: Synthetic oligonucleotide
  Target: ATXN1; (-) strand; PAM type: NRG; PAM sequence: AAG
attttatcatttgtaagcaa

SEQ ID NO: 71395 - DNA, 20 bp, Artificial Sequence
  Description of Artificial Sequence: Synthetic oligonucleotide
  Target: ATXN1; (-) strand; PAM type: NRG; PAM sequence: AAG
tgaaatattttatcatttgt

SEQ ID NO: 71396 - DNA, 20 bp, Artificial Sequence
  Description of Artificial Sequence: Synthetic oligonucleotide
  Target: ATXN1; (-) strand; PAM type: NRG; PAM sequence: TAG
cgaaaaggcttgcaagaaaa

SEQ ID NO: 71397 - DNA, 20 bp, Artificial Sequence
  Description of Artificial Sequence: Synthetic oligonucleotide
  Target: ATXN1; (-) strand; PAM type: NRG; PAM sequence: AAG
gagtctccgaaaaggcttgc

SEQ ID NO: 71398 - DNA, 20 bp, Artificial Sequence
  Description of Artificial Sequence: Synthetic oligonucleotide
  Target: ATXN1; (-) strand; PAM type: NRG; PAM sequence: AGG
atgataaagagtctccgaaa

SEQ ID NO: 71399 - DNA, 20 bp, Artificial Sequence
  Description of Artificial Sequence: Synthetic oligonucleotide
  Target: ATXN1; (-) strand; PAM type: NRG; PAM sequence: AAG
aatgataaagagtctccgaa

SEQ ID NO: 71400 - DNA, 20 bp, Artificial Sequence
  Description of Artificial Sequence: Synthetic oligonucleotide
  Target: ATXN1; (-) strand; PAM type: NRG; PAM sequence: GAG
ttgtcaaccaaaatgataaa

SEQ ID NO: 71401 - DNA, 20 bp, Artificial Sequence
  Description of Artificial Sequence: Synthetic oligonucleotide
  Target: ATXN1; (-) strand; PAM type: NRG; PAM sequence: AAG
aattgtcaaccaaaatgata

SEQ ID NO: 71402 - DNA, 20 bp, Artificial Sequence
  Description of Artificial Sequence: Synthetic oligonucleotide
  Target: ATXN1; (-) strand; PAM type: NRG; PAM sequence: TAG
taaaccaaatattactaggg

SEQ ID NO: 71403 - DNA, 20 bp, Artificial Sequence
  Description of Artificial Sequence: Synthetic oligonucleotide
  Target: ATXN1; (-) strand; PAM type: NRG; PAM sequence: GGG
tgataaaccaaatattacta

SEQ ID NO: 71404 - DNA, 20 bp, Artificial Sequence
  Description of Artificial Sequence: Synthetic oligonucleotide
  Target: ATXN1; (-) strand; PAM type: NRG; PAM sequence: AGG
ctgataaaccaaatattact

SEQ ID NO: 71405 - DNA, 20 bp, Artificial Sequence
  Description of Artificial Sequence: Synthetic oligonucleotide
  Target: ATXN1; (-) strand; PAM type: NRG; PAM sequence: TAG
cctgataaaccaaatattac

SEQ ID NO: 71406 - DNA, 20 bp, Artificial Sequence
  Description of Artificial Sequence: Synthetic oligonucleotide
  Target: ATXN1; (-) strand; PAM type: NRG; PAM sequence: AAG
cctcagcgtccccccagatc

SEQ ID NO: 71407 - DNA, 20 bp, Artificial Sequence
  Description of Artificial Sequence: Synthetic oligonucleotide
  Target: ATXN1; (-) strand; PAM type: NRG; PAM sequence: CAG
cattttcctcagcgtccccc

SEQ ID NO: 71408 - DNA, 20 bp, Artificial Sequence
  Description of Artificial Sequence: Synthetic oligonucleotide
  Target: ATXN1; (-) strand; PAM type: NRG; PAM sequence: CAG
aaagtatacctcattttcct

SEQ ID NO: 71409 - DNA, 20 bp, Artificial Sequence
  Description of Artificial Sequence: Synthetic oligonucleotide
  Target: ATXN1; (-) strand; PAM type: NRG; PAM sequence: AAG
ggatggaagaaacgagataa

SEQ ID NO: 71410 - DNA, 20 bp, Artificial Sequence
  Description of Artificial Sequence: Synthetic oligonucleotide
  Target: ATXN1; (-) strand; PAM type: NRG; PAM sequence: GAG
aagaatgggatggaagaaac

SEQ ID NO: 71411 - DNA, 20 bp, Artificial Sequence
  Description of Artificial Sequence: Synthetic oligonucleotide
  Target: ATXN1; (-) strand; PAM type: NRG; PAM sequence: AAG
aaggtggaagaatgggatgg

SEQ ID NO: 71412 - DNA, 20 bp, Artificial Sequence
  Description of Artificial Sequence: Synthetic oligonucleotide
  Target: ATXN1; (-) strand; PAM type: NRG; PAM sequence: TGG
agaaaggtggaagaatggga

SEQ ID NO: 71413 - DNA, 20 bp, Artificial Sequence
  Description of Artificial Sequence: Synthetic oligonucleotide
  Target: ATXN1; (-) strand; PAM type: NRG; PAM sequence: GGG
aggaagaaaggtggaagaat

SEQ ID NO: 71414 - DNA, 20 bp, Artificial Sequence
  Description of Artificial Sequence: Synthetic oligonucleotide
  Target: ATXN1; (-) strand; PAM type: NRG; PAM sequence: TGG
aaggaagaaaggtggaagaa

SEQ ID NO: 71415 - DNA, 20 bp, Artificial Sequence
  Description of Artificial Sequence: Synthetic oligonucleotide
  Target: ATXN1; (-) strand; PAM type: NRG; PAM sequence: AAG
gagaaaaggaagaaaggtgg

SEQ ID NO: 71416 - DNA, 20 bp, Artificial Sequence
  Description of Artificial Sequence: Synthetic oligonucleotide
  Target: ATXN1; (-) strand; PAM type: NRG; PAM sequence: TGG
agagagaaaaggaagaaagg

SEQ ID NO: 71417 - DNA, 20 bp, Artificial Sequence
  Description of Artificial Sequence: Synthetic oligonucleotide
  Target: ATXN1; (-) strand; PAM type: NRG; PAM sequence: AGG
ctaagagagaaaaggaagaa

SEQ ID NO: 71418 - DNA, 20 bp, Artificial Sequence
  Description of Artificial Sequence: Synthetic oligonucleotide
  Target: ATXN1; (-) strand; PAM type: NRG; PAM sequence: AAG
gctaagagagaaaaggaaga

SEQ ID NO: 71419 - DNA, 20 bp, Artificial Sequence
  Description of Artificial Sequence: Synthetic oligonucleotide
  Target: ATXN1; (-) strand; PAM type: NRG; PAM sequence: AAG
ttttgctaagagagaaaagg

SEQ ID NO: 71420 - DNA, 20 bp, Artificial Sequence
  Description of Artificial Sequence: Synthetic oligonucleotide
  Target: ATXN1; (-) strand; PAM type: NRG; PAM sequence: AGG
ggcttttgctaagagagaaa

SEQ ID NO: 71421 - DNA, 20 bp, Artificial Sequence
  Description of Artificial Sequence: Synthetic oligonucleotide
  Target: ATXN1; (-) strand; PAM type: NRG; PAM sequence: AAG
aggcttttgctaagagagaa

SEQ ID NO: 71422 - DNA, 20 bp, Artificial Sequence
  Description of Artificial Sequence: Synthetic oligonucleotide
  Target: ATXN1; (-) strand; PAM type: NRG; PAM sequence: GAG
agtaaaggcttttgctaaga

SEQ ID NO: 71423 - DNA, 20 bp, Artificial Sequence
  Description of Artificial Sequence: Synthetic oligonucleotide
  Target: ATXN1; (-) strand; PAM type: NRG; PAM sequence: GAG
gtagtaaaggcttttgctaa

SEQ ID NO: 71424 - DNA, 20 bp, Artificial Sequence
  Description of Artificial Sequence: Synthetic oligonucleotide
  Target: ATXN1; (-) strand; PAM type: NRG; PAM sequence: AAG
atgtagtaaaggcttttgct

SEQ ID NO: 71425 - DNA, 20 bp, Artificial Sequence
  Description of Artificial Sequence: Synthetic oligonucleotide
  Target: ATXN1; (-) strand; PAM type: NRG; PAM sequence: AGG
gctataggaatatgtagtaa

SEQ ID NO: 71426 - DNA, 20 bp, Artificial Sequence
  Description of Artificial Sequence: Synthetic oligonucleotide
  Target: ATXN1; (-) strand; PAM type: NRG; PAM sequence: AAG
agctataggaatatgtagta

SEQ ID NO: 71427 - DNA, 20 bp, Artificial Sequence
  Description of Artificial Sequence: Synthetic oligonucleotide
  Target: ATXN1; (-) strand; PAM type: NRG; PAM sequence: TAG
taagaagctataggaatatg

SEQ ID NO: 71428 - DNA, 20 bp, Artificial Sequence
  Description of Artificial Sequence: Synthetic oligonucleotide
  Target: ATXN1; (-) strand; PAM type: NRG; PAM sequence: AGG
taaaaagactaagaagctat

SEQ ID NO: 71429 - DNA, 20 bp, Artificial Sequence
  Description of Artificial Sequence: Synthetic oligonucleotide
  Target: ATXN1; (-) strand; PAM type: NRG; PAM sequence: TAG
gtaaaaagactaagaagcta

SEQ ID NO: 71430 - DNA, 20 bp, Artificial Sequence
  Description of Artificial Sequence: Synthetic oligonucleotide
  Target: ATXN1; (-) strand; PAM type: NRG; PAM sequence: AAG
aacgaagtaaaaagactaag

SEQ ID NO: 71431 - DNA, 20 bp, Artificial Sequence
  Description of Artificial Sequence: Synthetic oligonucleotide
  Target: ATXN1; (-) strand; PAM type: NRG; PAM sequence: AAG
gccaacgaagtaaaaagact

SEQ ID NO: 71432 - DNA, 20 bp, Artificial Sequence
  Description of Artificial Sequence: Synthetic oligonucleotide
  Target: ATXN1; (-) strand; PAM type: NRG; PAM sequence: AAG
tcttttgccaacgaagtaaa

SEQ ID NO: 71433 - DNA, 20 bp, Artificial Sequence
  Description of Artificial Sequence: Synthetic oligonucleotide
  Target: ATXN1; (-) strand; PAM type: NRG; PAM sequence: AAG
ctatttttcttttgccaacg

SEQ ID NO: 71434 - DNA, 20 bp, Artificial Sequence
  Description of Artificial Sequence: Synthetic oligonucleotide
  Target: ATXN1; (-) strand; PAM type: NRG; PAM sequence: CAG
tgtgctataaaggaagaagg

SEQ ID NO: 71435 - DNA, 20 bp, Artificial Sequence
  Description of Artificial Sequence: Synthetic oligonucleotide
  Target: ATXN1; (-) strand; PAM type: NRG; PAM sequence: AGG
gtctgtgctataaaggaaga

SEQ ID NO: 71436 - DNA, 20 bp, Artificial Sequence
  Description of Artificial Sequence: Synthetic oligonucleotide
  Target: ATXN1; (-) strand; PAM type: NRG; PAM sequence: AAG
agtctgtgctataaaggaag

SEQ ID NO: 71437 - DNA, 20 bp, Artificial Sequence
  Description of Artificial Sequence: Synthetic oligonucleotide
  Target: ATXN1; (-) strand; PAM type: NRG; PAM sequence: AAG
ggaagtctgtgctataaagg

SEQ ID NO: 71438 - DNA, 20 bp, Artificial Sequence
  Description of Artificial Sequence: Synthetic oligonucleotide
  Target: ATXN1; (-) strand; PAM type: NRG; PAM sequence: AGG
gtgggaagtctgtgctataa

SEQ ID NO: 71439 - DNA, 20 bp, Artificial Sequence
  Description of Artificial Sequence: Synthetic oligonucleotide
  Target: ATXN1; (-) strand; PAM type: NRG; PAM sequence: AAG
agtgggaagtctgtgctata

SEQ ID NO: 71440 - DNA, 20 bp, Artificial Sequence
  Description of Artificial Sequence: Synthetic oligonucleotide
  Target: ATXN1; (-) strand; PAM type: NRG; PAM sequence: AAG
gacaggagtttatgagtggg

SEQ ID NO: 71441 - DNA, 20 bp, Artificial Sequence
  Description of Artificial Sequence: Synthetic oligonucleotide
  Target: ATXN1; (-) strand; PAM type: NRG; PAM sequence: GGG
attgacaggagtttatgagt

SEQ ID NO: 71442 - DNA, 20 bp, Artificial Sequence
  Description of Artificial Sequence: Synthetic oligonucleotide
  Target: ATXN1; (-) strand; PAM type: NRG; PAM sequence: TGG
cattgacaggagtttatgag

SEQ ID NO: 71443 - DNA, 20 bp, Artificial Sequence
  Description of Artificial Sequence: Synthetic oligonucleotide
  Target: ATXN1; (-) strand; PAM type: NRG; PAM sequence: GAG
cagcattgacaggagtttat

SEQ ID NO: 71444 - DNA, 20 bp, Artificial Sequence
  Description of Artificial Sequence: Synthetic oligonucleotide
  Target: ATXN1; (-) strand; PAM type: NRG; PAM sequence: GAG
tttcttaccagcattgacag

SEQ ID NO: 71445 - DNA, 20 bp, Artificial Sequence
  Description of Artificial Sequence: Synthetic oligonucleotide
  Target: ATXN1; (-) strand; PAM type: NRG; PAM sequence: AGG
tttttcttaccagcattgac

SEQ ID NO: 71446 - DNA, 20 bp, Artificial Sequence
  Description of Artificial Sequence: Synthetic oligonucleotide
  Target: ATXN1; (-) strand; PAM type: NRG; PAM sequence: CAG
atttttcttaccagcattga

SEQ ID NO: 71447 - DNA, 20 bp, Artificial Sequence
  Description of Artificial Sequence: Synthetic oligonucleotide
  Target: ATXN1; (-) strand; PAM type: NRG; PAM sequence: CAG
agtagtctgatttttcttac

SEQ ID NO: 71448 - DNA, 20 bp, Artificial Sequence
  Description of Artificial Sequence: Synthetic oligonucleotide
  Target: ATXN1; (-) strand; PAM type: NRG; PAM sequence: TAG
ctcccgcagtgataaaatag

SEQ ID NO: 71449 - DNA, 20 bp, Artificial Sequence
  Description of Artificial Sequence: Synthetic oligonucleotide
  Target: ATXN1; (-) strand; PAM type: NRG; PAM sequence: TAG
gttctcccgcagtgataaaa

SEQ ID NO: 71450 - DNA, 20 bp, Artificial Sequence
  Description of Artificial Sequence: Synthetic oligonucleotide
  Target: ATXN1; (-) strand; PAM type: NRG; PAM sequence: CAG
atgctgtgttagttctcccg

SEQ ID NO: 71451 - DNA, 20 bp, Artificial Sequence
  Description of Artificial Sequence: Synthetic oligonucleotide
  Target: ATXN1; (-) strand; PAM type: NRG; PAM sequence: TAG
aaaggtaaagtatgctgtgt

SEQ ID NO: 71452 - DNA, 20 bp, Artificial Sequence
  Description of Artificial Sequence: Synthetic oligonucleotide
  Target: ATXN1; (-) strand; PAM type: NRG; PAM sequence: AAG
gaattatttgcagaaaggta

SEQ ID NO: 71453 - DNA, 20 bp, Artificial Sequence
  Description of Artificial Sequence: Synthetic oligonucleotide
  Target: ATXN1; (-) strand; PAM type: NRG; PAM sequence: AGG
tgacggaattatttgcagaa

SEQ ID NO: 71454 - DNA, 20 bp, Artificial Sequence
  Description of Artificial Sequence: Synthetic oligonucleotide
  Target: ATXN1; (-) strand; PAM type: NRG; PAM sequence: AAG
ctgacggaattatttgcaga

SEQ ID NO: 71455 - DNA, 20 bp, Artificial Sequence
  Description of Artificial Sequence: Synthetic oligonucleotide
  Target: ATXN1; (-) strand; PAM type: NRG; PAM sequence: CAG
gaatctgacggaattatttg

SEQ ID NO: 71456 - DNA, 20 bp, Artificial Sequence
  Description of Artificial Sequence: Synthetic oligonucleotide
  Target: ATXN1; (-) strand; PAM type: NRG; PAM sequence: CGG
tttggaaatgctgaatctga

SEQ ID NO: 71457 - DNA, 20 bp, Artificial Sequence
  Description of Artificial Sequence: Synthetic oligonucleotide
  Target: ATXN1; (-) strand; PAM type: NRG; PAM sequence: TGG
ataatgagtagaaaacgttt

SEQ ID NO: 71458 - DNA, 20 bp, Artificial Sequence
  Description of Artificial Sequence: Synthetic oligonucleotide
  Target: ATXN1; (-) strand; PAM type: NRG; PAM sequence: TAG
tgtagggcttttataatgag

SEQ ID NO: 71459 - DNA, 20 bp, Artificial Sequence
  Description of Artificial Sequence: Synthetic oligonucleotide
  Target: ATXN1; (-) strand; PAM type: NRG; PAM sequence: GAG
gtttgtagggcttttataat

SEQ ID NO: 71460 - DNA, 20 bp, Artificial Sequence
  Description of Artificial Sequence: Synthetic oligonucleotide
  Target: ATXN1; (-) strand; PAM type: NRG; PAM sequence: GGG
ttgtccatttggcgtttgta

SEQ ID NO: 71461 - DNA, 20 bp, Artificial Sequence
  Description of Artificial Sequence: Synthetic oligonucleotide
  Target: ATXN1; (-) strand; PAM type: NRG; PAM sequence: AGG
attgtccatttggcgtttgt

SEQ ID NO: 71462 - DNA, 20 bp, Artificial Sequence
  Description of Artificial Sequence: Synthetic oligonucleotide
  Target: ATXN1; (-) strand; PAM type: NRG; PAM sequence: TAG
tattgtccatttggcgtttg

SEQ ID NO: 71463 - DNA, 20 bp, Artificial Sequence
  Description of Artificial Sequence: Synthetic oligonucleotide
  Target: ATXN1; (-) strand; PAM type: NRG; PAM sequence: TGG
gagcctgtttattgtccatt

SEQ ID NO: 71464 - DNA, 20 bp, Artificial Sequence
  Description of Artificial Sequence: Synthetic oligonucleotide
  Target: ATXN1; (-) strand; PAM type: NRG; PAM sequence: GAG
gtgagcctgcctttggggtg

SEQ ID NO: 71465 - DNA, 20 bp, Artificial Sequence
  Description of Artificial Sequence: Synthetic oligonucleotide
  Target: ATXN1; (-) strand; PAM type: NRG; PAM sequence: TGG
cagtgagcctgcctttgggg

SEQ ID NO: 71466 - DNA, 20 bp, Artificial Sequence
  Description of Artificial Sequence: Synthetic oligonucleotide
  Target: ATXN1; (-) strand; PAM type: NRG; PAM sequence: GGG
taacagtgagcctgcctttg

SEQ ID NO: 71467 - DNA, 20 bp, Artificial Sequence
  Description of Artificial Sequence: Synthetic oligonucleotide
  Target: ATXN1; (-) strand; PAM type: NRG; PAM sequence: GGG
ttaacagtgagcctgccttt

SEQ ID NO: 71468 - DNA, 20 bp, Artificial Sequence
  Description of Artificial Sequence: Synthetic oligonucleotide
  Target: ATXN1; (-) strand; PAM type: NRG; PAM sequence: TGG
attaacagtgagcctgcctt

SEQ ID NO: 71469 - DNA, 20 bp, Artificial Sequence
  Description of Artificial Sequence: Synthetic oligonucleotide
  Target: ATXN1; (-) strand; PAM type: NRG; PAM sequence: GAG
catgttcccccattaacagt

SEQ ID NO: 71470 - DNA, 20 bp, Artificial Sequence
  Description of Artificial Sequence: Synthetic oligonucleotide
  Target: ATXN1; (-) strand; PAM type: NRG; PAM sequence: CAG
ttctcatgttcccccattaa

SEQ ID NO: 71471 - DNA, 20 bp, Artificial Sequence
  Description of Artificial Sequence: Synthetic oligonucleotide
  Target: ATXN1; (-) strand; PAM type: NRG; PAM sequence: GGG
atgttgttcctatttttaat

SEQ ID NO: 71472 - DNA, 20 bp, Artificial Sequence
  Description of Artificial Sequence: Synthetic oligonucleotide
  Target: ATXN1; (-) strand; PAM type: NRG; PAM sequence: TGG
catgttgttcctatttttaa

SEQ ID NO: 71473 - DNA, 20 bp, Artificial Sequence
  Description of Artificial Sequence: Synthetic oligonucleotide
  Target: ATXN1; (-) strand; PAM type: NRG; PAM sequence: TAG
ttaaataacagagatgatgg

SEQ ID NO: 71474 - DNA, 20 bp, Artificial Sequence
  Description of Artificial Sequence: Synthetic oligonucleotide
  Target: ATXN1; (-) strand; PAM type: NRG; PAM sequence: TGG
gtgttaaataacagagatga

SEQ ID NO: 71475 - DNA, 20 bp, Artificial Sequence
  Description of Artificial Sequence: Synthetic oligonucleotide
  Target: ATXN1; (-) strand; PAM type: NRG; PAM sequence: GAG
cagatcagtgttaaataaca

SEQ ID NO: 71476 - DNA, 20 bp, Artificial Sequence
  Description of Artificial Sequence: Synthetic oligonucleotide
  Target: ATXN1; (-) strand; PAM type: NRG; PAM sequence: CAG
aacagatcagtgttaaataa

SEQ ID NO: 71477 - DNA, 20 bp, Artificial Sequence
  Description of Artificial Sequence: Synthetic oligonucleotide
  Target: ATXN1; (-) strand; PAM type: NRG; PAM sequence: CAG
attggctaagtttaacagat

SEQ ID NO: 71478 - DNA, 20 bp, Artificial Sequence
  Description of Artificial Sequence: Synthetic oligonucleotide
  Target: ATXN1; (-) strand; PAM type: NRG; PAM sequence: CAG
gttaaattggctaagtttaa

SEQ ID NO: 71479 - DNA, 20 bp, Artificial Sequence
  Description of Artificial Sequence: Synthetic oligonucleotide
  Target: ATXN1; (-) strand; PAM type: NRG; PAM sequence: AAG
cttatgcagttaaattggct

SEQ ID NO: 71480 - DNA, 20 bp, Artificial Sequence
  Description of Artificial Sequence: Synthetic oligonucleotide
  Target: ATXN1; (-) strand; PAM type: NRG; PAM sequence: TGG
tttctcttatgcagttaaat

SEQ ID NO: 71481 - DNA, 20 bp, Artificial Sequence
  Description of Artificial Sequence: Synthetic oligonucleotide
  Target: ATXN1; (-) strand; PAM type: NRG; PAM sequence: CAG
ccttatttatttctcttatg

SEQ ID NO: 71482 - DNA, 20 bp, Artificial Sequence
  Description of Artificial Sequence: Synthetic oligonucleotide
  Target: ATXN1; (-) strand; PAM type: NRG; PAM sequence: TAG
caattgacttgctcagatca

SEQ ID NO: 71483 - DNA, 20 bp, Artificial Sequence
  Description of Artificial Sequence: Synthetic oligonucleotide
  Target: ATXN1; (-) strand; PAM type: NRG; PAM sequence: CAG
agttgttcaattgacttgct

SEQ ID NO: 71484 - DNA, 20 bp, Artificial Sequence
  Description of Artificial Sequence: Synthetic oligonucleotide
  Target: ATXN1; (-) strand; PAM type: NRG; PAM sequence: AAG
tacagaattctctaattaat

SEQ ID NO: 71485 - DNA, 20 bp, Artificial Sequence
  Description of Artificial Sequence: Synthetic oligonucleotide
  Target: ATXN1; (-) strand; PAM type: NRG; PAM sequence: CAG
cttttgtttcagttacccta

SEQ ID NO: 71486 - DNA, 20 bp, Artificial Sequence
  Description of Artificial Sequence: Synthetic oligonucleotide
  Target: ATXN1; (-) strand; PAM type: NRG; PAM sequence: CAG
ttttgtatattcttttgttt

SEQ ID NO: 71487 - DNA, 20 bp, Artificial Sequence
  Description of Artificial Sequence: Synthetic oligonucleotide
  Target: ATXN1; (-) strand; PAM type: NRG; PAM sequence: AGG
ttactggttgtcctttagaa

SEQ ID NO: 71488 - DNA, 20 bp, Artificial Sequence
  Description of Artificial Sequence: Synthetic oligonucleotide
  Target: ATXN1; (-) strand; PAM type: NRG; PAM sequence: AAG
tttactggttgtcctttaga

SEQ ID NO: 71489 - DNA, 20 bp, Artificial Sequence
  Description of Artificial Sequence: Synthetic oligonucleotide
  Target: ATXN1; (-) strand; PAM type: NRG; PAM sequence: TAG
cctttttactggttgtcctt

SEQ ID NO: 71490 - DNA, 20 bp, Artificial Sequence
  Description of Artificial Sequence: Synthetic oligonucleotide
  Target: ATXN1; (-) strand; PAM type: NRG; PAM sequence: TGG
aatatgggatacctttttac

SEQ ID NO: 71491 - DNA, 20 bp, Artificial Sequence
  Description of Artificial Sequence: Synthetic oligonucleotide
  Target: ATXN1; (-) strand; PAM type: NRG; PAM sequence: GGG
ttttgttgttatttaaatat

SEQ ID NO: 71492 - DNA, 20 bp, Artificial Sequence
  Description of Artificial Sequence: Synthetic oligonucleotide
  Target: ATXN1; (-) strand; PAM type: NRG; PAM sequence: TGG
tttttgttgttatttaaata

SEQ ID NO: 71493 - DNA, 20 bp, Artificial Sequence
  Description of Artificial Sequence: Synthetic oligonucleotide
  Target: ATXN1; (-) strand; PAM type: NRG; PAM sequence: AGG
tcctccttcagtttatccct

SEQ ID NO: 71494 - DNA, 20 bp, Artificial Sequence
  Description of Artificial Sequence: Synthetic oligonucleotide
  Target: ATXN1; (-) strand; PAM type: NRG; PAM sequence: TAG
gtcctccttcagtttatccc

SEQ ID NO: 71495 - DNA, 20 bp, Artificial Sequence
  Description of Artificial Sequence: Synthetic oligonucleotide
  Target: ATXN1; (-) strand; PAM type: NRG; PAM sequence: CAG
tcttgcatatagtcctcctt

SEQ ID NO: 71496 - DNA, 20 bp, Artificial Sequence
  Description of Artificial Sequence: Synthetic oligonucleotide
  Target: ATXN1; (-) strand; PAM type: NRG; PAM sequence: TAG
ctttatgtagatcttgcata

SEQ ID NO: 71497 - DNA, 20 bp, Artificial Sequence
  Description of Artificial Sequence: Synthetic oligonucleotide
  Target: ATXN1; (-) strand; PAM type: NRG; PAM sequence: TAG
tgcacccagccctctttatg

SEQ ID NO: 71498 - DNA, 20 bp, Artificial Sequence
  Description of Artificial Sequence: Synthetic oligonucleotide
  Target: ATXN1; (-) strand; PAM type: NRG; PAM sequence: CAG
taggcctgagccactgcacc

SEQ ID NO: 71499 - DNA, 20 bp, Artificial Sequence
  Description of Artificial Sequence: Synthetic oligonucleotide
  Target: ATXN1; (-) strand; PAM type: NRG; PAM sequence: GAG
agtgctggaataataggcct

SEQ ID NO: 71500 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctggaataat

SEQ ID NO: 71501 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtgctggaataa

SEQ ID NO: 71502 - DNA, 20 bp, Artificial Sequence
  Description of Artificial Sequence: Synthetic oligonucleotide
  Target: ATXN1; (-) strand; PAM type: NRG; PAM sequence: TGG
acctcgccctcccaaagtgc

SEQ ID NO: 71503 - DNA, 20 bp, Artificial Sequence
  Description of Artificial Sequence: Synthetic oligonucleotide
  Target: ATXN1; (-) strand; PAM type: NRG; PAM sequence: AAG
ctgcccacctcgccctccca

SEQ ID NO: 71504 - DNA, 20 bp, Artificial Sequence
  Description of Artificial Sequence: Synthetic oligonucleotide
  Target: ATXN1; (-) strand; PAM type: NRG; PAM sequence: AAG
ggtctcgaactcctgacctc

SEQ ID NO: 71505 - DNA, 20 bp, Artificial Sequence
  Description of Artificial Sequence: Synthetic oligonucleotide
  Target: ATXN1; (-) strand; PAM type: NRG; PAM sequence: TGG
tttaccatgtttggttaggc

SEQ ID NO: 71506 - DNA, 20 bp, Artificial Sequence
  Description of Artificial Sequence: Synthetic oligonucleotide
  Target: ATXN1; (-) strand; PAM type: NRG; PAM sequence: AGG
gcgttttaccatgtttggtt

SEQ ID NO: 71507 - DNA, 20 bp, Artificial Sequence
  Description of Artificial Sequence: Synthetic oligonucleotide
  Target: ATXN1; (-) strand; PAM type: NRG; PAM sequence: TAG
ggcgttttaccatgtttggt

SEQ ID NO: 71508 - DNA, 20 bp, Artificial Sequence
  Description of Artificial Sequence: Synthetic oligonucleotide
  Target: ATXN1; (-) strand; PAM type: NRG; PAM sequence: TGG
agacggcgttttaccatgtt

SEQ ID NO: 71509 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 71510 - DNA, 20 bp, Artificial Sequence
  Description of Artificial Sequence: Synthetic oligonucleotide
  Target: ATXN1; (-) strand; PAM type: NRG; PAM sequence: GAG
atttttttgtatttttagta

SEQ ID NO: 71511 - DNA, 20 bp, Artificial Sequence
  Description of Artificial Sequence: Synthetic oligonucleotide
  Target: ATXN1; (-) strand; PAM type: NRG; PAM sequence: TAG
taatttttttgtatttttag

SEQ ID NO: 71512 - DNA, 20 bp, Artificial Sequence
  Description of Artificial Sequence: Synthetic oligonucleotide
  Target: ATXN1; (-) strand; PAM type: NRG; PAM sequence: TAG
ggctaatttttttgtatttt

SEQ ID NO: 71513 - DNA, 20 bp, Artificial Sequence
  Description of Artificial Sequence: Synthetic oligonucleotide
  Target: ATXN1; (-) strand; PAM type: NRG; PAM sequence: TGG
caggtgtctgccaccacacc

SEQ ID NO: 71514 - DNA, 20 bp, Artificial Sequence
  Description of Artificial Sequence: Synthetic oligonucleotide
  Target: ATXN1; (-) strand; PAM type: NRG; PAM sequence: AGG
tccccagtaactgggactac

SEQ ID NO: 71515 - DNA, 20 bp, Artificial Sequence
  Description of Artificial Sequence: Synthetic oligonucleotide
  Target: ATXN1; (-) strand; PAM type: NRG; PAM sequence: CAG
ctccccagtaactgggacta

SEQ ID NO: 71516 - DNA, 20 bp, Artificial Sequence
  Description of Artificial Sequence: Synthetic oligonucleotide
  Target: ATXN1; (-) strand; PAM type: NRG; PAM sequence: GGG
ccttagcctccccagtaact

SEQ ID NO: 71517 - DNA, 20 bp, Artificial Sequence
  Description of Artificial Sequence: Synthetic oligonucleotide
  Target: ATXN1; (-) strand; PAM type: NRG; PAM sequence: TGG
gccttagcctccccagtaac

SEQ ID NO: 71518 - DNA, 20 bp, Artificial Sequence
  Description of Artificial Sequence: Synthetic oligonucleotide
  Target: ATXN1; (-) strand; PAM type: NRG; PAM sequence: CAG
ttcttgtgccttagcctccc

SEQ ID NO: 71519 - DNA, 20 bp, Artificial Sequence
  Description of Artificial Sequence: Synthetic oligonucleotide
  Target: ATXN1; (-) strand; PAM type: NRG; PAM sequence: TAG
ttcaagcgattcttgtgcct

SEQ ID NO: 71520 - DNA, 20 bp, Artificial Sequence
  Description of Artificial Sequence: Synthetic oligonucleotide
  Target: ATXN1; (-) strand; PAM type: NRG; PAM sequence: AAG
aacctctggctcccaggttc

SEQ ID NO: 71521 - DNA, 20 bp, Artificial Sequence
  Description of Artificial Sequence: Synthetic oligonucleotide
  Target: ATXN1; (-) strand; PAM type: NRG; PAM sequence: AGG
cactgaaacctctggctccc

SEQ ID NO: 71522 - DNA, 20 bp, Artificial Sequence
  Description of Artificial Sequence: Synthetic oligonucleotide
  Target: ATXN1; (-) strand; PAM type: NRG; PAM sequence: CAG
tcactgaaacctctggctcc

SEQ ID NO: 71523 - DNA, 20 bp, Artificial Sequence
  Description of Artificial Sequence: Synthetic oligonucleotide
  Target: ATXN1; (-) strand; PAM type: NRG; PAM sequence: TGG
tcttggctcactgaaacctc

SEQ ID NO: 71524 - DNA, 20 bp, Artificial Sequence
  Description of Artificial Sequence: Synthetic oligonucleotide
  Target: ATXN1; (-) strand; PAM type: NRG; PAM sequence: TGG
aaagtgcagtggcacaatct

SEQ ID NO: 71525 - DNA, 20 bp, Artificial Sequence
  Description of Artificial Sequence: Synthetic oligonucleotide
  Target: ATXN1; (-) strand; PAM type: NRG; PAM sequence: TGG
tttcccaggctaaagtgcag

SEQ ID NO: 71526 - DNA, 20 bp, Artificial Sequence
  Description of Artificial Sequence: Synthetic oligonucleotide
  Target: ATXN1; (-) strand; PAM type: NRG; PAM sequence: CAG
ctgtttcccaggctaaagtg

SEQ ID NO: 71527 - DNA, 20 bp, Artificial Sequence
  Description of Artificial Sequence: Synthetic oligonucleotide
  Target: ATXN1; (-) strand; PAM type: NRG; PAM sequence: AAG
tcactctgtttcccaggcta

SEQ ID NO: 71528 - DNA, 20 bp, Artificial Sequence
  Description of Artificial Sequence: Synthetic oligonucleotide
  Target: ATXN1; (-) strand; PAM type: NRG; PAM sequence: AGG
ggggtttcactctgtttccc

SEQ ID NO: 71529 - DNA, 20 bp, Artificial Sequence
  Description of Artificial Sequence: Synthetic oligonucleotide
  Target: ATXN1; (-) strand; PAM type: NRG; PAM sequence: CAG
tggggtttcactctgtttcc

SEQ ID NO: 71530 - DNA, 20 bp, Artificial Sequence
  Description of Artificial Sequence: Synthetic oligonucleotide
  Target: ATXN1; (-) strand; PAM type: NRG; PAM sequence: GGG
ttttttttttttttgaaatg

SEQ ID NO: 71531 - DNA, 20 bp, Artificial Sequence
  Description of Artificial Sequence: Synthetic oligonucleotide
  Target: ATXN1; (-) strand; PAM type: NRG; PAM sequence: GGG
tttttttttttttttgaaat

SEQ ID NO: 71532 - DNA, 20 bp, Artificial Sequence
  Description of Artificial Sequence: Synthetic oligonucleotide
  Target: ATXN1; (-) strand; PAM type: NRG; PAM sequence: TGG
ttttttttttttttttgaaa

SEQ ID NO: 71533 - DNA, 20 bp, Artificial Sequence
  Description of Artificial Sequence: Synthetic oligonucleotide
  Target: ATXN1; (-) strand; PAM type: NRG; PAM sequence: TAG
atttaacattcttctttatg

SEQ ID NO: 71534 - DNA, 20 bp, Artificial Sequence
  Description of Artificial Sequence: Synthetic oligonucleotide
  Target: ATXN1; (-) strand; PAM type: NRG; PAM sequence: TAG
tctcctcctctgtccctcag

SEQ ID NO: 71535 - DNA, 20 bp, Artificial Sequence
  Description of Artificial Sequence: Synthetic oligonucleotide
  Target: ATXN1; (-) strand; PAM type: NRG; PAM sequence: CAG
ctatctcctcctctgtccct

SEQ ID NO: 71536 - DNA, 20 bp, Artificial Sequence
  Description of Artificial Sequence: Synthetic oligonucleotide
  Target: ATXN1; (-) strand; PAM type: NRG; PAM sequence: CAG
aagaagaagatagacctttg

SEQ ID NO: 71537 - DNA, 20 bp, Artificial Sequence
  Description of Artificial Sequence: Synthetic oligonucleotide
  Target: ATXN1; (-) strand; PAM type: NRG; PAM sequence: TAG
ctttctattcaagaagaaga

SEQ ID NO: 71538 - DNA, 20 bp, Artificial Sequence
  Description of Artificial Sequence: Synthetic oligonucleotide
  Target: ATXN1; (-) strand; PAM type: NRG; PAM sequence: AAG
ttgactttctattcaagaag

SEQ ID NO: 71539 - DNA, 20 bp, Artificial Sequence
  Description of Artificial Sequence: Synthetic oligonucleotide
  Target: ATXN1; (-) strand; PAM type: NRG; PAM sequence: AAG
atattgactttctattcaag

SEQ ID NO: 71540 - DNA, 20 bp, Artificial Sequence
  Description of Artificial Sequence: Synthetic oligonucleotide
  Target: ATXN1; (-) strand; PAM type: NRG; PAM sequence: AAG
ttgatattgactttctattc

SEQ ID NO: 71541 - DNA, 20 bp, Artificial Sequence
  Description of Artificial Sequence: Synthetic oligonucleotide
  Target: ATXN1; (-) strand; PAM type: NRG; PAM sequence: AAG
agtttatagataaatataga

SEQ ID NO: 71542 - DNA, 20 bp, Artificial Sequence
  Description of Artificial Sequence: Synthetic oligonucleotide
  Target: ATXN1; (-) strand; PAM type: NRG; PAM sequence: TAG
tataagtttatagataaata

SEQ ID NO: 71543 - DNA, 20 bp, Artificial Sequence
  Description of Artificial Sequence: Synthetic oligonucleotide
  Target: ATXN1; (-) strand; PAM type: NRG; PAM sequence: TAG
tttgacatcatataagttta

SEQ ID NO: 71544 - DNA, 20 bp, Artificial Sequence
  Description of Artificial Sequence: Synthetic oligonucleotide
  Target: ATXN1; (-) strand; PAM type: NRG; PAM sequence: AAG
ttgtatttttgacatcatat

SEQ ID NO: 71545 - DNA, 20 bp, Artificial Sequence
  Description of Artificial Sequence: Synthetic oligonucleotide
  Target: ATXN1; (-) strand; PAM type: NRG; PAM sequence: TAG
ttccataggaacttcagaat

SEQ ID NO: 71546 - DNA, 20 bp, Artificial Sequence
  Description of Artificial Sequence: Synthetic oligonucleotide
  Target: ATXN1; (-) strand; PAM type: NRG; PAM sequence: CAG
ttatttttccataggaactt

SEQ ID NO: 71547 - DNA, 20 bp, Artificial Sequence
  Description of Artificial Sequence: Synthetic oligonucleotide
  Target: ATXN1; (-) strand; PAM type: NRG; PAM sequence: AGG
tttcctgtttatttttccat

SEQ ID NO: 71548 - DNA, 20 bp, Artificial Sequence
  Description of Artificial Sequence: Synthetic oligonucleotide
  Target: ATXN1; (-) strand; PAM type: NRG; PAM sequence: TAG
ctttcctgtttatttttcca

SEQ ID NO: 71549 - DNA, 20 bp, Artificial Sequence
  Description of Artificial Sequence: Synthetic oligonucleotide
  Target: ATXN1; (-) strand; PAM type: NRG; PAM sequence: TGG
ttctttttatatcattgtta

SEQ ID NO: 71550 - DNA, 20 bp, Artificial Sequence
  Description of Artificial Sequence: Synthetic oligonucleotide
  Target: ATXN1; (-) strand; PAM type: NRG; PAM sequence: TGG
taatatttttaatatcggta

SEQ ID NO: 71551 - DNA, 20 bp, Artificial Sequence
  Description of Artificial Sequence: Synthetic oligonucleotide
  Target: ATXN1; (-) strand; PAM type: NRG; PAM sequence: CGG
ctttataatatttttaatat

SEQ ID NO: 71552 - DNA, 20 bp, Artificial Sequence
  Description of Artificial Sequence: Synthetic oligonucleotide
  Target: ATXN1; (-) strand; PAM type: NRG; PAM sequence: AGG
gcacactgttttactttcta

SEQ ID NO: 71553 - DNA, 20 bp, Artificial Sequence
  Description of Artificial Sequence: Synthetic oligonucleotide
  Target: ATXN1; (-) strand; PAM type: NRG; PAM sequence: AAG
tgcacactgttttactttct

SEQ ID NO: 71554 - DNA, 20 bp, Artificial Sequence
  Description of Artificial Sequence: Synthetic oligonucleotide
  Target: ATXN1; (-) strand; PAM type: NRG; PAM sequence: AAG
tcttttctgttgaccttgct

SEQ ID NO: 71555 - DNA, 20 bp, Artificial Sequence
  Description of Artificial Sequence: Synthetic oligonucleotide
  Target: ATXN1; (-) strand; PAM type: NRG; PAM sequence: TGG
actgaagtccagtattcatt

SEQ ID NO: 71556 - DNA, 20 bp, Artificial Sequence
  Description of Artificial Sequence: Synthetic oligonucleotide
  Target: ATXN1; (-) strand; PAM type: NRG; PAM sequence: CAG
ccatatcattcactgaagtc

SEQ ID NO: 71557 - DNA, 20 bp, Artificial Sequence
  Description of Artificial Sequence: Synthetic oligonucleotide
  Target: ATXN1; (-) strand; PAM type: NRG; PAM sequence: AAG
gacacccatatcattcactg

SEQ ID NO: 71558 - DNA, 20 bp, Artificial Sequence
  Description of Artificial Sequence: Synthetic oligonucleotide
  Target: ATXN1; (-) strand; PAM type: NRG; PAM sequence: CAG
tccttcctcccactaaagtg

SEQ ID NO: 71559 - DNA, 20 bp, Artificial Sequence
  Description of Artificial Sequence: Synthetic oligonucleotide
  Target: ATXN1; (-) strand; PAM type: NRG; PAM sequence: AAG
ggaagtccttcctcccacta

SEQ ID NO: 71560 - DNA, 20 bp, Artificial Sequence
  Description of Artificial Sequence: Synthetic oligonucleotide
  Target: ATXN1; (-) strand; PAM type: NRG; PAM sequence: AAG
ggtggccgtccaattattgg

SEQ ID NO: 71561 - DNA, 20 bp, Artificial Sequence
  Description of Artificial Sequence: Synthetic oligonucleotide
  Target: ATXN1; (-) strand; PAM type: NRG; PAM sequence: TGG
ttaggtggccgtccaattat

SEQ ID NO: 71562 - DNA, 20 bp, Artificial Sequence
  Description of Artificial Sequence: Synthetic oligonucleotide
  Target: ATXN1; (-) strand; PAM type: NRG; PAM sequence: TGG
gggatctatatttttttagg

SEQ ID NO: 71563 - DNA, 20 bp, Artificial Sequence
  Description of Artificial Sequence: Synthetic oligonucleotide
  Target: ATXN1; (-) strand; PAM type: NRG; PAM sequence: AGG
ttagggatctatattttttt

SEQ ID NO: 71564 - DNA, 20 bp, Artificial Sequence
  Description of Artificial Sequence: Synthetic oligonucleotide
  Target: ATXN1; (-) strand; PAM type: NRG; PAM sequence: TAG
attagggatctatatttttt

SEQ ID NO: 71565 - DNA, 20 bp, Artificial Sequence
  Description of Artificial Sequence: Synthetic oligonucleotide
  Target: ATXN1; (-) strand; PAM type: NRG; PAM sequence: GGG
ttagtgcaggatgtgaatta

SEQ ID NO: 71566 - DNA, 20 bp, Artificial Sequence
  Description of Artificial Sequence: Synthetic oligonucleotide
  Target: ATXN1; (-) strand; PAM type: NRG; PAM sequence: AGG
tttagtgcaggatgtgaatt

SEQ ID NO: 71567 - DNA, 20 bp, Artificial Sequence
  Description of Artificial Sequence: Synthetic oligonucleotide
  Target: ATXN1; (-) strand; PAM type: NRG; PAM sequence: TAG
ttttagtgcaggatgtgaat

SEQ ID NO: 71568 - DNA, 20 bp, Artificial Sequence
  Description of Artificial Sequence: Synthetic oligonucleotide
  Target: ATXN1; (-) strand; PAM type: NRG; PAM sequence: AGG
cttgggatttattttagtgc

SEQ ID NO: 71569 - DNA, 20 bp, Artificial Sequence
  Description of Artificial Sequence: Synthetic oligonucleotide
  Target: ATXN1; (-) strand; PAM type: NRG; PAM sequence: CAG
ccttgggatttattttagtg

SEQ ID NO: 71570 - DNA, 20 bp, Artificial Sequence
  Description of Artificial Sequence: Synthetic oligonucleotide
  Target: ATXN1; (-) strand; PAM type: NRG; PAM sequence: TAG
ggtcaccttgggatttattt

SEQ ID NO: 71571 - DNA, 20 bp, Artificial Sequence
  Description of Artificial Sequence: Synthetic oligonucleotide
  Target: ATXN1; (-) strand; PAM type: NRG; PAM sequence: GGG
ttcaaatctttggtcacctt

SEQ ID NO: 71572 - DNA, 20 bp, Artificial Sequence
  Description of Artificial Sequence: Synthetic oligonucleotide
  Target: ATXN1; (-) strand; PAM type: NRG; PAM sequence: TGG
gttcaaatctttggtcacct

SEQ ID NO: 71573 - DNA, 20 bp, Artificial Sequence
  Description of Artificial Sequence: Synthetic oligonucleotide
  Target: ATXN1; (-) strand; PAM type: NRG; PAM sequence: TGG
attttttacgttcaaatctt

SEQ ID NO: 71574 - DNA, 20 bp, Artificial Sequence
  Description of Artificial Sequence: Synthetic oligonucleotide
  Target: ATXN1; (-) strand; PAM type: NRG; PAM sequence: AGG
cacttagcgtaatgttttca

SEQ ID NO: 71575 - DNA, 20 bp, Artificial Sequence
  Description of Artificial Sequence: Synthetic oligonucleotide
  Target: ATXN1; (-) strand; PAM type: NRG; PAM sequence: AAG
ccacttagcgtaatgttttc

SEQ ID NO: 71576 - DNA, 20 bp, Artificial Sequence
  Description of Artificial Sequence: Synthetic oligonucleotide
  Target: ATXN1; (-) strand; PAM type: NRG; PAM sequence: TAG
acacaactgacttttccact

SEQ ID NO: 71577 - DNA, 20 bp, Artificial Sequence
  Description of Artificial Sequence: Synthetic oligonucleotide
  Target: ATXN1; (-) strand; PAM type: NRG; PAM sequence: TGG
aaatggaaccatataatgtg

SEQ ID NO: 71578 - DNA, 20 bp, Artificial Sequence
  Description of Artificial Sequence: Synthetic oligonucleotide
  Target: ATXN1; (-) strand; PAM type: NRG; PAM sequence: TGG
tcctagacatctcatataaa

SEQ ID NO: 71579 - DNA, 20 bp, Artificial Sequence
  Description of Artificial Sequence: Synthetic oligonucleotide
  Target: ATXN1; (-) strand; PAM type: NRG; PAM sequence: TAG
ctctatggatttgcctgtcc

SEQ ID NO: 71580 - DNA, 20 bp, Artificial Sequence
  Description of Artificial Sequence: Synthetic oligonucleotide
  Target: ATXN1; (-) strand; PAM type: NRG; PAM sequence: TGG
taatctatgttttatctcta

SEQ ID NO: 71581 - DNA, 20 bp, Artificial Sequence
  Description of Artificial Sequence: Synthetic oligonucleotide
  Target: ATXN1; (-) strand; PAM type: NRG; PAM sequence: TGG
ttcctctaccttctggcccc

SEQ ID NO: 71582 - DNA, 20 bp, Artificial Sequence
  Description of Artificial Sequence: Synthetic oligonucleotide
  Target: ATXN1; (-) strand; PAM type: NRG; PAM sequence: TGG
cccccatttcctctaccttc

SEQ ID NO: 71583 - DNA, 20 bp, Artificial Sequence
  Description of Artificial Sequence: Synthetic oligonucleotide
  Target: ATXN1; (-) strand; PAM type: NRG; PAM sequence: AAG
aaagaaaacctttacccatt

SEQ ID NO: 71584 - DNA, 20 bp, Artificial Sequence
  Description of Artificial Sequence: Synthetic oligonucleotide
  Target: ATXN1; (-) strand; PAM type: NRG; PAM sequence: AAG
tacattttcattactccaaa

SEQ ID NO: 71585 - DNA, 20 bp, Artificial Sequence
  Description of Artificial Sequence: Synthetic oligonucleotide
  Target: ATXN1; (-) strand; PAM type: NRG; PAM sequence: TAG
atgggtttttaatctattca

SEQ ID NO: 71586 - DNA, 20 bp, Artificial Sequence
  Description of Artificial Sequence: Synthetic oligonucleotide
  Target: ATXN1; (-) strand; PAM type: NRG; PAM sequence: GGG
aatgcagtcttttaataaat

SEQ ID NO: 71587 - DNA, 20 bp, Artificial Sequence
  Description of Artificial Sequence: Synthetic oligonucleotide
  Target: ATXN1; (-) strand; PAM type: NRG; PAM sequence: TGG
caatgcagtcttttaataaa

SEQ ID NO: 71588 - DNA, 20 bp, Artificial Sequence
  Description of Artificial Sequence: Synthetic oligonucleotide
  Target: ATXN1; (-) strand; PAM type: NRG; PAM sequence: CAG
cactgtgcccagccacaatg

SEQ ID NO: 71589 - DNA, 20 bp, Artificial Sequence
  Description of Artificial Sequence: Synthetic oligonucleotide
  Target: ATXN1; (-) strand; PAM type: NRG; PAM sequence: CAG
caggtgtgagccactgtgcc

SEQ ID NO: 71590 - DNA, 20 bp, Artificial Sequence
  Description of Artificial Sequence: Synthetic oligonucleotide
  Target: ATXN1; (-) strand; PAM type: NRG; PAM sequence: GAG
agtgctaggattacaggtgt

SEQ ID NO: 71591 - DNA, 20 bp, Artificial Sequence
  Description of Artificial Sequence: Synthetic oligonucleotide
  Target: ATXN1; (-) strand; PAM type: NRG; PAM sequence: AGG
ttctaaagtgctaggattac

SEQ ID NO: 71592 - DNA, 20 bp, Artificial Sequence
  Description of Artificial Sequence: Synthetic oligonucleotide
  Target: ATXN1; (-) strand; PAM type: NRG; PAM sequence: CAG
cttctaaagtgctaggatta

SEQ ID NO: 71593 - DNA, 20 bp, Artificial Sequence
  Description of Artificial Sequence: Synthetic oligonucleotide
  Target: ATXN1; (-) strand; PAM type: NRG; PAM sequence: AGG
ccttagccttctaaagtgct

SEQ ID NO: 71594 - DNA, 20 bp, Artificial Sequence
  Description of Artificial Sequence: Synthetic oligonucleotide
  Target: ATXN1; (-) strand; PAM type: NRG; PAM sequence: TAG
gccttagccttctaaagtgc

SEQ ID NO: 71595 - DNA, 20 bp, Artificial Sequence
  Description of Artificial Sequence: Synthetic oligonucleotide
  Target: ATXN1; (-) strand; PAM type: NRG; PAM sequence: AAG
cctcctgccttagccttcta

SEQ ID NO: 71596 - DNA, 20 bp, Artificial Sequence
  Description of Artificial Sequence: Synthetic oligonucleotide
  Target: ATXN1; (-) strand; PAM type: NRG; PAM sequence: TAG
gctcaagcagcctcctgcct

SEQ ID NO: 71597 - DNA, 20 bp, Artificial Sequence
  Description of Artificial Sequence: Synthetic oligonucleotide
  Target: ATXN1; (-) strand; PAM type: NRG; PAM sequence: CAG
ctggaactcctgggctcaag

SEQ ID NO: 71598 - DNA, 20 bp, Artificial Sequence
  Description of Artificial Sequence: Synthetic oligonucleotide
  Target: ATXN1; (-) strand; PAM type: NRG; PAM sequence: AAG
aacctggaactcctgggctc

SEQ ID NO: 71599 - DNA, 20 bp, Artificial Sequence
  Description of Artificial Sequence: Synthetic oligonucleotide
  Target: ATXN1; (-) strand; PAM type: NRG; PAM sequence: GGG
tactgcaacctggaactcct

SEQ ID NO: 71600 - DNA, 20 bp, Artificial Sequence
  Description of Artificial Sequence: Synthetic oligonucleotide
  Target: ATXN1; (-) strand; PAM type: NRG; PAM sequence: TGG
ttactgcaacctggaactcc

SEQ ID NO: 71601 - DNA, 20 bp, Artificial Sequence
  Description of Artificial Sequence: Synthetic oligonucleotide
  Target: ATXN1; (-) strand; PAM type: NRG; PAM sequence: TGG
agtcacagcttactgcaacc

SEQ ID NO: 71602 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtgcagtca

SEQ ID NO: 71603 - DNA, 20 bp, Artificial Sequence
  Description of Artificial Sequence: Synthetic oligonucleotide
  Target: ATXN1; (-) strand; PAM type: NRG; PAM sequence: CAG
caggctggagtgcagtggtg

SEQ ID NO: 71604 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 71605 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 71606 - DNA, 20 bp, Artificial Sequence
  Description of Artificial Sequence: Synthetic oligonucleotide
  Target: ATXN1; (-) strand; PAM type: NRG; PAM sequence: GAG
tcgctctgtcacccaggctg

SEQ ID NO: 71607 - DNA, 20 bp, Artificial Sequence
  Description of Artificial Sequence: Synthetic oligonucleotide
  Target: ATXN1; (-) strand; PAM type: NRG; PAM sequence: TGG
tctcgctctgtcacccaggc

SEQ ID NO: 71608 - DNA, 20 bp, Artificial Sequence
  Description of Artificial Sequence: Synthetic oligonucleotide
  Target: ATXN1; (-) strand; PAM type: NRG; PAM sequence: AGG
aggatctcgctctgtcaccc

SEQ ID NO: 71609 - DNA, 20 bp, Artificial Sequence
  Description of Artificial Sequence: Synthetic oligonucleotide
  Target: ATXN1; (-) strand; PAM type: NRG; PAM sequence: CAG
caggatctcgctctgtcacc

SEQ ID NO: 71610 - DNA, 20 bp, Artificial Sequence
  Description of Artificial Sequence: Synthetic oligonucleotide
  Target: ATXN1; (-) strand; PAM type: NRG; PAM sequence: AGG
tttttttttttttttgacac

SEQ ID NO: 71611 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaca

SEQ ID NO: 71612 - DNA, 20 bp, Artificial Sequence
  Description of Artificial Sequence: Synthetic oligonucleotide
  Target: ATXN1; (-) strand; PAM type: NRG; PAM sequence: GAG
aaaattaaaaaggttttatt

SEQ ID NO: 71613 - DNA, 20 bp, Artificial Sequence
  Description of Artificial Sequence: Synthetic oligonucleotide
  Target: ATXN1; (-) strand; PAM type: NRG; PAM sequence: AGG
aaagaaaataaaaattaaaa

SEQ ID NO: 71614 - DNA, 20 bp, Artificial Sequence
  Description of Artificial Sequence: Synthetic oligonucleotide
  Target: ATXN1; (-) strand; PAM type: NRG; PAM sequence: AAG
aaaagaaaataaaaattaaa

SEQ ID NO: 71615 - DNA, 20 bp, Artificial Sequence
  Description of Artificial Sequence: Synthetic oligonucleotide
  Target: ATXN1; (-) strand; PAM type: NRG; PAM sequence: AAG
gagtgagaccctgtctctaa

SEQ ID NO: 71616 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtgacagagt

SEQ ID NO: 71617 - DNA, 20 bp, Artificial Sequence
  Description of Artificial Sequence: Synthetic oligonucleotide
  Target: ATXN1; (-) strand; PAM type: NRG; PAM sequence: GAG
acactccagcctgggtgaca

SEQ ID NO: 71618 - DNA, 20 bp, Artificial Sequence
  Description of Artificial Sequence: Synthetic oligonucleotide
  Target: ATXN1; (-) strand; PAM type: NRG; PAM sequence: CAG
ctacactccagcctgggtga

SEQ ID NO: 71619 - DNA, 20 bp, Artificial Sequence
  Description of Artificial Sequence: Synthetic oligonucleotide
  Target: ATXN1; (-) strand; PAM type: NRG; PAM sequence: GGG
gtgctactacactccagcct

SEQ ID NO: 71620 - DNA, 20 bp, Artificial Sequence
  Description of Artificial Sequence: Synthetic oligonucleotide
  Target: ATXN1; (-) strand; PAM type: NRG; PAM sequence: TGG
cgtgctactacactccagcc

SEQ ID NO: 71621 - DNA, 20 bp, Artificial Sequence
  Description of Artificial Sequence: Synthetic oligonucleotide
  Target: ATXN1; (-) strand; PAM type: NRG; PAM sequence: CAG
atggtcgtgctactacactc

SEQ ID NO: 71622 - DNA, 20 bp, Artificial Sequence
  Description of Artificial Sequence: Synthetic oligonucleotide
  Target: ATXN1; (-) strand; PAM type: NRG; PAM sequence: TGG
tttgagactgcagtgagtta

SEQ ID NO: 71623 - DNA, 20 bp, Artificial Sequence
  Description of Artificial Sequence: Synthetic oligonucleotide
  Target: ATXN1; (-) strand; PAM type: NRG; PAM sequence: GAG
caggagtttgagactgcagt

SEQ ID NO: 71624 - DNA, 20 bp, Artificial Sequence
  Description of Artificial Sequence: Synthetic oligonucleotide
  Target: ATXN1; (-) strand; PAM type: NRG; PAM sequence: CAG
agcccaggagtttgagactg

SEQ ID NO: 71625 - DNA, 20 bp, Artificial Sequence
  Description of Artificial Sequence: Synthetic oligonucleotide
  Target: ATXN1; (-) strand; PAM type: NRG; PAM sequence: GAG
ttgtttgagcccaggagttt

SEQ ID NO: 71626 - DNA, 20 bp, Artificial Sequence
  Description of Artificial Sequence: Synthetic oligonucleotide
  Target: ATXN1; (-) strand; PAM type: NRG; PAM sequence: GAG
gaaggattgtttgagcccag

SEQ ID NO: 71627 - DNA, 20 bp, Artificial Sequence
  Description of Artificial Sequence: Synthetic oligonucleotide
  Target: ATXN1; (-) strand; PAM type: NRG; PAM sequence: AGG
tggaaggattgtttgagccc

SEQ ID NO: 71628 - DNA, 20 bp, Artificial Sequence
  Description of Artificial Sequence: Synthetic oligonucleotide
  Target: ATXN1; (-) strand; PAM type: NRG; PAM sequence: CAG
gtggaaggattgtttgagcc

SEQ ID NO: 71629 - DNA, 20 bp, Artificial Sequence
  Description of Artificial Sequence: Synthetic oligonucleotide
  Target: ATXN1; (-) strand; PAM type: NRG; PAM sequence: GAG
ctgaggtggaaggattgttt

SEQ ID NO: 71630 - DNA, 20 bp, Artificial Sequence
  Description of Artificial Sequence: Synthetic oligonucleotide
  Target: ATXN1; (-) strand; PAM type: NRG; PAM sequence: AGG
actcgggaggctgaggtgga

SEQ ID NO: 71631 - DNA, 20 bp, Artificial Sequence
  Description of Artificial Sequence: Synthetic oligonucleotide
  Target: ATXN1; (-) strand; PAM type: NRG; PAM sequence: AAG
tactcgggaggctgaggtgg

SEQ ID NO: 71632 - DNA, 20 bp, Artificial Sequence
  Description of Artificial Sequence: Synthetic oligonucleotide
  Target: ATXN1; (-) strand; PAM type: NRG; PAM sequence: TGG
ttgtactcgggaggctgagg

SEQ ID NO: 71633 - DNA, 20 bp, Artificial Sequence
  Description of Artificial Sequence: Synthetic oligonucleotide
  Target: ATXN1; (-) strand; PAM type: NRG; PAM sequence: AGG
tgtttgtactcgggaggctg

SEQ ID NO: 71634 - DNA, 20 bp, Artificial Sequence
  Description of Artificial Sequence: Synthetic oligonucleotide
  Target: ATXN1; (-) strand; PAM type: NRG; PAM sequence: GAG
ctgtttgtactcgggaggct

SEQ ID NO: 71635 - DNA, 20 bp, Artificial Sequence
  Description of Artificial Sequence: Synthetic oligonucleotide
  Target: ATXN1; (-) strand; PAM type: NRG; PAM sequence: AGG
cacgcctgtttgtactcggg

SEQ ID NO: 71636 - DNA, 20 bp, Artificial Sequence
  Description of Artificial Sequence: Synthetic oligonucleotide
  Target: ATXN1; (-) strand; PAM type: NRG; PAM sequence: GAG
gcacgcctgtttgtactcgg

SEQ ID NO: 71637 - DNA, 20 bp, Artificial Sequence
  Description of Artificial Sequence: Synthetic oligonucleotide
  Target: ATXN1; (-) strand; PAM type: NRG; PAM sequence: GGG
gcgcacgcctgtttgtactc

SEQ ID NO: 71638 - DNA, 20 bp, Artificial Sequence
  Description of Artificial Sequence: Synthetic oligonucleotide
  Target: ATXN1; (-) strand; PAM type: NRG; PAM sequence: CGG
ggcgcacgcctgtttgtact

SEQ ID NO: 71639 - DNA, 20 bp, Artificial Sequence
  Description of Artificial Sequence: Synthetic oligonucleotide
  Target: ATXN1; (-) strand; PAM type: NRG; PAM sequence: TGG
taataaatagccaaacatgg

SEQ ID NO: 71640 - DNA, 20 bp, Artificial Sequence
  Description of Artificial Sequence: Synthetic oligonucleotide
  Target: ATXN1; (-) strand; PAM type: NRG; PAM sequence: TGG
taataataaatagccaaaca

SEQ ID NO: 71641 - DNA, 20 bp, Artificial Sequence
  Description of Artificial Sequence: Synthetic oligonucleotide
  Target: ATXN1; (-) strand; PAM type: NRG; PAM sequence: TAG
tacataataataataataaa

SEQ ID NO: 71642 - DNA, 20 bp, Artificial Sequence
  Description of Artificial Sequence: Synthetic oligonucleotide
  Target: ATXN1; (-) strand; PAM type: NRG; PAM sequence: GAG
accagtctggacaacacagg

SEQ ID NO: 71643 - DNA, 20 bp, Artificial Sequence
  Description of Artificial Sequence: Synthetic oligonucleotide
  Target: ATXN1; (-) strand; PAM type: NRG; PAM sequence: GGG
agaccagtctggacaacaca

SEQ ID NO: 71644 - DNA, 20 bp, Artificial Sequence
  Description of Artificial Sequence: Synthetic oligonucleotide
  Target: ATXN1; (-) strand; PAM type: NRG; PAM sequence: AGG
gagaccagtctggacaacac

SEQ ID NO: 71645 - DNA, 20 bp, Artificial Sequence
  Description of Artificial Sequence: Synthetic oligonucleotide
  Target: ATXN1; (-) strand; PAM type: NRG; PAM sequence: CAG
agagaccagtctggacaaca

SEQ ID NO: 71646 - DNA, 20 bp, Artificial Sequence
  Description of Artificial Sequence: Synthetic oligonucleotide
  Target: ATXN1; (-) strand; PAM type: NRG; PAM sequence: TGG
ccaggagttagagaccagtc

SEQ ID NO: 71647 - DNA, 20 bp, Artificial Sequence
  Description of Artificial Sequence: Synthetic oligonucleotide
  Target: ATXN1; (-) strand; PAM type: NRG; PAM sequence: CAG
tgaggccaggagttagagac

SEQ ID NO: 71648 - DNA, 20 bp, Artificial Sequence
  Description of Artificial Sequence: Synthetic oligonucleotide
  Target: ATXN1; (-) strand; PAM type: NRG; PAM sequence: GAG
tcacttgaggccaggagtta

SEQ ID NO: 71649 - DNA, 20 bp, Artificial Sequence
  Description of Artificial Sequence: Synthetic oligonucleotide
  Target: ATXN1; (-) strand; PAM type: NRG; PAM sequence: TAG
catcacttgaggccaggagt

SEQ ID NO: 71650 - DNA, 20 bp, Artificial Sequence
  Description of Artificial Sequence: Synthetic oligonucleotide
  Target: ATXN1; (-) strand; PAM type: NRG; PAM sequence: GAG
agagcatcacttgaggccag

SEQ ID NO: 71651 - DNA, 20 bp, Artificial Sequence
  Description of Artificial Sequence: Synthetic oligonucleotide
  Target: ATXN1; (-) strand; PAM type: NRG; PAM sequence: AGG
cgagagcatcacttgaggcc

SEQ ID NO: 71652 - DNA, 20 bp, Artificial Sequence
  Description of Artificial Sequence: Synthetic oligonucleotide
  Target: ATXN1; (-) strand; PAM type: NRG; PAM sequence: CAG
gcgagagcatcacttgaggc

SEQ ID NO: 71653 - DNA, 20 bp, Artificial Sequence
  Description of Artificial Sequence: Synthetic oligonucleotide
  Target: ATXN1; (-) strand; PAM type: NRG; PAM sequence: AGG
caaggcgagagcatcacttg

SEQ ID NO: 71654 - DNA, 20 bp, Artificial Sequence
  Description of Artificial Sequence: Synthetic oligonucleotide
  Target: ATXN1; (-) strand; PAM type: NRG; PAM sequence: GAG
ccaaggcgagagcatcactt

SEQ ID NO: 71655 - DNA, 20 bp, Artificial Sequence
  Description of Artificial Sequence: Synthetic oligonucleotide
  Target: ATXN1; (-) strand; PAM type: NRG; PAM sequence: GAG
actttgggaggccaaggcga

SEQ ID NO: 71656 - DNA, 20 bp, Artificial Sequence
  Description of Artificial Sequence: Synthetic oligonucleotide
  Target: ATXN1; (-) strand; PAM type: NRG; PAM sequence: GAG
gcactttgggaggccaaggc

SEQ ID NO: 71657 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggcca

SEQ ID NO: 71658 - DNA, 20 bp, Artificial Sequence
  Description of Artificial Sequence: Synthetic oligonucleotide
  Target: ATXN1; (-) strand; PAM type: NRG; PAM sequence: AAG
tcccagcactttgggaggcc

SEQ ID NO: 71659 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 71660 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 71661 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 71662 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagcactt

SEQ ID NO: 71663 - DNA, 20 bp, Artificial Sequence
  Description of Artificial Sequence: Synthetic oligonucleotide
  Target: ATXN1; (-) strand; PAM type: NRG; PAM sequence: CAG
atggttcatgcctgtaatcc

SEQ ID NO: 71664 - DNA, 20 bp, Artificial Sequence
  Description of Artificial Sequence: Synthetic oligonucleotide
  Target: ATXN1; (-) strand; PAM type: NRG; PAM sequence: TGG
atagttttggccaggcacaa

SEQ ID NO: 71665 - DNA, 20 bp, Artificial Sequence
  Description of Artificial Sequence: Synthetic oligonucleotide
  Target: ATXN1; (-) strand; PAM type: NRG; PAM sequence: AGG
taaaaataatagttttggcc

SEQ ID NO: 71666 - DNA, 20 bp, Artificial Sequence
  Description of Artificial Sequence: Synthetic oligonucleotide
  Target: ATXN1; (-) strand; PAM type: NRG; PAM sequence: CAG
ttaaaaataatagttttggc

SEQ ID NO: 71667 - DNA, 20 bp, Artificial Sequence
  Description of Artificial Sequence: Synthetic oligonucleotide
  Target: ATXN1; (-) strand; PAM type: NRG; PAM sequence: TGG
tattttaaaaataatagttt

SEQ ID NO: 71668 - DNA, 20 bp, Artificial Sequence
  Description of Artificial Sequence: Synthetic oligonucleotide
  Target: ATXN1; (-) strand; PAM type: NRG; PAM sequence: TAG
tattagtattttaaaaataa

SEQ ID NO: 71669 - DNA, 20 bp, Artificial Sequence
  Description of Artificial Sequence: Synthetic oligonucleotide
  Target: ATXN1; (-) strand; PAM type: NRG; PAM sequence: TAG
aattgtctcgtattttttat

SEQ ID NO: 71670 - DNA, 20 bp, Artificial Sequence
  Description of Artificial Sequence: Synthetic oligonucleotide
  Target: ATXN1; (-) strand; PAM type: NRG; PAM sequence: CAG
atacttaggtctcttctacg

SEQ ID NO: 71671 - DNA, 20 bp, Artificial Sequence
  Description of Artificial Sequence: Synthetic oligonucleotide
  Target: ATXN1; (-) strand; PAM type: NRG; PAM sequence: AGG
tttaatttttttacatactt

SEQ ID NO: 71672 - DNA, 20 bp, Artificial Sequence
  Description of Artificial Sequence: Synthetic oligonucleotide
  Target: ATXN1; (-) strand; PAM type: NRG; PAM sequence: TAG
ttttaatttttttacatact

SEQ ID NO: 71673 - DNA, 20 bp, Artificial Sequence
  Description of Artificial Sequence: Synthetic oligonucleotide
  Target: ATXN1; (-) strand; PAM type: NRG; PAM sequence: TGG
tttatcagatttttattttt

SEQ ID NO: 71674 - DNA, 20 bp, Artificial Sequence
  Description of Artificial Sequence: Synthetic oligonucleotide
  Target: ATXN1; (-) strand; PAM type: NRG; PAM sequence: CAG
attaaagtcatcttatttat

SEQ ID NO: 71675 - DNA, 20 bp, Artificial Sequence
  Description of Artificial Sequence: Synthetic oligonucleotide
  Target: ATXN1; (-) strand; PAM type: NRG; PAM sequence: AAG
tgcagggttttaaaaaatta

SEQ ID NO: 71676 - DNA, 20 bp, Artificial Sequence
  Description of Artificial Sequence: Synthetic oligonucleotide
  Target: ATXN1; (-) strand; PAM type: NRG; PAM sequence: GGG
ctttatgttttcttcatgca

SEQ ID NO: 71677 - DNA, 20 bp, Artificial Sequence
  Description of Artificial Sequence: Synthetic oligonucleotide
  Target: ATXN1; (-) strand; PAM type: NRG; PAM sequence: AGG
actttatgttttcttcatgc

SEQ ID NO: 71678 - DNA, 20 bp, Artificial Sequence
  Description of Artificial Sequence: Synthetic oligonucleotide
  Target: ATXN1; (-) strand; PAM type: NRG; PAM sequence: CAG
gactttatgttttcttcatg

SEQ ID NO: 71679 - DNA, 20 bp, Artificial Sequence
  Description of Artificial Sequence: Synthetic oligonucleotide
  Target: ATXN1; (-) strand; PAM type: NRG; PAM sequence: TAG
ccttttgtcttatgctattt

SEQ ID NO: 71680 - DNA, 20 bp, Artificial Sequence
  Description of Artificial Sequence: Synthetic oligonucleotide
  Target: ATXN1; (-) strand; PAM type: NRG; PAM sequence: TAG
catgtaacagctaaaaagat

SEQ ID NO: 71681 - DNA, 20 bp, Artificial Sequence
  Description of Artificial Sequence: Synthetic oligonucleotide
  Target: ATXN1; (-) strand; PAM type: NRG; PAM sequence: AAG
aggagcatgtaacagctaaa

SEQ ID NO: 71682 - DNA, 20 bp, Artificial Sequence
  Description of Artificial Sequence: Synthetic oligonucleotide
  Target: ATXN1; (-) strand; PAM type: NRG; PAM sequence: CAG
ttttttttaggagcatgtaa

SEQ ID NO: 71683 - DNA, 20 bp, Artificial Sequence
  Description of Artificial Sequence: Synthetic oligonucleotide
  Target: ATXN1; (-) strand; PAM type: NRG; PAM sequence: GAG
gaattgacttttttttttag

SEQ ID NO: 71684 - DNA, 20 bp, Artificial Sequence
  Description of Artificial Sequence: Synthetic oligonucleotide
  Target: ATXN1; (-) strand; PAM type: NRG; PAM sequence: AGG
gtgaattgactttttttttt

SEQ ID NO: 71685 - DNA, 20 bp, Artificial Sequence
  Description of Artificial Sequence: Synthetic oligonucleotide
  Target: ATXN1; (-) strand; PAM type: NRG; PAM sequence: TAG
tgtgaattgacttttttttt

SEQ ID NO: 71686 - DNA, 20 bp, Artificial Sequence
  Description of Artificial Sequence: Synthetic oligonucleotide
  Target: ATXN1; (-) strand; PAM type: NRG; PAM sequence: TGG
ccatttttctactacgtttt

SEQ ID NO: 71687 - DNA, 20 bp, Artificial Sequence
  Description of Artificial Sequence: Synthetic oligonucleotide
  Target: ATXN1; (-) strand; PAM type: NRG; PAM sequence: GGG
ccgttcctattttcttttct

SEQ ID NO: 71688 - DNA, 20 bp, Artificial Sequence
  Description of Artificial Sequence: Synthetic oligonucleotide
  Target: ATXN1; (-) strand; PAM type: NRG; PAM sequence: TGG
gccgttcctattttcttttc

SEQ ID NO: 71689 - DNA, 20 bp, Artificial Sequence
  Description of Artificial Sequence: Synthetic oligonucleotide
  Target: ATXN1; (-) strand; PAM type: NRG; PAM sequence: AAG
atatactttcatatgtttaa

SEQ ID NO: 71690 - DNA, 20 bp, Artificial Sequence
  Description of Artificial Sequence: Synthetic oligonucleotide
  Target: ATXN1; (-) strand; PAM type: NRG; PAM sequence: TGG
ggtttctgttattatagtgg

SEQ ID NO: 71691 - DNA, 20 bp, Artificial Sequence
  Description of Artificial Sequence: Synthetic oligonucleotide
  Target: ATXN1; (-) strand; PAM type: NRG; PAM sequence: TGG
atgggtttctgttattatag

SEQ ID NO: 71692 - DNA, 20 bp, Artificial Sequence
  Description of Artificial Sequence: Synthetic oligonucleotide
  Target: ATXN1; (-) strand; PAM type: NRG; PAM sequence: TAG
aatatgggtttctgttatta

SEQ ID NO: 71693 - DNA, 20 bp, Artificial Sequence
  Description of Artificial Sequence: Synthetic oligonucleotide
  Target: ATXN1; (-) strand; PAM type: NRG; PAM sequence: GGG
tattctagtagctttaatat

SEQ ID NO: 71694 - DNA, 20 bp, Artificial Sequence
  Description of Artificial Sequence: Synthetic oligonucleotide
  Target: ATXN1; (-) strand; PAM type: NRG; PAM sequence: TGG
atattctagtagctttaata

SEQ ID NO: 71695 - DNA, 20 bp, Artificial Sequence
  Description of Artificial Sequence: Synthetic oligonucleotide
  Target: ATXN1; (-) strand; PAM type: NRG; PAM sequence: TAG
tgaaaactactatattctag

SEQ ID NO: 71696 - DNA, 20 bp, Artificial Sequence
  Description of Artificial Sequence: Synthetic oligonucleotide
  Target: ATXN1; (-) strand; PAM type: NRG; PAM sequence: TAG
aggtgaaaactactatattc

SEQ ID NO: 71697 - DNA, 20 bp, Artificial Sequence
  Description of Artificial Sequence: Synthetic oligonucleotide
  Target: ATXN1; (-) strand; PAM type: NRG; PAM sequence: AGG
acgatctttgccaatctgag

SEQ ID NO: 71698 - DNA, 20 bp, Artificial Sequence
  Description of Artificial Sequence: Synthetic oligonucleotide
  Target: ATXN1; (-) strand; PAM type: NRG; PAM sequence: GAG
cacgatctttgccaatctga

SEQ ID NO: 71699 - DNA, 20 bp, Artificial Sequence
  Description of Artificial Sequence: Synthetic oligonucleotide
  Target: ATXN1; (-) strand; PAM type: NRG; PAM sequence: GAG
ttcacgatctttgccaatct

SEQ ID NO: 71700 - DNA, 20 bp, Artificial Sequence
  Description of Artificial Sequence: Synthetic oligonucleotide
  Target: ATXN1; (-) strand; PAM type: NRG; PAM sequence: CAG
tttgagtgtgcttttctcca

SEQ ID NO: 71701 - DNA, 20 bp, Artificial Sequence
  Description of Artificial Sequence: Synthetic oligonucleotide
  Target: ATXN1; (-) strand; PAM type: NRG; PAM sequence: GAG
tgttcctgctagcactgttt

SEQ ID NO: 71702 - DNA, 20 bp, Artificial Sequence
  Description of Artificial Sequence: Synthetic oligonucleotide
  Target: ATXN1; (-) strand; PAM type: NRG; PAM sequence: TAG
gtcctattgtatgttcctgc

SEQ ID NO: 71703 - DNA, 20 bp, Artificial Sequence
  Description of Artificial Sequence: Synthetic oligonucleotide
  Target: ATXN1; (-) strand; PAM type: NRG; PAM sequence: TGG
tgccaaattgccctccaatt

SEQ ID NO: 71704 - DNA, 20 bp, Artificial Sequence
  Description of Artificial Sequence: Synthetic oligonucleotide
  Target: ATXN1; (-) strand; PAM type: NRG; PAM sequence: TGG
ggaatatgcagttttaattt

SEQ ID NO: 71705 - DNA, 20 bp, Artificial Sequence
  Description of Artificial Sequence: Synthetic oligonucleotide
  Target: ATXN1; (-) strand; PAM type: NRG; PAM sequence: CAG
gttggatcaaaaggaatatg

SEQ ID NO: 71706 - DNA, 20 bp, Artificial Sequence
  Description of Artificial Sequence: Synthetic oligonucleotide
  Target: ATXN1; (-) strand; PAM type: NRG; PAM sequence: AGG
aggggaattgttggatcaaa

SEQ ID NO: 71707 - DNA, 20 bp, Artificial Sequence
  Description of Artificial Sequence: Synthetic oligonucleotide
  Target: ATXN1; (-) strand; PAM type: NRG; PAM sequence: AAG
aaggggaattgttggatcaa

SEQ ID NO: 71708 - DNA, 20 bp, Artificial Sequence
  Description of Artificial Sequence: Synthetic oligonucleotide
  Target: ATXN1; (-) strand; PAM type: NRG; PAM sequence: TGG
aattactaaaggggaattgt

SEQ ID NO: 71709 - DNA, 20 bp, Artificial Sequence
  Description of Artificial Sequence: Synthetic oligonucleotide
  Target: ATXN1; (-) strand; PAM type: NRG; PAM sequence: GGG
tggaggagaaattactaaag

SEQ ID NO: 71710 - DNA, 20 bp, Artificial Sequence
  Description of Artificial Sequence: Synthetic oligonucleotide
  Target: ATXN1; (-) strand; PAM type: NRG; PAM sequence: GGG
ctggaggagaaattactaaa

SEQ ID NO: 71711 - DNA, 20 bp, Artificial Sequence
  Description of Artificial Sequence: Synthetic oligonucleotide
  Target: ATXN1; (-) strand; PAM type: NRG; PAM sequence: AGG
tctggaggagaaattactaa

SEQ ID NO: 71712 - DNA, 20 bp, Artificial Sequence
  Description of Artificial Sequence: Synthetic oligonucleotide
  Target: ATXN1; (-) strand; PAM type: NRG; PAM sequence: AAG
ctctggaggagaaattacta

SEQ ID NO: 71713 - DNA, 20 bp, Artificial Sequence
  Description of Artificial Sequence: Synthetic oligonucleotide
  Target: ATXN1; (-) strand; PAM type: NRG; PAM sequence: GAG
gtcagcaaggatctctggag

SEQ ID NO: 71714 - DNA, 20 bp, Artificial Sequence
  Description of Artificial Sequence: Synthetic oligonucleotide
  Target: ATXN1; (-) strand; PAM type: NRG; PAM sequence: AGG
atgtcagcaaggatctctgg

SEQ ID NO: 71715 - DNA, 20 bp, Artificial Sequence
  Description of Artificial Sequence: Synthetic oligonucleotide
  Target: ATXN1; (-) strand; PAM type: NRG; PAM sequence: GAG
tatgtcagcaaggatctctg

SEQ ID NO: 71716 - DNA, 20 bp, Artificial Sequence
  Description of Artificial Sequence: Synthetic oligonucleotide
  Target: ATXN1; (-) strand; PAM type: NRG; PAM sequence: TGG
tgtatgtcagcaaggatctc

SEQ ID NO: 71717 - DNA, 20 bp, Artificial Sequence
  Description of Artificial Sequence: Synthetic oligonucleotide
  Target: ATXN1; (-) strand; PAM type: NRG; PAM sequence: AGG
tagcatgttgtatgtcagca

SEQ ID NO: 71718 - DNA, 20 bp, Artificial Sequence
  Description of Artificial Sequence: Synthetic oligonucleotide
  Target: ATXN1; (-) strand; PAM type: NRG; PAM sequence: AAG
atagcatgttgtatgtcagc

SEQ ID NO: 71719 - DNA, 20 bp, Artificial Sequence
  Description of Artificial Sequence: Synthetic oligonucleotide
  Target: ATXN1; (-) strand; PAM type: NRG; PAM sequence: CAG
ataaatagcatgttgtatgt

SEQ ID NO: 71720 - DNA, 20 bp, Artificial Sequence
  Description of Artificial Sequence: Synthetic oligonucleotide
  Target: ATXN1; (-) strand; PAM type: NRG; PAM sequence: TAG
agtgaacaactctctataaa

SEQ ID NO: 71721 - DNA, 20 bp, Artificial Sequence
  Description of Artificial Sequence: Synthetic oligonucleotide
  Target: ATXN1; (-) strand; PAM type: NRG; PAM sequence: CAG
tgctactatgaacaatgctt

SEQ ID NO: 71722 - DNA, 20 bp, Artificial Sequence
  Description of Artificial Sequence: Synthetic oligonucleotide
  Target: ATXN1; (-) strand; PAM type: NRG; PAM sequence: CAG
tttttttttttggttgtttc

SEQ ID NO: 71723 - DNA, 20 bp, Artificial Sequence
  Description of Artificial Sequence: Synthetic oligonucleotide
  Target: ATXN1; (-) strand; PAM type: NRG; PAM sequence: TGG
atggactttttttttttttt

SEQ ID NO: 71724 - DNA, 20 bp, Artificial Sequence
  Description of Artificial Sequence: Synthetic oligonucleotide
  Target: ATXN1; (-) strand; PAM type: NRG; PAM sequence: TGG
agtattcagtcccacattga

SEQ ID NO: 71725 - DNA, 20 bp, Artificial Sequence
  Description of Artificial Sequence: Synthetic oligonucleotide
  Target: ATXN1; (-) strand; PAM type: NRG; PAM sequence: CAG
tgattttgccataaagtatt

SEQ ID NO: 71726 - DNA, 20 bp, Artificial Sequence
  Description of Artificial Sequence: Synthetic oligonucleotide
  Target: ATXN1; (-) strand; PAM type: NRG; PAM sequence: AAG
gattgtatgattttgccata

SEQ ID NO: 71727 - DNA, 20 bp, Artificial Sequence
  Description of Artificial Sequence: Synthetic oligonucleotide
  Target: ATXN1; (-) strand; PAM type: NRG; PAM sequence: TAG
attcttttttagtatctaaa

SEQ ID NO: 71728 - DNA, 20 bp, Artificial Sequence
  Description of Artificial Sequence: Synthetic oligonucleotide
  Target: ATXN1; (-) strand; PAM type: NRG; PAM sequence: TAG
agaacagccttattcttttt

SEQ ID NO: 71729 - DNA, 20 bp, Artificial Sequence
  Description of Artificial Sequence: Synthetic oligonucleotide
  Target: ATXN1; (-) strand; PAM type: NRG; PAM sequence: CAG
tttcttatcggaacatagaa

SEQ ID NO: 71730 - DNA, 20 bp, Artificial Sequence
  Description of Artificial Sequence: Synthetic oligonucleotide
  Target: ATXN1; (-) strand; PAM type: NRG; PAM sequence: TAG
aaacctttcttatcggaaca

SEQ ID NO: 71731 - DNA, 20 bp, Artificial Sequence
  Description of Artificial Sequence: Synthetic oligonucleotide
  Target: ATXN1; (-) strand; PAM type: NRG; PAM sequence: CGG
tcctggaaaacctttcttat

SEQ ID NO: 71732 - DNA, 20 bp, Artificial Sequence
  Description of Artificial Sequence: Synthetic oligonucleotide
  Target: ATXN1; (-) strand; PAM type: NRG; PAM sequence: TGG
tttcacctaacagtgtgtcc

SEQ ID NO: 71733 - DNA, 20 bp, Artificial Sequence
  Description of Artificial Sequence: Synthetic oligonucleotide
  Target: ATXN1; (-) strand; PAM type: NRG; PAM sequence: CAG
ctttacctcttttcacctaa

SEQ ID NO: 71734 - DNA, 20 bp, Artificial Sequence
  Description of Artificial Sequence: Synthetic oligonucleotide
  Target: ATXN1; (-) strand; PAM type: NRG; PAM sequence: AGG
gattatataagcaaaaatat

SEQ ID NO: 71735 - DNA, 20 bp, Artificial Sequence
  Description of Artificial Sequence: Synthetic oligonucleotide
  Target: ATXN1; (-) strand; PAM type: NRG; PAM sequence: TAG
tgattatataagcaaaaata

SEQ ID NO: 71736 - DNA, 20 bp, Artificial Sequence
  Description of Artificial Sequence: Synthetic oligonucleotide
  Target: ATXN1; (-) strand; PAM type: NRG; PAM sequence: AAG
aggatattttatgattatat

SEQ ID NO: 71737 - DNA, 20 bp, Artificial Sequence
  Description of Artificial Sequence: Synthetic oligonucleotide
  Target: ATXN1; (-) strand; PAM type: NRG; PAM sequence: AGG
ttttcttgtgagtcctttta

SEQ ID NO: 71738 - DNA, 20 bp, Artificial Sequence
  Description of Artificial Sequence: Synthetic oligonucleotide
  Target: ATXN1; (-) strand; PAM type: NRG; PAM sequence: AAG
attttcttgtgagtcctttt

SEQ ID NO: 71739 - DNA, 20 bp, Artificial Sequence
  Description of Artificial Sequence: Synthetic oligonucleotide
  Target: ATXN1; (-) strand; PAM type: NRG; PAM sequence: GAG
taccattatcattttcttgt

SEQ ID NO: 71740 - DNA, 20 bp, Artificial Sequence
  Description of Artificial Sequence: Synthetic oligonucleotide
  Target: ATXN1; (-) strand; PAM type: NRG; PAM sequence: AAG
ttgaattctcacctagaagc

SEQ ID NO: 71741 - DNA, 20 bp, Artificial Sequence
  Description of Artificial Sequence: Synthetic oligonucleotide
  Target: ATXN1; (-) strand; PAM type: NRG; PAM sequence: AAG
tcacttgaattctcacctag

SEQ ID NO: 71742 - DNA, 20 bp, Artificial Sequence
  Description of Artificial Sequence: Synthetic oligonucleotide
  Target: ATXN1; (-) strand; PAM type: NRG; PAM sequence: TAG
aagtcacttgaattctcacc

SEQ ID NO: 71743 - DNA, 20 bp, Artificial Sequence
  Description of Artificial Sequence: Synthetic oligonucleotide
  Target: ATXN1; (-) strand; PAM type: NRG; PAM sequence: AAG
tctctcttatttctgtgtct

SEQ ID NO: 71744 - DNA, 20 bp, Artificial Sequence
  Description of Artificial Sequence: Synthetic oligonucleotide
  Target: ATXN1; (-) strand; PAM type: NRG; PAM sequence: AAG
atagatgtacaaggaaaaat

SEQ ID NO: 71745 - DNA, 20 bp, Artificial Sequence
  Description of Artificial Sequence: Synthetic oligonucleotide
  Target: ATXN1; (-) strand; PAM type: NRG; PAM sequence: AGG
gaaggtacgatagatgtaca

SEQ ID NO: 71746 - DNA, 20 bp, Artificial Sequence
  Description of Artificial Sequence: Synthetic oligonucleotide
  Target: ATXN1; (-) strand; PAM type: NRG; PAM sequence: AAG
agaaggtacgatagatgtac

SEQ ID NO: 71747 - DNA, 20 bp, Artificial Sequence
  Description of Artificial Sequence: Synthetic oligonucleotide
  Target: ATXN1; (-) strand; PAM type: NRG; PAM sequence: TAG
tagatatacagaaggtacga

SEQ ID NO: 71748 - DNA, 20 bp, Artificial Sequence
  Description of Artificial Sequence: Synthetic oligonucleotide
  Target: ATXN1; (-) strand; PAM type: NRG; PAM sequence: AGG
tgaattgctagatatacaga

SEQ ID NO: 71749 - DNA, 20 bp, Artificial Sequence
  Description of Artificial Sequence: Synthetic oligonucleotide
  Target: ATXN1; (-) strand; PAM type: NRG; PAM sequence: AAG
ttgaattgctagatatacag

SEQ ID NO: 71750 - DNA, 20 bp, Artificial Sequence
  Description of Artificial Sequence: Synthetic oligonucleotide
  Target: ATXN1; (-) strand; PAM type: NRG; PAM sequence: CAG
gttttgaattgctagatata

SEQ ID NO: 71751 - DNA, 20 bp, Artificial Sequence
  Description of Artificial Sequence: Synthetic oligonucleotide
  Target: ATXN1; (-) strand; PAM type: NRG; PAM sequence: TAG
ttaatattgttttgaattgc

SEQ ID NO: 71752 - DNA, 20 bp, Artificial Sequence
  Description of Artificial Sequence: Synthetic oligonucleotide
  Target: ATXN1; (-) strand; PAM type: NRG; PAM sequence: AAG
gtttcttttctttctttttg

SEQ ID NO: 71753 - DNA, 20 bp, Artificial Sequence
  Description of Artificial Sequence: Synthetic oligonucleotide
  Target: ATXN1; (-) strand; PAM type: NRG; PAM sequence: TGG
ttcagtgtccttggtatgct

SEQ ID NO: 71754 - DNA, 20 bp, Artificial Sequence
  Description of Artificial Sequence: Synthetic oligonucleotide
  Target: ATXN1; (-) strand; PAM type: NRG; PAM sequence: TGG
cttttatatttcagtgtcct

SEQ ID NO: 71755 - DNA, 20 bp, Artificial Sequence
  Description of Artificial Sequence: Synthetic oligonucleotide
  Target: ATXN1; (-) strand; PAM type: NRG; PAM sequence: CAG
actttgctccttttatattt

SEQ ID NO: 71756 - DNA, 20 bp, Artificial Sequence
  Description of Artificial Sequence: Synthetic oligonucleotide
  Target: ATXN1; (-) strand; PAM type: NRG; PAM sequence: TAG
ataacaaagctatccaaaat

SEQ ID NO: 71757 - DNA, 20 bp, Artificial Sequence
  Description of Artificial Sequence: Synthetic oligonucleotide
  Target: ATXN1; (-) strand; PAM type: NRG; PAM sequence: AAG
taaacatactaaaaataaca

SEQ ID NO: 71758 - DNA, 20 bp, Artificial Sequence
  Description of Artificial Sequence: Synthetic oligonucleotide
  Target: ATXN1; (-) strand; PAM type: NRG; PAM sequence: GGG
tcctgggcagtcaattttga

SEQ ID NO: 71759 - DNA, 20 bp, Artificial Sequence
  Description of Artificial Sequence: Synthetic oligonucleotide
  Target: ATXN1; (-) strand; PAM type: NRG; PAM sequence: AGG
ttcctgggcagtcaattttg

SEQ ID NO: 71760 - DNA, 20 bp, Artificial Sequence
  Description of Artificial Sequence: Synthetic oligonucleotide
  Target: ATXN1; (-) strand; PAM type: NRG; PAM sequence: GAG
tttcctgggcagtcaatttt

SEQ ID NO: 71761 - DNA, 20 bp, Artificial Sequence
  Description of Artificial Sequence: Synthetic oligonucleotide
  Target: ATXN1; (-) strand; PAM type: NRG; PAM sequence: CAG
gttgaaatcagtttcctggg

SEQ ID NO: 71762 - DNA, 20 bp, Artificial Sequence
  Description of Artificial Sequence: Synthetic oligonucleotide
  Target: ATXN1; (-) strand; PAM type: NRG; PAM sequence: GGG
aaagttgaaatcagtttcct

SEQ ID NO: 71763 - DNA, 20 bp, Artificial Sequence
  Description of Artificial Sequence: Synthetic oligonucleotide
  Target: ATXN1; (-) strand; PAM type: NRG; PAM sequence: TGG
aaaagttgaaatcagtttcc

SEQ ID NO: 71764 - DNA, 20 bp, Artificial Sequence
  Description of Artificial Sequence: Synthetic oligonucleotide
  Target: ATXN1; (-) strand; PAM type: NRG; PAM sequence: CAG
tatttgggaaaagttgaaat

SEQ ID NO: 71765 - DNA, 20 bp, Artificial Sequence
  Description of Artificial Sequence: Synthetic oligonucleotide
  Target: ATXN1; (-) strand; PAM type: NRG; PAM sequence: AAG
caaatgcctctatttgggaa

SEQ ID NO: 71766 - DNA, 20 bp, Artificial Sequence
  Description of Artificial Sequence: Synthetic oligonucleotide
  Target: ATXN1; (-) strand; PAM type: NRG; PAM sequence: GGG
ttagccaaatgcctctattt

SEQ ID NO: 71767 - DNA, 20 bp, Artificial Sequence
  Description of Artificial Sequence: Synthetic oligonucleotide
  Target: ATXN1; (-) strand; PAM type: NRG; PAM sequence: TGG
cttagccaaatgcctctatt

SEQ ID NO: 71768 - DNA, 20 bp, Artificial Sequence
  Description of Artificial Sequence: Synthetic oligonucleotide
  Target: ATXN1; (-) strand; PAM type: NRG; PAM sequence: TAG
agacatgtgtacaggaagct

SEQ ID NO: 71769 - DNA, 20 bp, Artificial Sequence
  Description of Artificial Sequence: Synthetic oligonucleotide
  Target: ATXN1; (-) strand; PAM type: NRG; PAM sequence: AAG
ggtgcagacatgtgtacagg

SEQ ID NO: 71770 - DNA, 20 bp, Artificial Sequence
  Description of Artificial Sequence: Synthetic oligonucleotide
  Target: ATXN1; (-) strand; PAM type: NRG; PAM sequence: AGG
ggcggtgcagacatgtgtac

SEQ ID NO: 71771 - DNA, 20 bp, Artificial Sequence
  Description of Artificial Sequence: Synthetic oligonucleotide
  Target: ATXN1; (-) strand; PAM type: NRG; PAM sequence: CAG
aggcggtgcagacatgtgta

SEQ ID NO: 71772 - DNA, 20 bp, Artificial Sequence
  Description of Artificial Sequence: Synthetic oligonucleotide
  Target: ATXN1; (-) strand; PAM type: NRG; PAM sequence: CAG
ggtggggtggggaggcggtg

SEQ ID NO: 71773 - DNA, 20 bp, Artificial Sequence
  Description of Artificial Sequence: Synthetic oligonucleotide
  Target: ATXN1; (-) strand; PAM type: NRG; PAM sequence: CGG
gtgatggtggggtggggagg

SEQ ID NO: 71774 - DNA, 20 bp, Artificial Sequence
  Description of Artificial Sequence: Synthetic oligonucleotide
  Target: ATXN1; (-) strand; PAM type: NRG; PAM sequence: AGG
cctgtgatggtggggtgggg

SEQ ID NO: 71775 - DNA, 20 bp, Artificial Sequence
  Description of Artificial Sequence: Synthetic oligonucleotide
  Target: ATXN1; (-) strand; PAM type: NRG; PAM sequence: GAG
tcctgtgatggtggggtggg

SEQ ID NO: 71776 - DNA, 20 bp, Artificial Sequence
  Description of Artificial Sequence: Synthetic oligonucleotide
  Target: ATXN1; (-) strand; PAM type: NRG; PAM sequence: GGG
tctcctgtgatggtggggtg

SEQ ID NO: 71777 - DNA, 20 bp, Artificial Sequence
  Description of Artificial Sequence: Synthetic oligonucleotide
  Target: ATXN1; (-) strand; PAM type: NRG; PAM sequence: GGG
gtctcctgtgatggtggggt

SEQ ID NO: 71778 - DNA, 20 bp, Artificial Sequence
  Description of Artificial Sequence: Synthetic oligonucleotide
  Target: ATXN1; (-) strand; PAM type: NRG; PAM sequence: TGG
cgtctcctgtgatggtgggg

SEQ ID NO: 71779 - DNA, 20 bp, Artificial Sequence
  Description of Artificial Sequence: Synthetic oligonucleotide
  Target: ATXN1; (-) strand; PAM type: NRG; PAM sequence: GGG
tcccgtctcctgtgatggtg

SEQ ID NO: 71780 - DNA, 20 bp, Artificial Sequence
  Description of Artificial Sequence: Synthetic oligonucleotide
  Target: ATXN1; (-) strand; PAM type: NRG; PAM sequence: GGG
gtcccgtctcctgtgatggt

SEQ ID NO: 71781 - DNA, 20 bp, Artificial Sequence
  Description of Artificial Sequence: Synthetic oligonucleotide
  Target: ATXN1; (-) strand; PAM type: NRG; PAM sequence: TGG
ggtcccgtctcctgtgatgg

SEQ ID NO: 71782 - DNA, 20 bp, Artificial Sequence
  Description of Artificial Sequence: Synthetic oligonucleotide
  Target: ATXN1; (-) strand; PAM type: NRG; PAM sequence: TGG
ggtggtcccgtctcctgtga

SEQ ID NO: 71783 - DNA, 20 bp, Artificial Sequence
  Description of Artificial Sequence: Synthetic oligonucleotide
  Target: ATXN1; (-) strand; PAM type: NRG; PAM sequence: TGG
tatccacttggtcttggagg

SEQ ID NO: 71784 - DNA, 20 bp, Artificial Sequence
  Description of Artificial Sequence: Synthetic oligonucleotide
  Target: ATXN1; (-) strand; PAM type: NRG; PAM sequence: AGG
aattatccacttggtcttgg

SEQ ID NO: 71785 - DNA, 20 bp, Artificial Sequence
  Description of Artificial Sequence: Synthetic oligonucleotide
  Target: ATXN1; (-) strand; PAM type: NRG; PAM sequence: GAG
gaattatccacttggtcttg

SEQ ID NO: 71786 - DNA, 20 bp, Artificial Sequence
  Description of Artificial Sequence: Synthetic oligonucleotide
  Target: ATXN1; (-) strand; PAM type: NRG; PAM sequence: TGG
ttgaattatccacttggtct

SEQ ID NO: 71787 - DNA, 20 bp, Artificial Sequence
  Description of Artificial Sequence: Synthetic oligonucleotide
  Target: ATXN1; (-) strand; PAM type: NRG; PAM sequence: TGG
tgaagattgaattatccact

SEQ ID NO: 71788 - DNA, 20 bp, Artificial Sequence
  Description of Artificial Sequence: Synthetic oligonucleotide
  Target: ATXN1; (-) strand; PAM type: NRG; PAM sequence: AAG
gcaaatttgaatggattatg

SEQ ID NO: 71789 - DNA, 20 bp, Artificial Sequence
  Description of Artificial Sequence: Synthetic oligonucleotide
  Target: ATXN1; (-) strand; PAM type: NRG; PAM sequence: TGG
caacagagggcaaatttgaa

SEQ ID NO: 71790 - DNA, 20 bp, Artificial Sequence
  Description of Artificial Sequence: Synthetic oligonucleotide
  Target: ATXN1; (-) strand; PAM type: NRG; PAM sequence: GGG
atatctccagctacaacaga

SEQ ID NO: 71791 - DNA, 20 bp, Artificial Sequence
  Description of Artificial Sequence: Synthetic oligonucleotide
  Target: ATXN1; (-) strand; PAM type: NRG; PAM sequence: AGG
catatctccagctacaacag

SEQ ID NO: 71792 - DNA, 20 bp, Artificial Sequence
  Description of Artificial Sequence: Synthetic oligonucleotide
  Target: ATXN1; (-) strand; PAM type: NRG; PAM sequence: GAG
gcatatctccagctacaaca

SEQ ID NO: 71793 - DNA, 20 bp, Artificial Sequence
  Description of Artificial Sequence: Synthetic oligonucleotide
  Target: ATXN1; (-) strand; PAM type: NRG; PAM sequence: CAG
tggcatatctccagctacaa

SEQ ID NO: 71794 - DNA, 20 bp, Artificial Sequence
  Description of Artificial Sequence: Synthetic oligonucleotide
  Target: ATXN1; (-) strand; PAM type: NRG; PAM sequence: CAG
ccctctcgttggcatatctc

SEQ ID NO: 71795 - DNA, 20 bp, Artificial Sequence
  Description of Artificial Sequence: Synthetic oligonucleotide
  Target: ATXN1; (-) strand; PAM type: NRG; PAM sequence: TGG
tctaaacaaacccctctcgt

SEQ ID NO: 71796 - DNA, 20 bp, Artificial Sequence
  Description of Artificial Sequence: Synthetic oligonucleotide
  Target: ATXN1; (-) strand; PAM type: NRG; PAM sequence: AGG
gtctttttctttgcatcctg

SEQ ID NO: 71797 - DNA, 20 bp, Artificial Sequence
  Description of Artificial Sequence: Synthetic oligonucleotide
  Target: ATXN1; (-) strand; PAM type: NRG; PAM sequence: GAG
ggtctttttctttgcatcct

SEQ ID NO: 71798 - DNA, 20 bp, Artificial Sequence
  Description of Artificial Sequence: Synthetic oligonucleotide
  Target: ATXN1; (-) strand; PAM type: NRG; PAM sequence: TGG
ctacgcagaataagtaaaat

SEQ ID NO: 71799 - DNA, 20 bp, Artificial Sequence
  Description of Artificial Sequence: Synthetic oligonucleotide
  Target: ATXN1; (-) strand; PAM type: NRG; PAM sequence: AAG
aaaattcagctacgcagaat

SEQ ID NO: 71800 - DNA, 20 bp, Artificial Sequence
  Description of Artificial Sequence: Synthetic oligonucleotide
  Target: ATXN1; (-) strand; PAM type: NRG; PAM sequence: CAG
gacctaaaaattcagctacg

SEQ ID NO: 71801 - DNA, 20 bp, Artificial Sequence
  Description of Artificial Sequence: Synthetic oligonucleotide
  Target: ATXN1; (-) strand; PAM type: NRG; PAM sequence: CAG
cattggaagacctaaaaatt

SEQ ID NO: 71802 - DNA, 20 bp, Artificial Sequence
  Description of Artificial Sequence: Synthetic oligonucleotide
  Target: ATXN1; (-) strand; PAM type: NRG; PAM sequence: AAG
ccctaactgatgaccattgg

SEQ ID NO: 71803 - DNA, 20 bp, Artificial Sequence
  Description of Artificial Sequence: Synthetic oligonucleotide
  Target: ATXN1; (-) strand; PAM type: NRG; PAM sequence: TGG
taaccctaactgatgaccat

SEQ ID NO: 71804 - DNA, 20 bp, Artificial Sequence
  Description of Artificial Sequence: Synthetic oligonucleotide
  Target: ATXN1; (-) strand; PAM type: NRG; PAM sequence: CAG
ctcctgtcaggacattttta

SEQ ID NO: 71805 - DNA, 20 bp, Artificial Sequence
  Description of Artificial Sequence: Synthetic oligonucleotide
  Target: ATXN1; (-) strand; PAM type: NRG; PAM sequence: AGG
gctggtctccagctcctgtc

SEQ ID NO: 71806 - DNA, 20 bp, Artificial Sequence
  Description of Artificial Sequence: Synthetic oligonucleotide
  Target: ATXN1; (-) strand; PAM type: NRG; PAM sequence: CAG
ggctggtctccagctcctgt

SEQ ID NO: 71807 - DNA, 20 bp, Artificial Sequence
  Description of Artificial Sequence: Synthetic oligonucleotide
  Target: ATXN1; (-) strand; PAM type: NRG; PAM sequence: CAG
atgttggccaggctggtctc

SEQ ID NO: 71808 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 71809 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 71810 - DNA, 20 bp, Artificial Sequence
  Description of Artificial Sequence: Synthetic oligonucleotide
  Target: ATXN1; (-) strand; PAM type: NRG; PAM sequence: CAG
cggggtttcaccatgttggc

SEQ ID NO: 71811 - DNA, 20 bp, Artificial Sequence
  Description of Artificial Sequence: Synthetic oligonucleotide
  Target: ATXN1; (-) strand; PAM type: NRG; PAM sequence: TGG
gagacggggtttcaccatgt

SEQ ID NO: 71812 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagacg

SEQ ID NO: 71813 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 71814 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 71815 - DNA, 20 bp, Artificial Sequence
  Description of Artificial Sequence: Synthetic oligonucleotide
  Target: ATXN1; (-) strand; PAM type: NRG; PAM sequence: GAG
aaatttttgtatttttagta

SEQ ID NO: 71816 - DNA, 20 bp, Artificial Sequence
  Description of Artificial Sequence: Synthetic oligonucleotide
  Target: ATXN1; (-) strand; PAM type: NRG; PAM sequence: TAG
gcaaatttttgtatttttag

SEQ ID NO: 71817 - DNA, 20 bp, Artificial Sequence
  Description of Artificial Sequence: Synthetic oligonucleotide
  Target: ATXN1; (-) strand; PAM type: NRG; PAM sequence: TAG
ccagcaaatttttgtatttt

SEQ ID NO: 71818 - DNA, 20 bp, Artificial Sequence
  Description of Artificial Sequence: Synthetic oligonucleotide
  Target: ATXN1; (-) strand; PAM type: NRG; PAM sequence: CAG
caagcacctgccaccatgcc

SEQ ID NO: 71819 - DNA, 20 bp, Artificial Sequence
  Description of Artificial Sequence: Synthetic oligonucleotide
  Target: ATXN1; (-) strand; PAM type: NRG; PAM sequence: AAG
tcccgagtagctgggattac

SEQ ID NO: 71820 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtagct

SEQ ID NO: 71821 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 71822 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 71823 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 71824 - DNA, 20 bp, Artificial Sequence
  Description of Artificial Sequence: Synthetic oligonucleotide
  Target: ATXN1; (-) strand; PAM type: NRG; PAM sequence: CAG
tttaaacgattctcctgcct

SEQ ID NO: 71825 - DNA, 20 bp, Artificial Sequence
  Description of Artificial Sequence: Synthetic oligonucleotide
  Target: ATXN1; (-) strand; PAM type: NRG; PAM sequence: CGG
ggagtgcaatggtgtgatct

SEQ ID NO: 71826 - DNA, 20 bp, Artificial Sequence
  Description of Artificial Sequence: Synthetic oligonucleotide
  Target: ATXN1; (-) strand; PAM type: NRG; PAM sequence: TGG
ctatccaaactggagtgcaa

SEQ ID NO: 71827 - DNA, 20 bp, Artificial Sequence
  Description of Artificial Sequence: Synthetic oligonucleotide
  Target: ATXN1; (-) strand; PAM type: NRG; PAM sequence: GAG
cgctcttgctatccaaactg

SEQ ID NO: 71828 - DNA, 20 bp, Artificial Sequence
  Description of Artificial Sequence: Synthetic oligonucleotide
  Target: ATXN1; (-) strand; PAM type: NRG; PAM sequence: TGG
ttcgctcttgctatccaaac

SEQ ID NO: 71829 - DNA, 20 bp, Artificial Sequence
  Description of Artificial Sequence: Synthetic oligonucleotide
  Target: ATXN1; (-) strand; PAM type: NRG; PAM sequence: GAG
ttatttttatttttgaggtg

SEQ ID NO: 71830 - DNA, 20 bp, Artificial Sequence
  Description of Artificial Sequence: Synthetic oligonucleotide
  Target: ATXN1; (-) strand; PAM type: NRG; PAM sequence: TGG
ttttatttttatttttgagg

SEQ ID NO: 71831 - DNA, 20 bp, Artificial Sequence
  Description of Artificial Sequence: Synthetic oligonucleotide
  Target: ATXN1; (-) strand; PAM type: NRG; PAM sequence: AGG
tttttttatttttatttttg

SEQ ID NO: 71832 - DNA, 20 bp, Artificial Sequence
  Description of Artificial Sequence: Synthetic oligonucleotide
  Target: ATXN1; (-) strand; PAM type: NRG; PAM sequence: GAG
atttttttatttttattttt

SEQ ID NO: 71833 - DNA, 20 bp, Artificial Sequence
  Description of Artificial Sequence: Synthetic oligonucleotide
  Target: ATXN1; (-) strand; PAM type: NRG; PAM sequence: AGG
agctcactatagtctttgtc

SEQ ID NO: 71834 - DNA, 20 bp, Artificial Sequence
  Description of Artificial Sequence: Synthetic oligonucleotide
  Target: ATXN1; (-) strand; PAM type: NRG; PAM sequence: CAG
gagctcactatagtctttgt

SEQ ID NO: 71835 - DNA, 20 bp, Artificial Sequence
  Description of Artificial Sequence: Synthetic oligonucleotide
  Target: ATXN1; (-) strand; PAM type: NRG; PAM sequence: TAG
aatgtctgatgagctcacta

SEQ ID NO: 71836 - DNA, 20 bp, Artificial Sequence
  Description of Artificial Sequence: Synthetic oligonucleotide
  Target: ATXN1; (-) strand; PAM type: NRG; PAM sequence: GAG
atattaaaggaatgtctgat

SEQ ID NO: 71837 - DNA, 20 bp, Artificial Sequence
  Description of Artificial Sequence: Synthetic oligonucleotide
  Target: ATXN1; (-) strand; PAM type: NRG; PAM sequence: AGG
ctttagaacaagcatattaa

SEQ ID NO: 71838 - DNA, 20 bp, Artificial Sequence
  Description of Artificial Sequence: Synthetic oligonucleotide
  Target: ATXN1; (-) strand; PAM type: NRG; PAM sequence: AAG
cctttagaacaagcatatta

SEQ ID NO: 71839 - DNA, 20 bp, Artificial Sequence
  Description of Artificial Sequence: Synthetic oligonucleotide
  Target: ATXN1; (-) strand; PAM type: NRG; PAM sequence: AAG
acccctgccccctttagaac

SEQ ID NO: 71840 - DNA, 20 bp, Artificial Sequence
  Description of Artificial Sequence: Synthetic oligonucleotide
  Target: ATXN1; (-) strand; PAM type: NRG; PAM sequence: TAG
ctctccacccctgccccctt

SEQ ID NO: 71841 - DNA, 20 bp, Artificial Sequence
  Description of Artificial Sequence: Synthetic oligonucleotide
  Target: ATXN1; (-) strand; PAM type: NRG; PAM sequence: TAG
tgggccctgcagaccaattc

SEQ ID NO: 71842 - DNA, 20 bp, Artificial Sequence
  Description of Artificial Sequence: Synthetic oligonucleotide
  Target: ATXN1; (-) strand; PAM type: NRG; PAM sequence: CAG
ctgagaggagctgggccctg

SEQ ID NO: 71843 - DNA, 20 bp, Artificial Sequence
  Description of Artificial Sequence: Synthetic oligonucleotide
  Target: ATXN1; (-) strand; PAM type: NRG; PAM sequence: GGG
acgggtgtctgagaggagct

SEQ ID NO: 71844 - DNA, 20 bp, Artificial Sequence
  Description of Artificial Sequence: Synthetic oligonucleotide
  Target: ATXN1; (-) strand; PAM type: NRG; PAM sequence: TGG
gacgggtgtctgagaggagc

SEQ ID NO: 71845 - DNA, 20 bp, Artificial Sequence
  Description of Artificial Sequence: Synthetic oligonucleotide
  Target: ATXN1; (-) strand; PAM type: NRG; PAM sequence: GAG
ccaagacgggtgtctgagag

SEQ ID NO: 71846 - DNA, 20 bp, Artificial Sequence
  Description of Artificial Sequence: Synthetic oligonucleotide
  Target: ATXN1; (-) strand; PAM type: NRG; PAM sequence: AGG
ctccaagacgggtgtctgag

SEQ ID NO: 71847 - DNA, 20 bp, Artificial Sequence
  Description of Artificial Sequence: Synthetic oligonucleotide
  Target: ATXN1; (-) strand; PAM type: NRG; PAM sequence: GAG
cctccaagacgggtgtctga

SEQ ID NO: 71848 - DNA, 20 bp, Artificial Sequence
  Description of Artificial Sequence: Synthetic oligonucleotide
  Target: ATXN1; (-) strand; PAM type: NRG; PAM sequence: GAG
ctcctccaagacgggtgtct

SEQ ID NO: 71849 - DNA, 20 bp, Artificial Sequence
  Description of Artificial Sequence: Synthetic oligonucleotide
  Target: ATXN1; (-) strand; PAM type: NRG; PAM sequence: GGG
cttctaacctcctccaagac

SEQ ID NO: 71850 - DNA, 20 bp, Artificial Sequence
  Description of Artificial Sequence: Synthetic oligonucleotide
  Target: ATXN1; (-) strand; PAM type: NRG; PAM sequence: CGG
tcttctaacctcctccaaga

SEQ ID NO: 71851 - DNA, 20 bp, Artificial Sequence
  Description of Artificial Sequence: Synthetic oligonucleotide
  Target: ATXN1; (-) strand; PAM type: NRG; PAM sequence: AAG
acactcttctaacctcctcc

SEQ ID NO: 71852 - DNA, 20 bp, Artificial Sequence
  Description of Artificial Sequence: Synthetic oligonucleotide
  Target: ATXN1; (-) strand; PAM type: NRG; PAM sequence: TGG
ctgggacattttagtgttgc

SEQ ID NO: 71853 - DNA, 20 bp, Artificial Sequence
  Description of Artificial Sequence: Synthetic oligonucleotide
  Target: ATXN1; (-) strand; PAM type: NRG; PAM sequence: TAG
cattggagtctgggacattt

SEQ ID NO: 71854 - DNA, 20 bp, Artificial Sequence
  Description of Artificial Sequence: Synthetic oligonucleotide
  Target: ATXN1; (-) strand; PAM type: NRG; PAM sequence: GGG
gagaagcttcattggagtct

SEQ ID NO: 71855 - DNA, 20 bp, Artificial Sequence
  Description of Artificial Sequence: Synthetic oligonucleotide
  Target: ATXN1; (-) strand; PAM type: NRG; PAM sequence: TGG
tgagaagcttcattggagtc

SEQ ID NO: 71856 - DNA, 20 bp, Artificial Sequence
  Description of Artificial Sequence: Synthetic oligonucleotide
  Target: ATXN1; (-) strand; PAM type: NRG; PAM sequence: GAG
tagaatgagaagcttcattg

SEQ ID NO: 71857 - DNA, 20 bp, Artificial Sequence
  Description of Artificial Sequence: Synthetic oligonucleotide
  Target: ATXN1; (-) strand; PAM type: NRG; PAM sequence: TGG
ggtagaatgagaagcttcat

SEQ ID NO: 71858 - DNA, 20 bp, Artificial Sequence
  Description of Artificial Sequence: Synthetic oligonucleotide
  Target: ATXN1; (-) strand; PAM type: NRG; PAM sequence: AAG
tgcaggagtggtagaatgag

SEQ ID NO: 71859 - DNA, 20 bp, Artificial Sequence
  Description of Artificial Sequence: Synthetic oligonucleotide
  Target: ATXN1; (-) strand; PAM type: NRG; PAM sequence: GAG
ctctgcaggagtggtagaat

SEQ ID NO: 71860 - DNA, 20 bp, Artificial Sequence
  Description of Artificial Sequence: Synthetic oligonucleotide
  Target: ATXN1; (-) strand; PAM type: NRG; PAM sequence: TAG
aagaatctctgcaggagtgg

SEQ ID NO: 71861 - DNA, 20 bp, Artificial Sequence
  Description of Artificial Sequence: Synthetic oligonucleotide
  Target: ATXN1; (-) strand; PAM type: NRG; PAM sequence: TGG
tacaagaatctctgcaggag

SEQ ID NO: 71862 - DNA, 20 bp, Artificial Sequence
  Description of Artificial Sequence: Synthetic oligonucleotide
  Target: ATXN1; (-) strand; PAM type: NRG; PAM sequence: GAG
tgctacaagaatctctgcag

SEQ ID NO: 71863 - DNA, 20 bp, Artificial Sequence
  Description of Artificial Sequence: Synthetic oligonucleotide
  Target: ATXN1; (-) strand; PAM type: NRG; PAM sequence: AGG
tttgctacaagaatctctgc

SEQ ID NO: 71864 - DNA, 20 bp, Artificial Sequence
  Description of Artificial Sequence: Synthetic oligonucleotide
  Target: ATXN1; (-) strand; PAM type: NRG; PAM sequence: CAG
atttgctacaagaatctctg

SEQ ID NO: 71865 - DNA, 20 bp, Artificial Sequence
  Description of Artificial Sequence: Synthetic oligonucleotide
  Target: ATXN1; (-) strand; PAM type: NRG; PAM sequence: AAG
aaaacccagggatttgctac

SEQ ID NO: 71866 - DNA, 20 bp, Artificial Sequence
  Description of Artificial Sequence: Synthetic oligonucleotide
  Target: ATXN1; (-) strand; PAM type: NRG; PAM sequence: GGG
caggcaaggtgaaaaaccca

SEQ ID NO: 71867 - DNA, 20 bp, Artificial Sequence
  Description of Artificial Sequence: Synthetic oligonucleotide
  Target: ATXN1; (-) strand; PAM type: NRG; PAM sequence: AGG
acaggcaaggtgaaaaaccc

SEQ ID NO: 71868 - DNA, 20 bp, Artificial Sequence
  Description of Artificial Sequence: Synthetic oligonucleotide
  Target: ATXN1; (-) strand; PAM type: NRG; PAM sequence: CAG
gacaggcaaggtgaaaaacc

SEQ ID NO: 71869 - DNA, 20 bp, Artificial Sequence
  Description of Artificial Sequence: Synthetic oligonucleotide
  Target: ATXN1; (-) strand; PAM type: NRG; PAM sequence: AGG
aaagttgtgcttgacaggca

SEQ ID NO: 71870 - DNA, 20 bp, Artificial Sequence
  Description of Artificial Sequence: Synthetic oligonucleotide
  Target: ATXN1; (-) strand; PAM type: NRG; PAM sequence: AAG
aaaagttgtgcttgacaggc

SEQ ID NO: 71871 - DNA, 20 bp, Artificial Sequence
  Description of Artificial Sequence: Synthetic oligonucleotide
  Target: ATXN1; (-) strand; PAM type: NRG; PAM sequence: AGG
tcaaaaaagttgtgcttgac

SEQ ID NO: 71872 - DNA, 20 bp, Artificial Sequence
  Description of Artificial Sequence: Synthetic oligonucleotide
  Target: ATXN1; (-) strand; PAM type: NRG; PAM sequence: CAG
atcaaaaaagttgtgcttga

SEQ ID NO: 71873 - DNA, 20 bp, Artificial Sequence
  Description of Artificial Sequence: Synthetic oligonucleotide
  Target: ATXN1; (-) strand; PAM type: NRG; PAM sequence: AAG
tgtcttcaagggaatcaaaa

SEQ ID NO: 71874 - DNA, 20 bp, Artificial Sequence
  Description of Artificial Sequence: Synthetic oligonucleotide
  Target: ATXN1; (-) strand; PAM type: NRG; PAM sequence: GGG
gatgctgaatgtgtcttcaa

SEQ ID NO: 71875 - DNA, 20 bp, Artificial Sequence
  Description of Artificial Sequence: Synthetic oligonucleotide
  Target: ATXN1; (-) strand; PAM type: NRG; PAM sequence: AGG
tgatgctgaatgtgtcttca

SEQ ID NO: 71876 - DNA, 20 bp, Artificial Sequence
  Description of Artificial Sequence: Synthetic oligonucleotide
  Target: ATXN1; (-) strand; PAM type: NRG; PAM sequence: AAG
gtgatgctgaatgtgtcttc

SEQ ID NO: 71877 - DNA, 20 bp, Artificial Sequence
  Description of Artificial Sequence: Synthetic oligonucleotide
  Target: ATXN1; (-) strand; PAM type: NRG; PAM sequence: AAG
ggtcataattgggggaaagt

SEQ ID NO: 71878 - DNA, 20 bp, Artificial Sequence
  Description of Artificial Sequence: Synthetic oligonucleotide
  Target: ATXN1; (-) strand; PAM type: NRG; PAM sequence: AAG
aaatggtcataattggggga

SEQ ID NO: 71879 - DNA, 20 bp, Artificial Sequence
  Description of Artificial Sequence: Synthetic oligonucleotide
  Target: ATXN1; (-) strand; PAM type: NRG; PAM sequence: GGG
ctaaaaatggtcataattgg

SEQ ID NO: 71880 - DNA, 20 bp, Artificial Sequence
  Description of Artificial Sequence: Synthetic oligonucleotide
  Target: ATXN1; (-) strand; PAM type: NRG; PAM sequence: GGG
gctaaaaatggtcataattg

SEQ ID NO: 71881 - DNA, 20 bp, Artificial Sequence
  Description of Artificial Sequence: Synthetic oligonucleotide
  Target: ATXN1; (-) strand; PAM type: NRG; PAM sequence: GGG
tgctaaaaatggtcataatt

SEQ ID NO: 71882 - DNA, 20 bp, Artificial Sequence
  Description of Artificial Sequence: Synthetic oligonucleotide
  Target: ATXN1; (-) strand; PAM type: NRG; PAM sequence: TGG
atgctaaaaatggtcataat

SEQ ID NO: 71883 - DNA, 20 bp, Artificial Sequence
  Description of Artificial Sequence: Synthetic oligonucleotide
  Target: ATXN1; (-) strand; PAM type: NRG; PAM sequence: TGG
attgactgtgatgctaaaaa

SEQ ID NO: 71884 - DNA, 20 bp, Artificial Sequence
  Description of Artificial Sequence: Synthetic oligonucleotide
  Target: ATXN1; (-) strand; PAM type: NRG; PAM sequence: TGG
ccggtccatcaggtggacag

SEQ ID NO: 71885 - DNA, 20 bp, Artificial Sequence
  Description of Artificial Sequence: Synthetic oligonucleotide
  Target: ATXN1; (-) strand; PAM type: NRG; PAM sequence: CAG
cctccggtccatcaggtgga

SEQ ID NO: 71886 - DNA, 20 bp, Artificial Sequence
  Description of Artificial Sequence: Synthetic oligonucleotide
  Target: ATXN1; (-) strand; PAM type: NRG; PAM sequence: TGG
ttgccctccggtccatcagg

SEQ ID NO: 71887 - DNA, 20 bp, Artificial Sequence
  Description of Artificial Sequence: Synthetic oligonucleotide
  Target: ATXN1; (-) strand; PAM type: NRG; PAM sequence: AGG
gctttgccctccggtccatc

SEQ ID NO: 71888 - DNA, 20 bp, Artificial Sequence
  Description of Artificial Sequence: Synthetic oligonucleotide
  Target: ATXN1; (-) strand; PAM type: NRG; PAM sequence: CAG
agctttgccctccggtccat

SEQ ID NO: 71889 - DNA, 20 bp, Artificial Sequence
  Description of Artificial Sequence: Synthetic oligonucleotide
  Target: ATXN1; (-) strand; PAM type: NRG; PAM sequence: CGG
tttcagccagctttgccctc

SEQ ID NO: 71890 - DNA, 20 bp, Artificial Sequence
  Description of Artificial Sequence: Synthetic oligonucleotide
  Target: ATXN1; (-) strand; PAM type: NRG; PAM sequence: CAG
gattacctgtgaatttcagc

SEQ ID NO: 71891 - DNA, 20 bp, Artificial Sequence
  Description of Artificial Sequence: Synthetic oligonucleotide
  Target: ATXN1; (-) strand; PAM type: NRG; PAM sequence: CAG
ttgggattacctgtgaattt

SEQ ID NO: 71892 - DNA, 20 bp, Artificial Sequence
  Description of Artificial Sequence: Synthetic oligonucleotide
  Target: ATXN1; (-) strand; PAM type: NRG; PAM sequence: GGG
tgtttgactaaaataaagtt

SEQ ID NO: 71893 - DNA, 20 bp, Artificial Sequence
  Description of Artificial Sequence: Synthetic oligonucleotide
  Target: ATXN1; (-) strand; PAM type: NRG; PAM sequence: TGG
atgtttgactaaaataaagt

SEQ ID NO: 71894 - DNA, 20 bp, Artificial Sequence
  Description of Artificial Sequence: Synthetic oligonucleotide
  Target: ATXN1; (-) strand; PAM type: NRG; PAM sequence: AAG
tgatatgtttgactaaaata

SEQ ID NO: 71895 - DNA, 20 bp, Artificial Sequence
  Description of Artificial Sequence: Synthetic oligonucleotide
  Target: ATXN1; (-) strand; PAM type: NRG; PAM sequence: AGG
tttttcattttgaagaggca

SEQ ID NO: 71896 - DNA, 20 bp, Artificial Sequence
  Description of Artificial Sequence: Synthetic oligonucleotide
  Target: ATXN1; (-) strand; PAM type: NRG; PAM sequence: AAG
ttttttcattttgaagaggc

SEQ ID NO: 71897 - DNA, 20 bp, Artificial Sequence
  Description of Artificial Sequence: Synthetic oligonucleotide
  Target: ATXN1; (-) strand; PAM type: NRG; PAM sequence: AGG
gttgttttttcattttgaag

SEQ ID NO: 71898 - DNA, 20 bp, Artificial Sequence
  Description of Artificial Sequence: Synthetic oligonucleotide
  Target: ATXN1; (-) strand; PAM type: NRG; PAM sequence: GAG
ggttgttttttcattttgaa

SEQ ID NO: 71899 - DNA, 20 bp, Artificial Sequence
  Description of Artificial Sequence: Synthetic oligonucleotide
  Target: ATXN1; (-) strand; PAM type: NRG; PAM sequence: AAG
gaggttgttttttcattttg

SEQ ID NO: 71900 - DNA, 20 bp, Artificial Sequence
  Description of Artificial Sequence: Synthetic oligonucleotide
  Target: ATXN1; (-) strand; PAM type: NRG; PAM sequence: AGG
acaaagaagaaaggaacaag

SEQ ID NO: 71901 - DNA, 20 bp, Artificial Sequence
  Description of Artificial Sequence: Synthetic oligonucleotide
  Target: ATXN1; (-) strand; PAM type: NRG; PAM sequence: GAG
aacaaagaagaaaggaacaa

SEQ ID NO: 71902 - DNA, 20 bp, Artificial Sequence
  Description of Artificial Sequence: Synthetic oligonucleotide
  Target: ATXN1; (-) strand; PAM type: NRG; PAM sequence: AAG
tgaacaaagaagaaaggaac

SEQ ID NO: 71903 - DNA, 20 bp, Artificial Sequence
  Description of Artificial Sequence: Synthetic oligonucleotide
  Target: ATXN1; (-) strand; PAM type: NRG; PAM sequence: AGG
ctcctatgaacaaagaagaa

SEQ ID NO: 71904 - DNA, 20 bp, Artificial Sequence
  Description of Artificial Sequence: Synthetic oligonucleotide
  Target: ATXN1; (-) strand; PAM type: NRG; PAM sequence: AAG
tctcctatgaacaaagaaga

SEQ ID NO: 71905 - DNA, 20 bp, Artificial Sequence
  Description of Artificial Sequence: Synthetic oligonucleotide
  Target: ATXN1; (-) strand; PAM type: NRG; PAM sequence: AAG
ttgttctcctatgaacaaag

SEQ ID NO: 71906 - DNA, 20 bp, Artificial Sequence
  Description of Artificial Sequence: Synthetic oligonucleotide
  Target: ATXN1; (-) strand; PAM type: NRG; PAM sequence: AAG
attttgttctcctatgaaca

SEQ ID NO: 71907 - DNA, 20 bp, Artificial Sequence
  Description of Artificial Sequence: Synthetic oligonucleotide
  Target: ATXN1; (-) strand; PAM type: NRG; PAM sequence: AAG
gtttctctacattgtataca

SEQ ID NO: 71908 - DNA, 20 bp, Artificial Sequence
  Description of Artificial Sequence: Synthetic oligonucleotide
  Target: ATXN1; (-) strand; PAM type: NRG; PAM sequence: TAG
ctttttattttatttttcaa

SEQ ID NO: 71909 - DNA, 20 bp, Artificial Sequence
  Description of Artificial Sequence: Synthetic oligonucleotide
  Target: ATXN1; (-) strand; PAM type: NRG; PAM sequence: TAG
ggtaggaagcctgactttta

SEQ ID NO: 71910 - DNA, 20 bp, Artificial Sequence
  Description of Artificial Sequence: Synthetic oligonucleotide
  Target: ATXN1; (-) strand; PAM type: NRG; PAM sequence: AAG
ccgaaggtcatctgggtagg

SEQ ID NO: 71911 - DNA, 20 bp, Artificial Sequence
  Description of Artificial Sequence: Synthetic oligonucleotide
  Target: ATXN1; (-) strand; PAM type: NRG; PAM sequence: AGG
tttccgaaggtcatctgggt

SEQ ID NO: 71912 - DNA, 20 bp, Artificial Sequence
  Description of Artificial Sequence: Synthetic oligonucleotide
  Target: ATXN1; (-) strand; PAM type: NRG; PAM sequence: TAG
ttttccgaaggtcatctggg

SEQ ID NO: 71913 - DNA, 20 bp, Artificial Sequence
  Description of Artificial Sequence: Synthetic oligonucleotide
  Target: ATXN1; (-) strand; PAM type: NRG; PAM sequence: GGG
aatttttccgaaggtcatct

SEQ ID NO: 71914 - DNA, 20 bp, Artificial Sequence
  Description of Artificial Sequence: Synthetic oligonucleotide
  Target: ATXN1; (-) strand; PAM type: NRG; PAM sequence: TGG
aaatttttccgaaggtcatc

SEQ ID NO: 71915 - DNA, 20 bp, Artificial Sequence
  Description of Artificial Sequence: Synthetic oligonucleotide
  Target: ATXN1; (-) strand; PAM type: NRG; PAM sequence: AGG
attcagagaaatttttccga

SEQ ID NO: 71916 - DNA, 20 bp, Artificial Sequence
  Description of Artificial Sequence: Synthetic oligonucleotide
  Target: ATXN1; (-) strand; PAM type: NRG; PAM sequence: AAG
gattcagagaaatttttccg

SEQ ID NO: 71917 - DNA, 20 bp, Artificial Sequence
  Description of Artificial Sequence: Synthetic oligonucleotide
  Target: ATXN1; (-) strand; PAM type: NRG; PAM sequence: GAG
cccaaggcatcagggattca

SEQ ID NO: 71918 - DNA, 20 bp, Artificial Sequence
  Description of Artificial Sequence: Synthetic oligonucleotide
  Target: ATXN1; (-) strand; PAM type: NRG; PAM sequence: CAG
tacccaaggcatcagggatt

SEQ ID NO: 71919 - DNA, 20 bp, Artificial Sequence
  Description of Artificial Sequence: Synthetic oligonucleotide
  Target: ATXN1; (-) strand; PAM type: NRG; PAM sequence: GGG
actggatacccaaggcatca

SEQ ID NO: 71920 - DNA, 20 bp, Artificial Sequence
  Description of Artificial Sequence: Synthetic oligonucleotide
  Target: ATXN1; (-) strand; PAM type: NRG; PAM sequence: AGG
tactggatacccaaggcatc

SEQ ID NO: 71921 - DNA, 20 bp, Artificial Sequence
  Description of Artificial Sequence: Synthetic oligonucleotide
  Target: ATXN1; (-) strand; PAM type: NRG; PAM sequence: CAG
atactggatacccaaggcat

SEQ ID NO: 71922 - DNA, 20 bp, Artificial Sequence
  Description of Artificial Sequence: Synthetic oligonucleotide
  Target: ATXN1; (-) strand; PAM type: NRG; PAM sequence: AGG
tactgcatactggataccca

SEQ ID NO: 71923 - DNA, 20 bp, Artificial Sequence
  Description of Artificial Sequence: Synthetic oligonucleotide
  Target: ATXN1; (-) strand; PAM type: NRG; PAM sequence: AAG
atactgcatactggataccc

SEQ ID NO: 71924 - DNA, 20 bp, Artificial Sequence
  Description of Artificial Sequence: Synthetic oligonucleotide
  Target: ATXN1; (-) strand; PAM type: NRG; PAM sequence: TGG
gtatcagatatactgcatac

SEQ ID NO: 71925 - DNA, 20 bp, Artificial Sequence
  Description of Artificial Sequence: Synthetic oligonucleotide
  Target: ATXN1; (-) strand; PAM type: NRG; PAM sequence: CAG
gatcctccaatctcttgtat

SEQ ID NO: 71926 - DNA, 20 bp, Artificial Sequence
  Description of Artificial Sequence: Synthetic oligonucleotide
  Target: ATXN1; (-) strand; PAM type: NRG; PAM sequence: TGG
tacagcccagaatgaactca

SEQ ID NO: 71927 - DNA, 20 bp, Artificial Sequence
  Description of Artificial Sequence: Synthetic oligonucleotide
  Target: ATXN1; (-) strand; PAM type: NRG; PAM sequence: CAG
tatggcatcactatacagcc

SEQ ID NO: 71928 - DNA, 20 bp, Artificial Sequence
  Description of Artificial Sequence: Synthetic oligonucleotide
  Target: ATXN1; (-) strand; PAM type: NRG; PAM sequence: CAG
agtgttatggcatcactata

SEQ ID NO: 71929 - DNA, 20 bp, Artificial Sequence
  Description of Artificial Sequence: Synthetic oligonucleotide
  Target: ATXN1; (-) strand; PAM type: NRG; PAM sequence: TGG
gaaaatagcaatgagtgtta

SEQ ID NO: 71930 - DNA, 20 bp, Artificial Sequence
  Description of Artificial Sequence: Synthetic oligonucleotide
  Target: ATXN1; (-) strand; PAM type: NRG; PAM sequence: GAG
caagcttggaaaatagcaat

SEQ ID NO: 71931 - DNA, 20 bp, Artificial Sequence
  Description of Artificial Sequence: Synthetic oligonucleotide
  Target: ATXN1; (-) strand; PAM type: NRG; PAM sequence: TAG
tgattctcaagcttggaaaa

SEQ ID NO: 71932 - DNA, 20 bp, Artificial Sequence
  Description of Artificial Sequence: Synthetic oligonucleotide
  Target: ATXN1; (-) strand; PAM type: NRG; PAM sequence: TGG
tattaaatgattctcaagct

SEQ ID NO: 71933 - DNA, 20 bp, Artificial Sequence
  Description of Artificial Sequence: Synthetic oligonucleotide
  Target: ATXN1; (-) strand; PAM type: NRG; PAM sequence: AAG
ggaaatattaaatgattctc

SEQ ID NO: 71934 - DNA, 20 bp, Artificial Sequence
  Description of Artificial Sequence: Synthetic oligonucleotide
  Target: ATXN1; (-) strand; PAM type: NRG; PAM sequence: GGG
cagttaatcagatagtttta

SEQ ID NO: 71935 - DNA, 20 bp, Artificial Sequence
  Description of Artificial Sequence: Synthetic oligonucleotide
  Target: ATXN1; (-) strand; PAM type: NRG; PAM sequence: AGG
gcagttaatcagatagtttt

SEQ ID NO: 71936 - DNA, 20 bp, Artificial Sequence
  Description of Artificial Sequence: Synthetic oligonucleotide
  Target: ATXN1; (-) strand; PAM type: NRG; PAM sequence: TAG
tgcagttaatcagatagttt

SEQ ID NO: 71937 - DNA, 20 bp, Artificial Sequence
  Description of Artificial Sequence: Synthetic oligonucleotide
  Target: ATXN1; (-) strand; PAM type: NRG; PAM sequence: TAG
ccattttgcagttaatcaga

SEQ ID NO: 71938 - DNA, 20 bp, Artificial Sequence
  Description of Artificial Sequence: Synthetic oligonucleotide
  Target: ATXN1; (-) strand; PAM type: NRG; PAM sequence: CAG
tgcaccattttgcagttaat

SEQ ID NO: 71939 - DNA, 20 bp, Artificial Sequence
  Description of Artificial Sequence: Synthetic oligonucleotide
  Target: ATXN1; (-) strand; PAM type: NRG; PAM sequence: CAG
ttgctcagtgcaccattttg

SEQ ID NO: 71940 - DNA, 20 bp, Artificial Sequence
  Description of Artificial Sequence: Synthetic oligonucleotide
  Target: ATXN1; (-) strand; PAM type: NRG; PAM sequence: CAG
gcaaaaatattatcattgct

SEQ ID NO: 71941 - DNA, 20 bp, Artificial Sequence
  Description of Artificial Sequence: Synthetic oligonucleotide
  Target: ATXN1; (-) strand; PAM type: NRG; PAM sequence: TAG
ggtgggagagggttgttgta

SEQ ID NO: 71942 - DNA, 20 bp, Artificial Sequence
  Description of Artificial Sequence: Synthetic oligonucleotide
  Target: ATXN1; (-) strand; PAM type: NRG; PAM sequence: GGG
gtggagaggtgggtgggaga

SEQ ID NO: 71943 - DNA, 20 bp, Artificial Sequence
  Description of Artificial Sequence: Synthetic oligonucleotide
  Target: ATXN1; (-) strand; PAM type: NRG; PAM sequence: AGG
tgtggagaggtgggtgggag

SEQ ID NO: 71944 - DNA, 20 bp, Artificial Sequence
  Description of Artificial Sequence: Synthetic oligonucleotide
  Target: ATXN1; (-) strand; PAM type: NRG; PAM sequence: GAG
ctgtggagaggtgggtggga

SEQ ID NO: 71945 - DNA, 20 bp, Artificial Sequence
  Description of Artificial Sequence: Synthetic oligonucleotide
  Target: ATXN1; (-) strand; PAM type: NRG; PAM sequence: GAG
atctgtggagaggtgggtgg

SEQ ID NO: 71946 - DNA, 20 bp, Artificial Sequence
  Description of Artificial Sequence: Synthetic oligonucleotide
  Target: ATXN1; (-) strand; PAM type: NRG; PAM sequence: GGG
gtatctgtggagaggtgggt

SEQ ID NO: 71947 - DNA, 20 bp, Artificial Sequence
  Description of Artificial Sequence: Synthetic oligonucleotide
  Target: ATXN1; (-) strand; PAM type: NRG; PAM sequence: TGG
tgtatctgtggagaggtggg

SEQ ID NO: 71948 - DNA, 20 bp, Artificial Sequence
  Description of Artificial Sequence: Synthetic oligonucleotide
  Target: ATXN1; (-) strand; PAM type: NRG; PAM sequence: GGG
aaatgtatctgtggagaggt

SEQ ID NO: 71949 - DNA, 20 bp, Artificial Sequence
  Description of Artificial Sequence: Synthetic oligonucleotide
  Target: ATXN1; (-) strand; PAM type: NRG; PAM sequence: TGG
aaaatgtatctgtggagagg

SEQ ID NO: 71950 - DNA, 20 bp, Artificial Sequence
  Description of Artificial Sequence: Synthetic oligonucleotide
  Target: ATXN1; (-) strand; PAM type: NRG; PAM sequence: AGG
agcaaaatgtatctgtggag

SEQ ID NO: 71951 - DNA, 20 bp, Artificial Sequence
  Description of Artificial Sequence: Synthetic oligonucleotide
  Target: ATXN1; (-) strand; PAM type: NRG; PAM sequence: GAG
tagcaaaatgtatctgtgga

SEQ ID NO: 71952 - DNA, 20 bp, Artificial Sequence
  Description of Artificial Sequence: Synthetic oligonucleotide
  Target: ATXN1; (-) strand; PAM type: NRG; PAM sequence: GAG
cttagcaaaatgtatctgtg

SEQ ID NO: 71953 - DNA, 20 bp, Artificial Sequence
  Description of Artificial Sequence: Synthetic oligonucleotide
  Target: ATXN1; (-) strand; PAM type: NRG; PAM sequence: TGG
aacttagcaaaatgtatctg

SEQ ID NO: 71954 - DNA, 20 bp, Artificial Sequence
  Description of Artificial Sequence: Synthetic oligonucleotide
  Target: ATXN1; (-) strand; PAM type: NRG; PAM sequence: TAG
caatgaagaaaagcaaaact

SEQ ID NO: 71955 - DNA, 20 bp, Artificial Sequence
  Description of Artificial Sequence: Synthetic oligonucleotide
  Target: ATXN1; (-) strand; PAM type: NRG; PAM sequence: AAG
ttttatttaccaatgaagaa

SEQ ID NO: 71956 - DNA, 20 bp, Artificial Sequence
  Description of Artificial Sequence: Synthetic oligonucleotide
  Target: ATXN1; (-) strand; PAM type: NRG; PAM sequence: AAG
cccatttttatttaccaatg

SEQ ID NO: 71957 - DNA, 20 bp, Artificial Sequence
  Description of Artificial Sequence: Synthetic oligonucleotide
  Target: ATXN1; (-) strand; PAM type: NRG; PAM sequence: TGG
atggctctatgggaacttgt

SEQ ID NO: 71958 - DNA, 20 bp, Artificial Sequence
  Description of Artificial Sequence: Synthetic oligonucleotide
  Target: ATXN1; (-) strand; PAM type: NRG; PAM sequence: GGG
agtgaaaagtatggctctat

SEQ ID NO: 71959 - DNA, 20 bp, Artificial Sequence
  Description of Artificial Sequence: Synthetic oligonucleotide
  Target: ATXN1; (-) strand; PAM type: NRG; PAM sequence: TGG
gagtgaaaagtatggctcta

SEQ ID NO: 71960 - DNA, 20 bp, Artificial Sequence
  Description of Artificial Sequence: Synthetic oligonucleotide
  Target: ATXN1; (-) strand; PAM type: NRG; PAM sequence: TGG
aatgaaaggagtgaaaagta

SEQ ID NO: 71961 - DNA, 20 bp, Artificial Sequence
  Description of Artificial Sequence: Synthetic oligonucleotide
  Target: ATXN1; (-) strand; PAM type: NRG; PAM sequence: AAG
tgctaaatgaaaggagtgaa

SEQ ID NO: 71962 - DNA, 20 bp, Artificial Sequence
  Description of Artificial Sequence: Synthetic oligonucleotide
  Target: ATXN1; (-) strand; PAM type: NRG; PAM sequence: GAG
caatgtttgctaaatgaaag

SEQ ID NO: 71963 - DNA, 20 bp, Artificial Sequence
  Description of Artificial Sequence: Synthetic oligonucleotide
  Target: ATXN1; (-) strand; PAM type: NRG; PAM sequence: AGG
gtcaatgtttgctaaatgaa

SEQ ID NO: 71964 - DNA, 20 bp, Artificial Sequence
  Description of Artificial Sequence: Synthetic oligonucleotide
  Target: ATXN1; (-) strand; PAM type: NRG; PAM sequence: AAG
tgtcaatgtttgctaaatga

SEQ ID NO: 71965 - DNA, 20 bp, Artificial Sequence
  Description of Artificial Sequence: Synthetic oligonucleotide
  Target: ATXN1; (-) strand; PAM type: NRG; PAM sequence: CAG
ttaacccctgtccttaaaca

SEQ ID NO: 71966 - DNA, 20 bp, Artificial Sequence
  Description of Artificial Sequence: Synthetic oligonucleotide
  Target: ATXN1; (-) strand; PAM type: NRG; PAM sequence: GAG
tactcatgagacagtatatt

SEQ ID NO: 71967 - DNA, 20 bp, Artificial Sequence
  Description of Artificial Sequence: Synthetic oligonucleotide
  Target: ATXN1; (-) strand; PAM type: NRG; PAM sequence: CAG
taaactatgtactcatgaga

SEQ ID NO: 71968 - DNA, 20 bp, Artificial Sequence
  Description of Artificial Sequence: Synthetic oligonucleotide
  Target: ATXN1; (-) strand; PAM type: NRG; PAM sequence: GAG
cttttaaactatgtactcat

SEQ ID NO: 71969 - DNA, 20 bp, Artificial Sequence
  Description of Artificial Sequence: Synthetic oligonucleotide
  Target: ATXN1; (-) strand; PAM type: NRG; PAM sequence: TGG
ggacctttcttacttttact

SEQ ID NO: 71970 - DNA, 20 bp, Artificial Sequence
  Description of Artificial Sequence: Synthetic oligonucleotide
  Target: ATXN1; (-) strand; PAM type: NRG; PAM sequence: GGG
ttttggtccacatttttaat

SEQ ID NO: 71971 - DNA, 20 bp, Artificial Sequence
  Description of Artificial Sequence: Synthetic oligonucleotide
  Target: ATXN1; (-) strand; PAM type: NRG; PAM sequence: TGG
tttttggtccacatttttaa

SEQ ID NO: 71972 - DNA, 20 bp, Artificial Sequence
  Description of Artificial Sequence: Synthetic oligonucleotide
  Target: ATXN1; (-) strand; PAM type: NRG; PAM sequence: TGG
ccaggaagttatcttttttt

SEQ ID NO: 71973 - DNA, 20 bp, Artificial Sequence
  Description of Artificial Sequence: Synthetic oligonucleotide
  Target: ATXN1; (-) strand; PAM type: NRG; PAM sequence: AAG
taatctcaaatgaccccagg

SEQ ID NO: 71974 - DNA, 20 bp, Artificial Sequence
  Description of Artificial Sequence: Synthetic oligonucleotide
  Target: ATXN1; (-) strand; PAM type: NRG; PAM sequence: AGG
acataatctcaaatgacccc

SEQ ID NO: 71975 - DNA, 20 bp, Artificial Sequence
  Description of Artificial Sequence: Synthetic oligonucleotide
  Target: ATXN1; (-) strand; PAM type: NRG; PAM sequence: CAG
gacataatctcaaatgaccc

SEQ ID NO: 71976 - DNA, 20 bp, Artificial Sequence
  Description of Artificial Sequence: Synthetic oligonucleotide
  Target: ATXN1; (-) strand; PAM type: NRG; PAM sequence: AGG
atttctatatattcttttcc

SEQ ID NO: 71977 - DNA, 20 bp, Artificial Sequence
  Description of Artificial Sequence: Synthetic oligonucleotide
  Target: ATXN1; (-) strand; PAM type: NRG; PAM sequence: CAG
catttctatatattcttttc

SEQ ID NO: 71978 - DNA, 20 bp, Artificial Sequence
  Description of Artificial Sequence: Synthetic oligonucleotide
  Target: ATXN1; (-) strand; PAM type: NRG; PAM sequence: AGG
atctctggtttctttcacct

SEQ ID NO: 71979 - DNA, 20 bp, Artificial Sequence
  Description of Artificial Sequence: Synthetic oligonucleotide
  Target: ATXN1; (-) strand; PAM type: NRG; PAM sequence: TAG
catctctggtttctttcacc

SEQ ID NO: 71980 - DNA, 20 bp, Artificial Sequence
  Description of Artificial Sequence: Synthetic oligonucleotide
  Target: ATXN1; (-) strand; PAM type: NRG; PAM sequence: TGG
ttctgcttctgttgcatctc

SEQ ID NO: 71981 - DNA, 20 bp, Artificial Sequence
  Description of Artificial Sequence: Synthetic oligonucleotide
  Target: ATXN1; (-) strand; PAM type: NRG; PAM sequence: TGG
tctcacacctcaagctccct

SEQ ID NO: 71982 - DNA, 20 bp, Artificial Sequence
  Description of Artificial Sequence: Synthetic oligonucleotide
  Target: ATXN1; (-) strand; PAM type: NRG; PAM sequence: AAG
acatgttcctctcacacctc

SEQ ID NO: 71983 - DNA, 20 bp, Artificial Sequence
  Description of Artificial Sequence: Synthetic oligonucleotide
  Target: ATXN1; (-) strand; PAM type: NRG; PAM sequence: AGG
aaccttactcattgcagccc

SEQ ID NO: 71984 - DNA, 20 bp, Artificial Sequence
  Description of Artificial Sequence: Synthetic oligonucleotide
  Target: ATXN1; (-) strand; PAM type: NRG; PAM sequence: CAG
taaccttactcattgcagcc

SEQ ID NO: 71985 - DNA, 20 bp, Artificial Sequence
  Description of Artificial Sequence: Synthetic oligonucleotide
  Target: ATXN1; (-) strand; PAM type: NRG; PAM sequence: CAG
cttcctaaccttactcattg

SEQ ID NO: 71986 - DNA, 20 bp, Artificial Sequence
  Description of Artificial Sequence: Synthetic oligonucleotide
  Target: ATXN1; (-) strand; PAM type: NRG; PAM sequence: CAG
ggagtgttgtgacttggtta

SEQ ID NO: 71987 - DNA, 20 bp, Artificial Sequence
  Description of Artificial Sequence: Synthetic oligonucleotide
  Target: ATXN1; (-) strand; PAM type: NRG; PAM sequence: TGG
cctgagggagtgttgtgact

SEQ ID NO: 71988 - DNA, 20 bp, Artificial Sequence
  Description of Artificial Sequence: Synthetic oligonucleotide
  Target: ATXN1; (-) strand; PAM type: NRG; PAM sequence: GAG
acatcttccaggtcctgagg

SEQ ID NO: 71989 - DNA, 20 bp, Artificial Sequence
  Description of Artificial Sequence: Synthetic oligonucleotide
  Target: ATXN1; (-) strand; PAM type: NRG; PAM sequence: GGG
ttacatcttccaggtcctga

SEQ ID NO: 71990 - DNA, 20 bp, Artificial Sequence
  Description of Artificial Sequence: Synthetic oligonucleotide
  Target: ATXN1; (-) strand; PAM type: NRG; PAM sequence: AGG
tttacatcttccaggtcctg

SEQ ID NO: 71991 - DNA, 20 bp, Artificial Sequence
  Description of Artificial Sequence: Synthetic oligonucleotide
  Target: ATXN1; (-) strand; PAM type: NRG; PAM sequence: GAG
gtttacatcttccaggtcct

SEQ ID NO: 71992 - DNA, 20 bp, Artificial Sequence
  Description of Artificial Sequence: Synthetic oligonucleotide
  Target: ATXN1; (-) strand; PAM type: NRG; PAM sequence: AGG
cttccttgtttacatcttcc

SEQ ID NO: 71993 - DNA, 20 bp, Artificial Sequence
  Description of Artificial Sequence: Synthetic oligonucleotide
  Target: ATXN1; (-) strand; PAM type: NRG; PAM sequence: CAG
tcttccttgtttacatcttc

SEQ ID NO: 71994 - DNA, 20 bp, Artificial Sequence
  Description of Artificial Sequence: Synthetic oligonucleotide
  Target: ATXN1; (-) strand; PAM type: NRG; PAM sequence: AAG
cttaaaagtagattctgcct

SEQ ID NO: 71995 - DNA, 20 bp, Artificial Sequence
  Description of Artificial Sequence: Synthetic oligonucleotide
  Target: ATXN1; (-) strand; PAM type: NRG; PAM sequence: TAG
ttcgtacttattcttaaaag

SEQ ID NO: 71996 - DNA, 20 bp, Artificial Sequence
  Description of Artificial Sequence: Synthetic oligonucleotide
  Target: ATXN1; (-) strand; PAM type: NRG; PAM sequence: AAG
cttttcgtacttattcttaa

SEQ ID NO: 71997 - DNA, 20 bp, Artificial Sequence
  Description of Artificial Sequence: Synthetic oligonucleotide
  Target: ATXN1; (-) strand; PAM type: NRG; PAM sequence: CAG
acaggtgtgagccactgcat

SEQ ID NO: 71998 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggtgt

SEQ ID NO: 71999 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 72000 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 72001 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 72002 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 72003 - DNA, 20 bp, Artificial Sequence
  Description of Artificial Sequence: Synthetic oligonucleotide
  Target: ATXN1; (-) strand; PAM type: NRG; PAM sequence: AAG
ccgcctgcctcggcctccca

SEQ ID NO: 72004 - DNA, 20 bp, Artificial Sequence
  Description of Artificial Sequence: Synthetic oligonucleotide
  Target: ATXN1; (-) strand; PAM type: NRG; PAM sequence: CGG
ctcaagcaatccgcctgcct

SEQ ID NO: 72005 - DNA, 20 bp, Artificial Sequence
  Description of Artificial Sequence: Synthetic oligonucleotide
  Target: ATXN1; (-) strand; PAM type: NRG; PAM sequence: AAG
tggtctccaactctgagctc

SEQ ID NO: 72006 - DNA, 20 bp, Artificial Sequence
  Description of Artificial Sequence: Synthetic oligonucleotide
  Target: ATXN1; (-) strand; PAM type: NRG; PAM sequence: GAG
ccaggctggtctccaactct

SEQ ID NO: 72007 - DNA, 20 bp, Artificial Sequence
  Description of Artificial Sequence: Synthetic oligonucleotide
  Target: ATXN1; (-) strand; PAM type: NRG; PAM sequence: TGG
ttttgctgtgttgcccaggc

SEQ ID NO: 72008 - DNA, 20 bp, Artificial Sequence
  Description of Artificial Sequence: Synthetic oligonucleotide
  Target: ATXN1; (-) strand; PAM type: NRG; PAM sequence: AGG
agggttttgctgtgttgccc

SEQ ID NO: 72009 - DNA, 20 bp, Artificial Sequence
  Description of Artificial Sequence: Synthetic oligonucleotide
  Target: ATXN1; (-) strand; PAM type: NRG; PAM sequence: CAG
cagggttttgctgtgttgcc

SEQ ID NO: 72010 - DNA, 20 bp, Artificial Sequence
  Description of Artificial Sequence: Synthetic oligonucleotide
  Target: ATXN1; (-) strand; PAM type: NRG; PAM sequence: GGG
ttgtattttttgtagaggca

SEQ ID NO: 72011 - DNA, 20 bp, Artificial Sequence
  Description of Artificial Sequence: Synthetic oligonucleotide
  Target: ATXN1; (-) strand; PAM type: NRG; PAM sequence: AGG
tttgtattttttgtagaggc

SEQ ID NO: 72012 - DNA, 20 bp, Artificial Sequence
  Description of Artificial Sequence: Synthetic oligonucleotide
  Target: ATXN1; (-) strand; PAM type: NRG; PAM sequence: CAG
ttttgtattttttgtagagg

SEQ ID NO: 72013 - DNA, 20 bp, Artificial Sequence
  Description of Artificial Sequence: Synthetic oligonucleotide
  Target: ATXN1; (-) strand; PAM type: NRG; PAM sequence: AGG
aatttttgtattttttgtag

SEQ ID NO: 72014 - DNA, 20 bp, Artificial Sequence
  Description of Artificial Sequence: Synthetic oligonucleotide
  Target: ATXN1; (-) strand; PAM type: NRG; PAM sequence: GAG
taatttttgtattttttgta

SEQ ID NO: 72015 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtattttttg

SEQ ID NO: 72016 - DNA, 20 bp, Artificial Sequence
  Description of Artificial Sequence: Synthetic oligonucleotide
  Target: ATXN1; (-) strand; PAM type: NRG; PAM sequence: TGG
caggtgcaggccaccacacc

SEQ ID NO: 72017 - DNA, 20 bp, Artificial Sequence
  Description of Artificial Sequence: Synthetic oligonucleotide
  Target: ATXN1; (-) strand; PAM type: NRG; PAM sequence: AGG
atagctgggactacaggtgc

SEQ ID NO: 72018 - DNA, 20 bp, Artificial Sequence
  Description of Artificial Sequence: Synthetic oligonucleotide
  Target: ATXN1; (-) strand; PAM type: NRG; PAM sequence: CAG
aatagctgggactacaggtg

SEQ ID NO: 72019 - DNA, 20 bp, Artificial Sequence
  Description of Artificial Sequence: Synthetic oligonucleotide
  Target: ATXN1; (-) strand; PAM type: NRG; PAM sequence: AGG
tcccaaatagctgggactac

SEQ ID NO: 72020 - DNA, 20 bp, Artificial Sequence
  Description of Artificial Sequence: Synthetic oligonucleotide
  Target: ATXN1; (-) strand; PAM type: NRG; PAM sequence: CAG
ctcccaaatagctgggacta

SEQ ID NO: 72021 - DNA, 20 bp, Artificial Sequence
  Description of Artificial Sequence: Synthetic oligonucleotide
  Target: ATXN1; (-) strand; PAM type: NRG; PAM sequence: GGG
tctcagcctcccaaatagct

SEQ ID NO: 72022 - DNA, 20 bp, Artificial Sequence
  Description of Artificial Sequence: Synthetic oligonucleotide
  Target: ATXN1; (-) strand; PAM type: NRG; PAM sequence: TGG
atctcagcctcccaaatagc

SEQ ID NO: 72023 - DNA, 20 bp, Artificial Sequence
  Description of Artificial Sequence: Synthetic oligonucleotide
  Target: ATXN1; (-) strand; PAM type: NRG; PAM sequence: TAG
tcccatctcagcctcccaaa

SEQ ID NO: 72024 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatcttcccatct

SEQ ID NO: 72025 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccgggctc

SEQ ID NO: 72026 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctgcctccc

SEQ ID NO: 72027 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctctgcctcc

SEQ ID NO: 72028 - DNA, 20 bp, Artificial Sequence
  Description of Artificial Sequence: Synthetic oligonucleotide
  Target: ATXN1; (-) strand; PAM type: NRG; PAM sequence: TGG
ggagtacagtggggtgatct

SEQ ID NO: 72029 - DNA, 20 bp, Artificial Sequence
  Description of Artificial Sequence: Synthetic oligonucleotide
  Target: ATXN1; (-) strand; PAM type: NRG; PAM sequence: GGG
gcccaggctggagtacagtg

SEQ ID NO: 72030 - DNA, 20 bp, Artificial Sequence
  Description of Artificial Sequence: Synthetic oligonucleotide
  Target: ATXN1; (-) strand; PAM type: NRG; PAM sequence: GGG
tgcccaggctggagtacagt

SEQ ID NO: 72031 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtacag

SEQ ID NO: 72032 - DNA, 20 bp, Artificial Sequence
  Description of Artificial Sequence: Synthetic oligonucleotide
  Target: ATXN1; (-) strand; PAM type: NRG; PAM sequence: CAG
ctgttgcccaggctggagta

SEQ ID NO: 72033 - DNA, 20 bp, Artificial Sequence
  Description of Artificial Sequence: Synthetic oligonucleotide
  Target: ATXN1; (-) strand; PAM type: NRG; PAM sequence: GAG
tagctctgttgcccaggctg

SEQ ID NO: 72034 - DNA, 20 bp, Artificial Sequence
  Description of Artificial Sequence: Synthetic oligonucleotide
  Target: ATXN1; (-) strand; PAM type: NRG; PAM sequence: TGG
tctagctctgttgcccaggc

SEQ ID NO: 72035 - DNA, 20 bp, Artificial Sequence
  Description of Artificial Sequence: Synthetic oligonucleotide
  Target: ATXN1; (-) strand; PAM type: NRG; PAM sequence: AGG
aagatctagctctgttgccc

SEQ ID NO: 72036 - DNA, 20 bp, Artificial Sequence
  Description of Artificial Sequence: Synthetic oligonucleotide
  Target: ATXN1; (-) strand; PAM type: NRG; PAM sequence: CAG
caagatctagctctgttgcc

SEQ ID NO: 72037 - DNA, 20 bp, Artificial Sequence
  Description of Artificial Sequence: Synthetic oligonucleotide
  Target: ATXN1; (-) strand; PAM type: NRG; PAM sequence: TAG
tttttttttgagacaagatc

SEQ ID NO: 72038 - DNA, 20 bp, Artificial Sequence
  Description of Artificial Sequence: Synthetic oligonucleotide
  Target: ATXN1; (-) strand; PAM type: NRG; PAM sequence: AAG
tttttttttttttttgagac

SEQ ID NO: 72039 - DNA, 20 bp, Artificial Sequence
  Description of Artificial Sequence: Synthetic oligonucleotide
  Target: ATXN1; (-) strand; PAM type: NRG; PAM sequence: GAG
tcttcttttttttttttttt

SEQ ID NO: 72040 - DNA, 20 bp, Artificial Sequence
  Description of Artificial Sequence: Synthetic oligonucleotide
  Target: ATXN1; (-) strand; PAM type: NRG; PAM sequence: CAG
tttcctacggtggctgctgc

SEQ ID NO: 72041 - DNA, 20 bp, Artificial Sequence
  Description of Artificial Sequence: Synthetic oligonucleotide
  Target: ATXN1; (-) strand; PAM type: NRG; PAM sequence: TGG
ctgggctgtatttcctacgg

SEQ ID NO: 72042 - DNA, 20 bp, Artificial Sequence
  Description of Artificial Sequence: Synthetic oligonucleotide
  Target: ATXN1; (-) strand; PAM type: NRG; PAM sequence: CGG
cctctgggctgtatttccta

SEQ ID NO: 72043 - DNA, 20 bp, Artificial Sequence
  Description of Artificial Sequence: Synthetic oligonucleotide
  Target: ATXN1; (-) strand; PAM type: NRG; PAM sequence: GGG
gtggttactcctagacctct

SEQ ID NO: 72044 - DNA, 20 bp, Artificial Sequence
  Description of Artificial Sequence: Synthetic oligonucleotide
  Target: ATXN1; (-) strand; PAM type: NRG; PAM sequence: TGG
agtggttactcctagacctc

SEQ ID NO: 72045 - DNA, 20 bp, Artificial Sequence
  Description of Artificial Sequence: Synthetic oligonucleotide
  Target: ATXN1; (-) strand; PAM type: NRG; PAM sequence: TAG
ttttattcagtggttactcc

SEQ ID NO: 72046 - DNA, 20 bp, Artificial Sequence
  Description of Artificial Sequence: Synthetic oligonucleotide
  Target: ATXN1; (-) strand; PAM type: NRG; PAM sequence: TGG
actagtaagcttttattcag

SEQ ID NO: 72047 - DNA, 20 bp, Artificial Sequence
  Description of Artificial Sequence: Synthetic oligonucleotide
  Target: ATXN1; (-) strand; PAM type: NRG; PAM sequence: CAG
caaactagtaagcttttatt

SEQ ID NO: 72048 - DNA, 20 bp, Artificial Sequence
  Description of Artificial Sequence: Synthetic oligonucleotide
  Target: ATXN1; (-) strand; PAM type: NRG; PAM sequence: AAG
taagatggactcaaactagt

SEQ ID NO: 72049 - DNA, 20 bp, Artificial Sequence
  Description of Artificial Sequence: Synthetic oligonucleotide
  Target: ATXN1; (-) strand; PAM type: NRG; PAM sequence: TAG
ggcctaagatggactcaaac

SEQ ID NO: 72050 - DNA, 20 bp, Artificial Sequence
  Description of Artificial Sequence: Synthetic oligonucleotide
  Target: ATXN1; (-) strand; PAM type: NRG; PAM sequence: TGG
atgtcttcactggcctaaga

SEQ ID NO: 72051 - DNA, 20 bp, Artificial Sequence
  Description of Artificial Sequence: Synthetic oligonucleotide
  Target: ATXN1; (-) strand; PAM type: NRG; PAM sequence: AAG
cccaatgtcttcactggcct

SEQ ID NO: 72052 - DNA, 20 bp, Artificial Sequence
  Description of Artificial Sequence: Synthetic oligonucleotide
  Target: ATXN1; (-) strand; PAM type: NRG; PAM sequence: TGG
tctcggcccaatgtcttcac

SEQ ID NO: 72053 - DNA, 20 bp, Artificial Sequence
  Description of Artificial Sequence: Synthetic oligonucleotide
  Target: ATXN1; (-) strand; PAM type: NRG; PAM sequence: CGG
tccaagcactggaaacttct

SEQ ID NO: 72054 - DNA, 20 bp, Artificial Sequence
  Description of Artificial Sequence: Synthetic oligonucleotide
  Target: ATXN1; (-) strand; PAM type: NRG; PAM sequence: TGG
cttctctgtcatccaagcac

SEQ ID NO: 72055 - DNA, 20 bp, Artificial Sequence
  Description of Artificial Sequence: Synthetic oligonucleotide
  Target: ATXN1; (-) strand; PAM type: NRG; PAM sequence: AAG
ccagttcttctctgtcatcc

SEQ ID NO: 72056 - DNA, 20 bp, Artificial Sequence
  Description of Artificial Sequence: Synthetic oligonucleotide
  Target: ATXN1; (-) strand; PAM type: NRG; PAM sequence: CAG
cccactgaagtcttagtcac

SEQ ID NO: 72057 - DNA, 20 bp, Artificial Sequence
  Description of Artificial Sequence: Synthetic oligonucleotide
  Target: ATXN1; (-) strand; PAM type: NRG; PAM sequence: TAG
attaccacccactgaagtct

SEQ ID NO: 72058 - DNA, 20 bp, Artificial Sequence
  Description of Artificial Sequence: Synthetic oligonucleotide
  Target: ATXN1; (-) strand; PAM type: NRG; PAM sequence: AAG
cagattattaccacccactg

SEQ ID NO: 72059 - DNA, 20 bp, Artificial Sequence
  Description of Artificial Sequence: Synthetic oligonucleotide
  Target: ATXN1; (-) strand; PAM type: NRG; PAM sequence: CAG
tagtctgtgttctattcatc

SEQ ID NO: 72060 - DNA, 20 bp, Artificial Sequence
  Description of Artificial Sequence: Synthetic oligonucleotide
  Target: ATXN1; (-) strand; PAM type: NRG; PAM sequence: TAG
ctcaacatgttttgaaaaca

SEQ ID NO: 72061 - DNA, 20 bp, Artificial Sequence
  Description of Artificial Sequence: Synthetic oligonucleotide
  Target: ATXN1; (-) strand; PAM type: NRG; PAM sequence: AGG
attttgaccttgttctcctc

SEQ ID NO: 72062 - DNA, 20 bp, Artificial Sequence
  Description of Artificial Sequence: Synthetic oligonucleotide
  Target: ATXN1; (-) strand; PAM type: NRG; PAM sequence: CAG
tattttgaccttgttctcct

SEQ ID NO: 72063 - DNA, 20 bp, Artificial Sequence
  Description of Artificial Sequence: Synthetic oligonucleotide
  Target: ATXN1; (-) strand; PAM type: NRG; PAM sequence: GAG
ctgtcttttaaaaactaaag

SEQ ID NO: 72064 - DNA, 20 bp, Artificial Sequence
  Description of Artificial Sequence: Synthetic oligonucleotide
  Target: ATXN1; (-) strand; PAM type: NRG; PAM sequence: AGG
gcctgtcttttaaaaactaa

SEQ ID NO: 72065 - DNA, 20 bp, Artificial Sequence
  Description of Artificial Sequence: Synthetic oligonucleotide
  Target: ATXN1; (-) strand; PAM type: NRG; PAM sequence: AAG
ggcctgtcttttaaaaacta

SEQ ID NO: 72066 - DNA, 20 bp, Artificial Sequence
  Description of Artificial Sequence: Synthetic oligonucleotide
  Target: ATXN1; (-) strand; PAM type: NRG; PAM sequence: TGG
tatgaatgtgcctagtggtg

SEQ ID NO: 72067 - DNA, 20 bp, Artificial Sequence
  Description of Artificial Sequence: Synthetic oligonucleotide
  Target: ATXN1; (-) strand; PAM type: NRG; PAM sequence: TGG
cagtctatgaatgtgcctag

SEQ ID NO: 72068 - DNA, 20 bp, Artificial Sequence
  Description of Artificial Sequence: Synthetic oligonucleotide
  Target: ATXN1; (-) strand; PAM type: NRG; PAM sequence: TAG
cttcagtctatgaatgtgcc

SEQ ID NO: 72069 - DNA, 20 bp, Artificial Sequence
  Description of Artificial Sequence: Synthetic oligonucleotide
  Target: ATXN1; (-) strand; PAM type: NRG; PAM sequence: CAG
cttaaccaaaaccttctctt

SEQ ID NO: 72070 - DNA, 20 bp, Artificial Sequence
  Description of Artificial Sequence: Synthetic oligonucleotide
  Target: ATXN1; (-) strand; PAM type: NRG; PAM sequence: AGG
tctctgaggctttgtcacct

SEQ ID NO: 72071 - DNA, 20 bp, Artificial Sequence
  Description of Artificial Sequence: Synthetic oligonucleotide
  Target: ATXN1; (-) strand; PAM type: NRG; PAM sequence: TAG
ttctctgaggctttgtcacc

SEQ ID NO: 72072 - DNA, 20 bp, Artificial Sequence
  Description of Artificial Sequence: Synthetic oligonucleotide
  Target: ATXN1; (-) strand; PAM type: NRG; PAM sequence: AGG
tctctaccctgacttctctg

SEQ ID NO: 72073 - DNA, 20 bp, Artificial Sequence
  Description of Artificial Sequence: Synthetic oligonucleotide
  Target: ATXN1; (-) strand; PAM type: NRG; PAM sequence: GAG
ctctctaccctgacttctct

SEQ ID NO: 72074 - DNA, 20 bp, Artificial Sequence
  Description of Artificial Sequence: Synthetic oligonucleotide
  Target: ATXN1; (-) strand; PAM type: NRG; PAM sequence: TGG
ctccaagacccctcgttttc

SEQ ID NO: 72075 - DNA, 20 bp, Artificial Sequence
  Description of Artificial Sequence: Synthetic oligonucleotide
  Target: ATXN1; (-) strand; PAM type: NRG; PAM sequence: AAG
ctcccactccgcaaggctcc

SEQ ID NO: 72076 - DNA, 20 bp, Artificial Sequence
  Description of Artificial Sequence: Synthetic oligonucleotide
  Target: ATXN1; (-) strand; PAM type: NRG; PAM sequence: AGG
agaagacctcccactccgca

SEQ ID NO: 72077 - DNA, 20 bp, Artificial Sequence
  Description of Artificial Sequence: Synthetic oligonucleotide
  Target: ATXN1; (-) strand; PAM type: NRG; PAM sequence: AAG
aagaagacctcccactccgc

SEQ ID NO: 72078 - DNA, 20 bp, Artificial Sequence
  Description of Artificial Sequence: Synthetic oligonucleotide
  Target: ATXN1; (-) strand; PAM type: NRG; PAM sequence: AAG
acgcatcccagaggagcaag

SEQ ID NO: 72079 - DNA, 20 bp, Artificial Sequence
  Description of Artificial Sequence: Synthetic oligonucleotide
  Target: ATXN1; (-) strand; PAM type: NRG; PAM sequence: AAG
ctcacgcatcccagaggagc

SEQ ID NO: 72080 - DNA, 20 bp, Artificial Sequence
  Description of Artificial Sequence: Synthetic oligonucleotide
  Target: ATXN1; (-) strand; PAM type: NRG; PAM sequence: GAG
tgtgctcacgcatcccagag

SEQ ID NO: 72081 - DNA, 20 bp, Artificial Sequence
  Description of Artificial Sequence: Synthetic oligonucleotide
  Target: ATXN1; (-) strand; PAM type: NRG; PAM sequence: AGG
gctgtgctcacgcatcccag

SEQ ID NO: 72082 - DNA, 20 bp, Artificial Sequence
  Description of Artificial Sequence: Synthetic oligonucleotide
  Target: ATXN1; (-) strand; PAM type: NRG; PAM sequence: GAG
tgctgtgctcacgcatccca

SEQ ID NO: 72083 - DNA, 20 bp, Artificial Sequence
  Description of Artificial Sequence: Synthetic oligonucleotide
  Target: ATXN1; (-) strand; PAM type: NRG; PAM sequence: CAG
catgctgtgctcacgcatcc

SEQ ID NO: 72084 - DNA, 20 bp, Artificial Sequence
  Description of Artificial Sequence: Synthetic oligonucleotide
  Target: ATXN1; (-) strand; PAM type: NRG; PAM sequence: AAG
cctgtctcacagttgcagac

SEQ ID NO: 72085 - DNA, 20 bp, Artificial Sequence
  Description of Artificial Sequence: Synthetic oligonucleotide
  Target: ATXN1; (-) strand; PAM type: NRG; PAM sequence: CAG
ttgctcctgtctcacagttg

SEQ ID NO: 72086 - DNA, 20 bp, Artificial Sequence
  Description of Artificial Sequence: Synthetic oligonucleotide
  Target: ATXN1; (-) strand; PAM type: NRG; PAM sequence: CAG
tgtccgttgctcctgtctca

SEQ ID NO: 72087 - DNA, 20 bp, Artificial Sequence
  Description of Artificial Sequence: Synthetic oligonucleotide
  Target: ATXN1; (-) strand; PAM type: NRG; PAM sequence: AGG
tttaaaatcttgaagaatcc

SEQ ID NO: 72088 - DNA, 20 bp, Artificial Sequence
  Description of Artificial Sequence: Synthetic oligonucleotide
  Target: ATXN1; (-) strand; PAM type: NRG; PAM sequence: CAG
ttttaaaatcttgaagaatc

SEQ ID NO: 72089 - DNA, 20 bp, Artificial Sequence
  Description of Artificial Sequence: Synthetic oligonucleotide
  Target: ATXN1; (-) strand; PAM type: NRG; PAM sequence: AAG
cttgcttttttaaaatcttg

SEQ ID NO: 72090 - DNA, 20 bp, Artificial Sequence
  Description of Artificial Sequence: Synthetic oligonucleotide
  Target: ATXN1; (-) strand; PAM type: NRG; PAM sequence: AGG
cctcaccctcactttggtag

SEQ ID NO: 72091 - DNA, 20 bp, Artificial Sequence
  Description of Artificial Sequence: Synthetic oligonucleotide
  Target: ATXN1; (-) strand; PAM type: NRG; PAM sequence: GAG
ccctcaccctcactttggta

SEQ ID NO: 72092 - DNA, 20 bp, Artificial Sequence
  Description of Artificial Sequence: Synthetic oligonucleotide
  Target: ATXN1; (-) strand; PAM type: NRG; PAM sequence: TAG
taccctcaccctcactttgg

SEQ ID NO: 72093 - DNA, 20 bp, Artificial Sequence
  Description of Artificial Sequence: Synthetic oligonucleotide
  Target: ATXN1; (-) strand; PAM type: NRG; PAM sequence: TGG
acttaccctcaccctcactt

SEQ ID NO: 72094 - DNA, 20 bp, Artificial Sequence
  Description of Artificial Sequence: Synthetic oligonucleotide
  Target: ATXN1; (-) strand; PAM type: NRG; PAM sequence: CAG
ggatctattccaaacttttc

SEQ ID NO: 72095 - DNA, 20 bp, Artificial Sequence
  Description of Artificial Sequence: Synthetic oligonucleotide
  Target: ATXN1; (-) strand; PAM type: NRG; PAM sequence: GGG
ctcatagtcacatttcttat

SEQ ID NO: 72096 - DNA, 20 bp, Artificial Sequence
  Description of Artificial Sequence: Synthetic oligonucleotide
  Target: ATXN1; (-) strand; PAM type: NRG; PAM sequence: TGG
gctcatagtcacatttctta

SEQ ID NO: 72097 - DNA, 20 bp, Artificial Sequence
  Description of Artificial Sequence: Synthetic oligonucleotide
  Target: ATXN1; (-) strand; PAM type: NRG; PAM sequence: TAG
ttgcttttctagtgggctca

SEQ ID NO: 72098 - DNA, 20 bp, Artificial Sequence
  Description of Artificial Sequence: Synthetic oligonucleotide
  Target: ATXN1; (-) strand; PAM type: NRG; PAM sequence: GGG
gtcatcattgcttttctagt

SEQ ID NO: 72099 - DNA, 20 bp, Artificial Sequence
  Description of Artificial Sequence: Synthetic oligonucleotide
  Target: ATXN1; (-) strand; PAM type: NRG; PAM sequence: TGG
agtcatcattgcttttctag

SEQ ID NO: 72100 - DNA, 20 bp, Artificial Sequence
  Description of Artificial Sequence: Synthetic oligonucleotide
  Target: ATXN1; (-) strand; PAM type: NRG; PAM sequence: TAG
gagagtcatcattgcttttc

SEQ ID NO: 72101 - DNA, 20 bp, Artificial Sequence
  Description of Artificial Sequence: Synthetic oligonucleotide
  Target: ATXN1; (-) strand; PAM type: NRG; PAM sequence: GAG
tcttactgttaatctgagga

SEQ ID NO: 72102 - DNA, 20 bp, Artificial Sequence
  Description of Artificial Sequence: Synthetic oligonucleotide
  Target: ATXN1; (-) strand; PAM type: NRG; PAM sequence: GAG
attcttactgttaatctgag

SEQ ID NO: 72103 - DNA, 20 bp, Artificial Sequence
  Description of Artificial Sequence: Synthetic oligonucleotide
  Target: ATXN1; (-) strand; PAM type: NRG; PAM sequence: AGG
aaattcttactgttaatctg

SEQ ID NO: 72104 - DNA, 20 bp, Artificial Sequence
  Description of Artificial Sequence: Synthetic oligonucleotide
  Target: ATXN1; (-) strand; PAM type: NRG; PAM sequence: GAG
taaattcttactgttaatct

SEQ ID NO: 72105 - DNA, 20 bp, Artificial Sequence
  Description of Artificial Sequence: Synthetic oligonucleotide
  Target: ATXN1; (-) strand; PAM type: NRG; PAM sequence: GGG
ggcccccaaacccaactgat

SEQ ID NO: 72106 - DNA, 20 bp, Artificial Sequence
  Description of Artificial Sequence: Synthetic oligonucleotide
  Target: ATXN1; (-) strand; PAM type: NRG; PAM sequence: TGG
aggcccccaaacccaactga

SEQ ID NO: 72107 - DNA, 20 bp, Artificial Sequence
  Description of Artificial Sequence: Synthetic oligonucleotide
  Target: ATXN1; (-) strand; PAM type: NRG; PAM sequence: AGG
tcacctgcacagctgcttag

SEQ ID NO: 72108 - DNA, 20 bp, Artificial Sequence
  Description of Artificial Sequence: Synthetic oligonucleotide
  Target: ATXN1; (-) strand; PAM type: NRG; PAM sequence: GAG
atcacctgcacagctgctta

SEQ ID NO: 72109 - DNA, 20 bp, Artificial Sequence
  Description of Artificial Sequence: Synthetic oligonucleotide
  Target: ATXN1; (-) strand; PAM type: NRG; PAM sequence: TAG
ccatcacctgcacagctgct

SEQ ID NO: 72110 - DNA, 20 bp, Artificial Sequence
  Description of Artificial Sequence: Synthetic oligonucleotide
  Target: ATXN1; (-) strand; PAM type: NRG; PAM sequence: CAG
catgatccccatcacctgca

SEQ ID NO: 72111 - DNA, 20 bp, Artificial Sequence
  Description of Artificial Sequence: Synthetic oligonucleotide
  Target: ATXN1; (-) strand; PAM type: NRG; PAM sequence: AGG
agtgccatgcattcctttcc

SEQ ID NO: 72112 - DNA, 20 bp, Artificial Sequence
  Description of Artificial Sequence: Synthetic oligonucleotide
  Target: ATXN1; (-) strand; PAM type: NRG; PAM sequence: CAG
tagtgccatgcattcctttc

SEQ ID NO: 72113 - DNA, 20 bp, Artificial Sequence
  Description of Artificial Sequence: Synthetic oligonucleotide
  Target: ATXN1; (-) strand; PAM type: NRG; PAM sequence: TAG
actgtgcatgcccaatagct

SEQ ID NO: 72114 - DNA, 20 bp, Artificial Sequence
  Description of Artificial Sequence: Synthetic oligonucleotide
  Target: ATXN1; (-) strand; PAM type: NRG; PAM sequence: TAG
gtttaactgtgcatgcccaa

SEQ ID NO: 72115 - DNA, 20 bp, Artificial Sequence
  Description of Artificial Sequence: Synthetic oligonucleotide
  Target: ATXN1; (-) strand; PAM type: NRG; PAM sequence: AAG
gcctagacctcatggcttga

SEQ ID NO: 72116 - DNA, 20 bp, Artificial Sequence
  Description of Artificial Sequence: Synthetic oligonucleotide
  Target: ATXN1; (-) strand; PAM type: NRG; PAM sequence: TGG
cctaaccagcctagacctca

SEQ ID NO: 72117 - DNA, 20 bp, Artificial Sequence
  Description of Artificial Sequence: Synthetic oligonucleotide
  Target: ATXN1; (-) strand; PAM type: NRG; PAM sequence: TAG
ttcctgccccctaaccagcc

SEQ ID NO: 72118 - DNA, 20 bp, Artificial Sequence
  Description of Artificial Sequence: Synthetic oligonucleotide
  Target: ATXN1; (-) strand; PAM type: NRG; PAM sequence: CAG
ccgtattcctgccccctaac

SEQ ID NO: 72119 - DNA, 20 bp, Artificial Sequence
  Description of Artificial Sequence: Synthetic oligonucleotide
  Target: ATXN1; (-) strand; PAM type: NRG; PAM sequence: AGG
tcactatagccactttcttc

SEQ ID NO: 72120 - DNA, 20 bp, Artificial Sequence
  Description of Artificial Sequence: Synthetic oligonucleotide
  Target: ATXN1; (-) strand; PAM type: NRG; PAM sequence: CAG
gtcactatagccactttctt

SEQ ID NO: 72121 - DNA, 20 bp, Artificial Sequence
  Description of Artificial Sequence: Synthetic oligonucleotide
  Target: ATXN1; (-) strand; PAM type: NRG; PAM sequence: TAG
tcccccactcttggtcacta

SEQ ID NO: 72122 - DNA, 20 bp, Artificial Sequence
  Description of Artificial Sequence: Synthetic oligonucleotide
  Target: ATXN1; (-) strand; PAM type: NRG; PAM sequence: TGG
cctgactcatcccccactct

SEQ ID NO: 72123 - DNA, 20 bp, Artificial Sequence
  Description of Artificial Sequence: Synthetic oligonucleotide
  Target: ATXN1; (-) strand; PAM type: NRG; PAM sequence: GAG
ctcagttgtctccttattgt

SEQ ID NO: 72124 - DNA, 20 bp, Artificial Sequence
  Description of Artificial Sequence: Synthetic oligonucleotide
  Target: ATXN1; (-) strand; PAM type: NRG; PAM sequence: CAG
tccctctcttcctcagaact

SEQ ID NO: 72125 - DNA, 20 bp, Artificial Sequence
  Description of Artificial Sequence: Synthetic oligonucleotide
  Target: ATXN1; (-) strand; PAM type: NRG; PAM sequence: CAG
cttgctttccctctcttcct

SEQ ID NO: 72126 - DNA, 20 bp, Artificial Sequence
  Description of Artificial Sequence: Synthetic oligonucleotide
  Target: ATXN1; (-) strand; PAM type: NRG; PAM sequence: TAG
tctgtagttctctctgggca

SEQ ID NO: 72127 - DNA, 20 bp, Artificial Sequence
  Description of Artificial Sequence: Synthetic oligonucleotide
  Target: ATXN1; (-) strand; PAM type: NRG; PAM sequence: GGG
cagactctgtagttctctct

SEQ ID NO: 72128 - DNA, 20 bp, Artificial Sequence
  Description of Artificial Sequence: Synthetic oligonucleotide
  Target: ATXN1; (-) strand; PAM type: NRG; PAM sequence: TGG
tcagactctgtagttctctc

SEQ ID NO: 72129 - DNA, 20 bp, Artificial Sequence
  Description of Artificial Sequence: Synthetic oligonucleotide
  Target: ATXN1; (-) strand; PAM type: NRG; PAM sequence: TAG
tcttaaaatctcagactctg

SEQ ID NO: 72130 - DNA, 20 bp, Artificial Sequence
  Description of Artificial Sequence: Synthetic oligonucleotide
  Target: ATXN1; (-) strand; PAM type: NRG; PAM sequence: CAG
ctttctaaatcttaaaatct

SEQ ID NO: 72131 - DNA, 20 bp, Artificial Sequence
  Description of Artificial Sequence: Synthetic oligonucleotide
  Target: ATXN1; (-) strand; PAM type: NRG; PAM sequence: TGG
aaccctcacaccccccaact

SEQ ID NO: 72132 - DNA, 20 bp, Artificial Sequence
  Description of Artificial Sequence: Synthetic oligonucleotide
  Target: ATXN1; (-) strand; PAM type: NRG; PAM sequence: CGG
ccagagatactgccacaccc

SEQ ID NO: 72133 - DNA, 20 bp, Artificial Sequence
  Description of Artificial Sequence: Synthetic oligonucleotide
  Target: ATXN1; (-) strand; PAM type: NRG; PAM sequence: GAG
tccttcatttcagcttccca

SEQ ID NO: 72134 - DNA, 20 bp, Artificial Sequence
  Description of Artificial Sequence: Synthetic oligonucleotide
  Target: ATXN1; (-) strand; PAM type: NRG; PAM sequence: CAG
tttccttcatttcagcttcc

SEQ ID NO: 72135 - DNA, 20 bp, Artificial Sequence
  Description of Artificial Sequence: Synthetic oligonucleotide
  Target: ATXN1; (-) strand; PAM type: NRG; PAM sequence: CAG
acttcacctttccttcattt

SEQ ID NO: 72136 - DNA, 20 bp, Artificial Sequence
  Description of Artificial Sequence: Synthetic oligonucleotide
  Target: ATXN1; (-) strand; PAM type: NRG; PAM sequence: AAG
ttgcttcatctcctcacctt

SEQ ID NO: 72137 - DNA, 20 bp, Artificial Sequence
  Description of Artificial Sequence: Synthetic oligonucleotide
  Target: ATXN1; (-) strand; PAM type: NRG; PAM sequence: CAG
tgacccttctctctgccctg

SEQ ID NO: 72138 - DNA, 20 bp, Artificial Sequence
  Description of Artificial Sequence: Synthetic oligonucleotide
  Target: ATXN1; (-) strand; PAM type: NRG; PAM sequence: AAG
cggcgtcatggaccggtgtt

SEQ ID NO: 72139 - DNA, 20 bp, Artificial Sequence
  Description of Artificial Sequence: Synthetic oligonucleotide
  Target: ATXN1; (-) strand; PAM type: NRG; PAM sequence: CGG
agtgcagcggcgtcatggac

SEQ ID NO: 72140 - DNA, 20 bp, Artificial Sequence
  Description of Artificial Sequence: Synthetic oligonucleotide
  Target: ATXN1; (-) strand; PAM type: NRG; PAM sequence: TGG
gtctgagtgcagcggcgtca

SEQ ID NO: 72141 - DNA, 20 bp, Artificial Sequence
  Description of Artificial Sequence: Synthetic oligonucleotide
  Target: ATXN1; (-) strand; PAM type: NRG; PAM sequence: CGG
tcctctgtgtctgagtgcag

SEQ ID NO: 72142 - DNA, 20 bp, Artificial Sequence
  Description of Artificial Sequence: Synthetic oligonucleotide
  Target: ATXN1; (-) strand; PAM type: NRG; PAM sequence: CAG
acttcctctgtgtctgagtg

SEQ ID NO: 72143 - DNA, 20 bp, Artificial Sequence
  Description of Artificial Sequence: Synthetic oligonucleotide
  Target: ATXN1; (-) strand; PAM type: NRG; PAM sequence: GAG
gaaatacttcctctgtgtct

SEQ ID NO: 72144 - DNA, 20 bp, Artificial Sequence
  Description of Artificial Sequence: Synthetic oligonucleotide
  Target: ATXN1; (-) strand; PAM type: NRG; PAM sequence: AAG
ttgtgttccccgttgacaaa

SEQ ID NO: 72145 - DNA, 20 bp, Artificial Sequence
  Description of Artificial Sequence: Synthetic oligonucleotide
  Target: ATXN1; (-) strand; PAM type: NRG; PAM sequence: GGG
taagcccttggacctggagc

SEQ ID NO: 72146 - DNA, 20 bp, Artificial Sequence
  Description of Artificial Sequence: Synthetic oligonucleotide
  Target: ATXN1; (-) strand; PAM type: NRG; PAM sequence: CGG
ctaagcccttggacctggag

SEQ ID NO: 72147 - DNA, 20 bp, Artificial Sequence
  Description of Artificial Sequence: Synthetic oligonucleotide
  Target: ATXN1; (-) strand; PAM type: NRG; PAM sequence: GAG
gtcctaagcccttggacctg

SEQ ID NO: 72148 - DNA, 20 bp, Artificial Sequence
  Description of Artificial Sequence: Synthetic oligonucleotide
  Target: ATXN1; (-) strand; PAM type: NRG; PAM sequence: TGG
ccgtcctaagcccttggacc

SEQ ID NO: 72149 - DNA, 20 bp, Artificial Sequence
  Description of Artificial Sequence: Synthetic oligonucleotide
  Target: ATXN1; (-) strand; PAM type: NRG; PAM sequence: TGG
gatgctccgtcctaagccct

SEQ ID NO: 72150 - DNA, 20 bp, Artificial Sequence
  Description of Artificial Sequence: Synthetic oligonucleotide
  Target: ATXN1; (-) strand; PAM type: NRG; PAM sequence: AAG
taaatcagatgctccgtcct

SEQ ID NO: 72151 - DNA, 20 bp, Artificial Sequence
  Description of Artificial Sequence: Synthetic oligonucleotide
  Target: ATXN1; (-) strand; PAM type: NRG; PAM sequence: CAG
aaaaagtaaggaatataaat

SEQ ID NO: 72152 - DNA, 20 bp, Artificial Sequence
  Description of Artificial Sequence: Synthetic oligonucleotide
  Target: ATXN1; (-) strand; PAM type: NRG; PAM sequence: AGG
caattgtatcctaaaaagta

SEQ ID NO: 72153 - DNA, 20 bp, Artificial Sequence
  Description of Artificial Sequence: Synthetic oligonucleotide
  Target: ATXN1; (-) strand; PAM type: NRG; PAM sequence: AAG
ccaattgtatcctaaaaagt

SEQ ID NO: 72154 - DNA, 20 bp, Artificial Sequence
  Description of Artificial Sequence: Synthetic oligonucleotide
  Target: ATXN1; (-) strand; PAM type: NRG; PAM sequence: AAG
tctcccaattgtatcctaaa

SEQ ID NO: 72155 - DNA, 20 bp, Artificial Sequence
  Description of Artificial Sequence: Synthetic oligonucleotide
  Target: ATXN1; (-) strand; PAM type: NRG; PAM sequence: GAG
agaattctctttctattcgt

SEQ ID NO: 72156 - DNA, 20 bp, Artificial Sequence
  Description of Artificial Sequence: Synthetic oligonucleotide
  Target: ATXN1; (-) strand; PAM type: NRG; PAM sequence: GAG
atacacctgttgaaatctta

SEQ ID NO: 72157 - DNA, 20 bp, Artificial Sequence
  Description of Artificial Sequence: Synthetic oligonucleotide
  Target: ATXN1; (-) strand; PAM type: NRG; PAM sequence: TAG
tcatacacctgttgaaatct

SEQ ID NO: 72158 - DNA, 20 bp, Artificial Sequence
  Description of Artificial Sequence: Synthetic oligonucleotide
  Target: ATXN1; (-) strand; PAM type: NRG; PAM sequence: CAG
actccctcatgatatgatcc

SEQ ID NO: 72159 - DNA, 20 bp, Artificial Sequence
  Description of Artificial Sequence: Synthetic oligonucleotide
  Target: ATXN1; (-) strand; PAM type: NRG; PAM sequence: AGG
cacatcctgtttactcagca

SEQ ID NO: 72160 - DNA, 20 bp, Artificial Sequence
  Description of Artificial Sequence: Synthetic oligonucleotide
  Target: ATXN1; (-) strand; PAM type: NRG; PAM sequence: AAG
ccacatcctgtttactcagc

SEQ ID NO: 72161 - DNA, 20 bp, Artificial Sequence
  Description of Artificial Sequence: Synthetic oligonucleotide
  Target: ATXN1; (-) strand; PAM type: NRG; PAM sequence: CAG
ggacccacatcctgtttact

SEQ ID NO: 72162 - DNA, 20 bp, Artificial Sequence
  Description of Artificial Sequence: Synthetic oligonucleotide
  Target: ATXN1; (-) strand; PAM type: NRG; PAM sequence: TGG
aaggtagaagagctgggatt

SEQ ID NO: 72163 - DNA, 20 bp, Artificial Sequence
  Description of Artificial Sequence: Synthetic oligonucleotide
  Target: ATXN1; (-) strand; PAM type: NRG; PAM sequence: GGG
gctgaaaaggtagaagagct

SEQ ID NO: 72164 - DNA, 20 bp, Artificial Sequence
  Description of Artificial Sequence: Synthetic oligonucleotide
  Target: ATXN1; (-) strand; PAM type: NRG; PAM sequence: TGG
agctgaaaaggtagaagagc

SEQ ID NO: 72165 - DNA, 20 bp, Artificial Sequence
  Description of Artificial Sequence: Synthetic oligonucleotide
  Target: ATXN1; (-) strand; PAM type: NRG; PAM sequence: GAG
attcagctgaaaaggtagaa

SEQ ID NO: 72166 - DNA, 20 bp, Artificial Sequence
  Description of Artificial Sequence: Synthetic oligonucleotide
  Target: ATXN1; (-) strand; PAM type: NRG; PAM sequence: AAG
tcattcagctgaaaaggtag

SEQ ID NO: 72167 - DNA, 20 bp, Artificial Sequence
  Description of Artificial Sequence: Synthetic oligonucleotide
  Target: ATXN1; (-) strand; PAM type: NRG; PAM sequence: TAG
aggtcattcagctgaaaagg

SEQ ID NO: 72168 - DNA, 20 bp, Artificial Sequence
  Description of Artificial Sequence: Synthetic oligonucleotide
  Target: ATXN1; (-) strand; PAM type: NRG; PAM sequence: AGG
tggaggtcattcagctgaaa

SEQ ID NO: 72169 - DNA, 20 bp, Artificial Sequence
  Description of Artificial Sequence: Synthetic oligonucleotide
  Target: ATXN1; (-) strand; PAM type: NRG; PAM sequence: AAG
ctggaggtcattcagctgaa

SEQ ID NO: 72170 - DNA, 20 bp, Artificial Sequence
  Description of Artificial Sequence: Synthetic oligonucleotide
  Target: ATXN1; (-) strand; PAM type: NRG; PAM sequence: CAG
tgctaagcctggaggtcatt

SEQ ID NO: 72171 - DNA, 20 bp, Artificial Sequence
  Description of Artificial Sequence: Synthetic oligonucleotide
  Target: ATXN1; (-) strand; PAM type: NRG; PAM sequence: AGG
agagaggctgctaagcctgg

SEQ ID NO: 72172 - DNA, 20 bp, Artificial Sequence
  Description of Artificial Sequence: Synthetic oligonucleotide
  Target: ATXN1; (-) strand; PAM type: NRG; PAM sequence: GAG
tagagaggctgctaagcctg

SEQ ID NO: 72173 - DNA, 20 bp, Artificial Sequence
  Description of Artificial Sequence: Synthetic oligonucleotide
  Target: ATXN1; (-) strand; PAM type: NRG; PAM sequence: TGG
tttagagaggctgctaagcc

SEQ ID NO: 72174 - DNA, 20 bp, Artificial Sequence
  Description of Artificial Sequence: Synthetic oligonucleotide
  Target: ATXN1; (-) strand; PAM type: NRG; PAM sequence: AAG
tgaggtttagagaggctgct

SEQ ID NO: 72175 - DNA, 20 bp, Artificial Sequence
  Description of Artificial Sequence: Synthetic oligonucleotide
  Target: ATXN1; (-) strand; PAM type: NRG; PAM sequence: AGG
acgggggctgaggtttagag

SEQ ID NO: 72176 - DNA, 20 bp, Artificial Sequence
  Description of Artificial Sequence: Synthetic oligonucleotide
  Target: ATXN1; (-) strand; PAM type: NRG; PAM sequence: GAG
gacgggggctgaggtttaga

SEQ ID NO: 72177 - DNA, 20 bp, Artificial Sequence
  Description of Artificial Sequence: Synthetic oligonucleotide
  Target: ATXN1; (-) strand; PAM type: NRG; PAM sequence: GAG
tagacgggggctgaggttta

SEQ ID NO: 72178 - DNA, 20 bp, Artificial Sequence
  Description of Artificial Sequence: Synthetic oligonucleotide
  Target: ATXN1; (-) strand; PAM type: NRG; PAM sequence: TAG
tatagacgggggctgaggtt

SEQ ID NO: 72179 - DNA, 20 bp, Artificial Sequence
  Description of Artificial Sequence: Synthetic oligonucleotide
  Target: ATXN1; (-) strand; PAM type: NRG; PAM sequence: AGG
cactttatagacgggggctg

SEQ ID NO: 72180 - DNA, 20 bp, Artificial Sequence
  Description of Artificial Sequence: Synthetic oligonucleotide
  Target: ATXN1; (-) strand; PAM type: NRG; PAM sequence: GAG
tcactttatagacgggggct

SEQ ID NO: 72181 - DNA, 20 bp, Artificial Sequence
  Description of Artificial Sequence: Synthetic oligonucleotide
  Target: ATXN1; (-) strand; PAM type: NRG; PAM sequence: GGG
gtttctcactttatagacgg

SEQ ID NO: 72182 - DNA, 20 bp, Artificial Sequence
  Description of Artificial Sequence: Synthetic oligonucleotide
  Target: ATXN1; (-) strand; PAM type: NRG; PAM sequence: GGG
tgtttctcactttatagacg

SEQ ID NO: 72183 - DNA, 20 bp, Artificial Sequence
  Description of Artificial Sequence: Synthetic oligonucleotide
  Target: ATXN1; (-) strand; PAM type: NRG; PAM sequence: GGG
atgtttctcactttatagac

SEQ ID NO: 72184 - DNA, 20 bp, Artificial Sequence
  Description of Artificial Sequence: Synthetic oligonucleotide
  Target: ATXN1; (-) strand; PAM type: NRG; PAM sequence: CGG
aatgtttctcactttataga

SEQ ID NO: 72185 - DNA, 20 bp, Artificial Sequence
  Description of Artificial Sequence: Synthetic oligonucleotide
  Target: ATXN1; (-) strand; PAM type: NRG; PAM sequence: TAG
ttacaatgtttctcacttta

SEQ ID NO: 72186 - DNA, 20 bp, Artificial Sequence
  Description of Artificial Sequence: Synthetic oligonucleotide
  Target: ATXN1; (-) strand; PAM type: NRG; PAM sequence: AAG
gaatgcccaggcgctctgct

SEQ ID NO: 72187 - DNA, 20 bp, Artificial Sequence
  Description of Artificial Sequence: Synthetic oligonucleotide
  Target: ATXN1; (-) strand; PAM type: NRG; PAM sequence: AGG
tttgctaagtatgaatgccc

SEQ ID NO: 72188 - DNA, 20 bp, Artificial Sequence
  Description of Artificial Sequence: Synthetic oligonucleotide
  Target: ATXN1; (-) strand; PAM type: NRG; PAM sequence: CAG
ttttgctaagtatgaatgcc

SEQ ID NO: 72189 - DNA, 20 bp, Artificial Sequence
  Description of Artificial Sequence: Synthetic oligonucleotide
  Target: ATXN1; (-) strand; PAM type: NRG; PAM sequence: AAG
aatatcaaccaacttttgct

SEQ ID NO: 72190 - DNA, 20 bp, Artificial Sequence
  Description of Artificial Sequence: Synthetic oligonucleotide
  Target: ATXN1; (-) strand; PAM type: NRG; PAM sequence: AAG
gaacatagttgtagaagggt

SEQ ID NO: 72191 - DNA, 20 bp, Artificial Sequence
  Description of Artificial Sequence: Synthetic oligonucleotide
  Target: ATXN1; (-) strand; PAM type: NRG; PAM sequence: GGG
ttgagaacatagttgtagaa

SEQ ID NO: 72192 - DNA, 20 bp, Artificial Sequence
  Description of Artificial Sequence: Synthetic oligonucleotide
  Target: ATXN1; (-) strand; PAM type: NRG; PAM sequence: AGG
cttgagaacatagttgtaga

SEQ ID NO: 72193 - DNA, 20 bp, Artificial Sequence
  Description of Artificial Sequence: Synthetic oligonucleotide
  Target: ATXN1; (-) strand; PAM type: NRG; PAM sequence: AAG
tcttgagaacatagttgtag

SEQ ID NO: 72194 - DNA, 20 bp, Artificial Sequence
  Description of Artificial Sequence: Synthetic oligonucleotide
  Target: ATXN1; (-) strand; PAM type: NRG; PAM sequence: TAG
ttttcttgagaacatagttg

SEQ ID NO: 72195 - DNA, 20 bp, Artificial Sequence
  Description of Artificial Sequence: Synthetic oligonucleotide
  Target: ATXN1; (-) strand; PAM type: NRG; PAM sequence: TAG
aatgatttttcttgagaaca

SEQ ID NO: 72196 - DNA, 20 bp, Artificial Sequence
  Description of Artificial Sequence: Synthetic oligonucleotide
  Target: ATXN1; (-) strand; PAM type: NRG; PAM sequence: GAG
tcccaaaaatgatttttctt

SEQ ID NO: 72197 - DNA, 20 bp, Artificial Sequence
  Description of Artificial Sequence: Synthetic oligonucleotide
  Target: ATXN1; (-) strand; PAM type: NRG; PAM sequence: TGG
cacatttgttcgcttcacga

SEQ ID NO: 72198 - DNA, 20 bp, Artificial Sequence
  Description of Artificial Sequence: Synthetic oligonucleotide
  Target: ATXN1; (-) strand; PAM type: NRG; PAM sequence: AAG
tagttacaaattaagattgt

SEQ ID NO: 72199 - DNA, 20 bp, Artificial Sequence
  Description of Artificial Sequence: Synthetic oligonucleotide
  Target: ATXN1; (-) strand; PAM type: NRG; PAM sequence: AAG
cttttaggtagttacaaatt

SEQ ID NO: 72200 - DNA, 20 bp, Artificial Sequence
  Description of Artificial Sequence: Synthetic oligonucleotide
  Target: ATXN1; (-) strand; PAM type: NRG; PAM sequence: TAG
ctgtgcagcctacttttagg

SEQ ID NO: 72201 - DNA, 20 bp, Artificial Sequence
  Description of Artificial Sequence: Synthetic oligonucleotide
  Target: ATXN1; (-) strand; PAM type: NRG; PAM sequence: AGG
tctctgtgcagcctactttt

SEQ ID NO: 72202 - DNA, 20 bp, Artificial Sequence
  Description of Artificial Sequence: Synthetic oligonucleotide
  Target: ATXN1; (-) strand; PAM type: NRG; PAM sequence: TAG
ttctctgtgcagcctacttt

SEQ ID NO: 72203 - DNA, 20 bp, Artificial Sequence
  Description of Artificial Sequence: Synthetic oligonucleotide
  Target: ATXN1; (-) strand; PAM type: NRG; PAM sequence: CAG
catagtttcatttctctgtg

SEQ ID NO: 72204 - DNA, 20 bp, Artificial Sequence
  Description of Artificial Sequence: Synthetic oligonucleotide
  Target: ATXN1; (-) strand; PAM type: NRG; PAM sequence: TAG
tccaagtttttgtgtagaca

SEQ ID NO: 72205 - DNA, 20 bp, Artificial Sequence
  Description of Artificial Sequence: Synthetic oligonucleotide
  Target: ATXN1; (-) strand; PAM type: NRG; PAM sequence: TAG
ttcctttccaagtttttgtg

SEQ ID NO: 72206 - DNA, 20 bp, Artificial Sequence
  Description of Artificial Sequence: Synthetic oligonucleotide
  Target: ATXN1; (-) strand; PAM type: NRG; PAM sequence: AAG
tgctatgaacattcctttcc

SEQ ID NO: 72207 - DNA, 20 bp, Artificial Sequence
  Description of Artificial Sequence: Synthetic oligonucleotide
  Target: ATXN1; (-) strand; PAM type: NRG; PAM sequence: CAG
cactctttcactattatgaa

SEQ ID NO: 72208 - DNA, 20 bp, Artificial Sequence
  Description of Artificial Sequence: Synthetic oligonucleotide
  Target: ATXN1; (-) strand; PAM type: NRG; PAM sequence: GGG
ttatcagttgatggacattt

SEQ ID NO: 72209 - DNA, 20 bp, Artificial Sequence
  Description of Artificial Sequence: Synthetic oligonucleotide
  Target: ATXN1; (-) strand; PAM type: NRG; PAM sequence: TGG
tttatcagttgatggacatt

SEQ ID NO: 72210 - DNA, 20 bp, Artificial Sequence
  Description of Artificial Sequence: Synthetic oligonucleotide
  Target: ATXN1; (-) strand; PAM type: NRG; PAM sequence: TGG
tttattcatttatcagttga

SEQ ID NO: 72211 - DNA, 20 bp, Artificial Sequence
  Description of Artificial Sequence: Synthetic oligonucleotide
  Target: ATXN1; (-) strand; PAM type: NRG; PAM sequence: CAG
tattttgtttattcatttat

SEQ ID NO: 72212 - DNA, 20 bp, Artificial Sequence
  Description of Artificial Sequence: Synthetic oligonucleotide
  Target: ATXN1; (-) strand; PAM type: NRG; PAM sequence: TGG
tggaataatgtaacattgta

SEQ ID NO: 72213 - DNA, 20 bp, Artificial Sequence
  Description of Artificial Sequence: Synthetic oligonucleotide
  Target: ATXN1; (-) strand; PAM type: NRG; PAM sequence: TGG
tcattcatttcttgttatga

SEQ ID NO: 72214 - DNA, 20 bp, Artificial Sequence
  Description of Artificial Sequence: Synthetic oligonucleotide
  Target: ATXN1; (-) strand; PAM type: NRG; PAM sequence: CAG
atccacatttcagcatacat

SEQ ID NO: 72215 - DNA, 20 bp, Artificial Sequence
  Description of Artificial Sequence: Synthetic oligonucleotide
  Target: ATXN1; (-) strand; PAM type: NRG; PAM sequence: CAG
ttcaaggatcatccacattt

SEQ ID NO: 72216 - DNA, 20 bp, Artificial Sequence
  Description of Artificial Sequence: Synthetic oligonucleotide
  Target: ATXN1; (-) strand; PAM type: NRG; PAM sequence: AGG
cacttagcataatgctttca

SEQ ID NO: 72217 - DNA, 20 bp, Artificial Sequence
  Description of Artificial Sequence: Synthetic oligonucleotide
  Target: ATXN1; (-) strand; PAM type: NRG; PAM sequence: AAG
tcacttagcataatgctttc

SEQ ID NO: 72218 - DNA, 20 bp, Artificial Sequence
  Description of Artificial Sequence: Synthetic oligonucleotide
  Target: ATXN1; (-) strand; PAM type: NRG; PAM sequence: TAG
tgtgactgacttctttcact

SEQ ID NO: 72219 - DNA, 20 bp, Artificial Sequence
  Description of Artificial Sequence: Synthetic oligonucleotide
  Target: ATXN1; (-) strand; PAM type: NRG; PAM sequence: CGG
aaatagaatcatgcaatatg

SEQ ID NO: 72220 - DNA, 20 bp, Artificial Sequence
  Description of Artificial Sequence: Synthetic oligonucleotide
  Target: ATXN1; (-) strand; PAM type: NRG; PAM sequence: TAG
ttctagacattccatataaa

SEQ ID NO: 72221 - DNA, 20 bp, Artificial Sequence
  Description of Artificial Sequence: Synthetic oligonucleotide
  Target: ATXN1; (-) strand; PAM type: NRG; PAM sequence: TAG
atatatagatttgcttgttc

SEQ ID NO: 72222 - DNA, 20 bp, Artificial Sequence
  Description of Artificial Sequence: Synthetic oligonucleotide
  Target: ATXN1; (-) strand; PAM type: NRG; PAM sequence: TAG
cgaagctgtttctctatata

SEQ ID NO: 72223 - DNA, 20 bp, Artificial Sequence
  Description of Artificial Sequence: Synthetic oligonucleotide
  Target: ATXN1; (-) strand; PAM type: NRG; PAM sequence: AAG
ctcagctcctggcaaccacg

SEQ ID NO: 72224 - DNA, 20 bp, Artificial Sequence
  Description of Artificial Sequence: Synthetic oligonucleotide
  Target: ATXN1; (-) strand; PAM type: NRG; PAM sequence: TGG
aatcctctaccctcagctcc

SEQ ID NO: 72225 - DNA, 20 bp, Artificial Sequence
  Description of Artificial Sequence: Synthetic oligonucleotide
  Target: ATXN1; (-) strand; PAM type: NRG; PAM sequence: CAG
ttcccccaatcctctaccct

SEQ ID NO: 72226 - DNA, 20 bp, Artificial Sequence
  Description of Artificial Sequence: Synthetic oligonucleotide
  Target: ATXN1; (-) strand; PAM type: NRG; PAM sequence: CAG
aaaggaaatcccatacccat

SEQ ID NO: 72227 - DNA, 20 bp, Artificial Sequence
  Description of Artificial Sequence: Synthetic oligonucleotide
  Target: ATXN1; (-) strand; PAM type: NRG; PAM sequence: AGG
aacattttcatcacccctaa

SEQ ID NO: 72228 - DNA, 20 bp, Artificial Sequence
  Description of Artificial Sequence: Synthetic oligonucleotide
  Target: ATXN1; (-) strand; PAM type: NRG; PAM sequence: AAG
gaacattttcatcaccccta

SEQ ID NO: 72229 - DNA, 20 bp, Artificial Sequence
  Description of Artificial Sequence: Synthetic oligonucleotide
  Target: ATXN1; (-) strand; PAM type: NRG; PAM sequence: TAG
gctatcaccacaataaattt

SEQ ID NO: 72230 - DNA, 20 bp, Artificial Sequence
  Description of Artificial Sequence: Synthetic oligonucleotide
  Target: ATXN1; (-) strand; PAM type: NRG; PAM sequence: CAG
agtgtatttacagagctgtg

SEQ ID NO: 72231 - DNA, 20 bp, Artificial Sequence
  Description of Artificial Sequence: Synthetic oligonucleotide
  Target: ATXN1; (-) strand; PAM type: NRG; PAM sequence: GAG
tgctttttagtgtatttaca

SEQ ID NO: 72232 - DNA, 20 bp, Artificial Sequence
  Description of Artificial Sequence: Synthetic oligonucleotide
  Target: ATXN1; (-) strand; PAM type: NRG; PAM sequence: CAG
attgctttttagtgtattta

SEQ ID NO: 72233 - DNA, 20 bp, Artificial Sequence
  Description of Artificial Sequence: Synthetic oligonucleotide
  Target: ATXN1; (-) strand; PAM type: NRG; PAM sequence: TAG
aagtgcaatgaattgctttt

SEQ ID NO: 72234 - DNA, 20 bp, Artificial Sequence
  Description of Artificial Sequence: Synthetic oligonucleotide
  Target: ATXN1; (-) strand; PAM type: NRG; PAM sequence: AAG
cttatttaaattaaaaaaaa

SEQ ID NO: 72235 - DNA, 20 bp, Artificial Sequence
  Description of Artificial Sequence: Synthetic oligonucleotide
  Target: ATXN1; (-) strand; PAM type: NRG; PAM sequence: TAG
aggaggcattgaggactgca

SEQ ID NO: 72236 - DNA, 20 bp, Artificial Sequence
  Description of Artificial Sequence: Synthetic oligonucleotide
  Target: ATXN1; (-) strand; PAM type: NRG; PAM sequence: AGG
atggggagcaggaggcattg

SEQ ID NO: 72237 - DNA, 20 bp, Artificial Sequence
  Description of Artificial Sequence: Synthetic oligonucleotide
  Target: ATXN1; (-) strand; PAM type: NRG; PAM sequence: GAG
gatggggagcaggaggcatt

SEQ ID NO: 72238 - DNA, 20 bp, Artificial Sequence
  Description of Artificial Sequence: Synthetic oligonucleotide
  Target: ATXN1; (-) strand; PAM type: NRG; PAM sequence: AGG
ttcaggagatggggagcagg

SEQ ID NO: 72239 - DNA, 20 bp, Artificial Sequence
  Description of Artificial Sequence: Synthetic oligonucleotide
  Target: ATXN1; (-) strand; PAM type: NRG; PAM sequence: GAG
attcaggagatggggagcag

SEQ ID NO: 72240 - DNA, 20 bp, Artificial Sequence
  Description of Artificial Sequence: Synthetic oligonucleotide
  Target: ATXN1; (-) strand; PAM type: NRG; PAM sequence: AGG
ttattcaggagatggggagc

SEQ ID NO: 72241 - DNA, 20 bp, Artificial Sequence
  Description of Artificial Sequence: Synthetic oligonucleotide
  Target: ATXN1; (-) strand; PAM type: NRG; PAM sequence: CAG
tttattcaggagatggggag

SEQ ID NO: 72242 - DNA, 20 bp, Artificial Sequence
  Description of Artificial Sequence: Synthetic oligonucleotide
  Target: ATXN1; (-) strand; PAM type: NRG; PAM sequence: GAG
ttgtttattcaggagatggg

SEQ ID NO: 72243 - DNA, 20 bp, Artificial Sequence
  Description of Artificial Sequence: Synthetic oligonucleotide
  Target: ATXN1; (-) strand; PAM type: NRG; PAM sequence: GGG
tcttgtttattcaggagatg

SEQ ID NO: 72244 - DNA, 20 bp, Artificial Sequence
  Description of Artificial Sequence: Synthetic oligonucleotide
  Target: ATXN1; (-) strand; PAM type: NRG; PAM sequence: GGG
gtcttgtttattcaggagat

SEQ ID NO: 72245 - DNA, 20 bp, Artificial Sequence
  Description of Artificial Sequence: Synthetic oligonucleotide
  Target: ATXN1; (-) strand; PAM type: NRG; PAM sequence: TGG
agtcttgtttattcaggaga

SEQ ID NO: 72246 - DNA, 20 bp, Artificial Sequence
  Description of Artificial Sequence: Synthetic oligonucleotide
  Target: ATXN1; (-) strand; PAM type: NRG; PAM sequence: GAG
agaaagtcttgtttattcag

SEQ ID NO: 72247 - DNA, 20 bp, Artificial Sequence
  Description of Artificial Sequence: Synthetic oligonucleotide
  Target: ATXN1; (-) strand; PAM type: NRG; PAM sequence: AGG
gaagaaagtcttgtttattc

SEQ ID NO: 72248 - DNA, 20 bp, Artificial Sequence
  Description of Artificial Sequence: Synthetic oligonucleotide
  Target: ATXN1; (-) strand; PAM type: NRG; PAM sequence: CAG
ggaagaaagtcttgtttatt

SEQ ID NO: 72249 - DNA, 20 bp, Artificial Sequence
  Description of Artificial Sequence: Synthetic oligonucleotide
  Target: ATXN1; (-) strand; PAM type: NRG; PAM sequence: AAG
agaccctcacccagggaaga

SEQ ID NO: 72250 - DNA, 20 bp, Artificial Sequence
  Description of Artificial Sequence: Synthetic oligonucleotide
  Target: ATXN1; (-) strand; PAM type: NRG; PAM sequence: AAG
atcaagaccctcacccaggg

SEQ ID NO: 72251 - DNA, 20 bp, Artificial Sequence
  Description of Artificial Sequence: Synthetic oligonucleotide
  Target: ATXN1; (-) strand; PAM type: NRG; PAM sequence: GGG
cctatcaagaccctcaccca

SEQ ID NO: 72252 - DNA, 20 bp, Artificial Sequence
  Description of Artificial Sequence: Synthetic oligonucleotide
  Target: ATXN1; (-) strand; PAM type: NRG; PAM sequence: AGG
acctatcaagaccctcaccc

SEQ ID NO: 72253 - DNA, 20 bp, Artificial Sequence
  Description of Artificial Sequence: Synthetic oligonucleotide
  Target: ATXN1; (-) strand; PAM type: NRG; PAM sequence: CAG
tacctatcaagaccctcacc

SEQ ID NO: 72254 - DNA, 20 bp, Artificial Sequence
  Description of Artificial Sequence: Synthetic oligonucleotide
  Target: ATXN1; (-) strand; PAM type: NRG; PAM sequence: AAG
tgtacagtattctacctatc

SEQ ID NO: 72255 - DNA, 20 bp, Artificial Sequence
  Description of Artificial Sequence: Synthetic oligonucleotide
  Target: ATXN1; (-) strand; PAM type: NRG; PAM sequence: CAG
tgaattctgtattccgtgta

SEQ ID NO: 72256 - DNA, 20 bp, Artificial Sequence
  Description of Artificial Sequence: Synthetic oligonucleotide
  Target: ATXN1; (-) strand; PAM type: NRG; PAM sequence: AGG
cttctgatattcataagtca

SEQ ID NO: 72257 - DNA, 20 bp, Artificial Sequence
  Description of Artificial Sequence: Synthetic oligonucleotide
  Target: ATXN1; (-) strand; PAM type: NRG; PAM sequence: AAG
tcttctgatattcataagtc

SEQ ID NO: 72258 - DNA, 20 bp, Artificial Sequence
  Description of Artificial Sequence: Synthetic oligonucleotide
  Target: ATXN1; (-) strand; PAM type: NRG; PAM sequence: AAG
ggacatcttctgatattcat

SEQ ID NO: 72259 - DNA, 20 bp, Artificial Sequence
  Description of Artificial Sequence: Synthetic oligonucleotide
  Target: ATXN1; (-) strand; PAM type: NRG; PAM sequence: TGG
atgtctcctgagaaagagga

SEQ ID NO: 72260 - DNA, 20 bp, Artificial Sequence
  Description of Artificial Sequence: Synthetic oligonucleotide
  Target: ATXN1; (-) strand; PAM type: NRG; PAM sequence: AGG
ggaaatgtctcctgagaaag

SEQ ID NO: 72261 - DNA, 20 bp, Artificial Sequence
  Description of Artificial Sequence: Synthetic oligonucleotide
  Target: ATXN1; (-) strand; PAM type: NRG; PAM sequence: GAG
tggaaatgtctcctgagaaa

SEQ ID NO: 72262 - DNA, 20 bp, Artificial Sequence
  Description of Artificial Sequence: Synthetic oligonucleotide
  Target: ATXN1; (-) strand; PAM type: NRG; PAM sequence: AAG
cctggaaatgtctcctgaga

SEQ ID NO: 72263 - DNA, 20 bp, Artificial Sequence
  Description of Artificial Sequence: Synthetic oligonucleotide
  Target: ATXN1; (-) strand; PAM type: NRG; PAM sequence: GAG
tccacctggaaatgtctcct

SEQ ID NO: 72264 - DNA, 20 bp, Artificial Sequence
  Description of Artificial Sequence: Synthetic oligonucleotide
  Target: ATXN1; (-) strand; PAM type: NRG; PAM sequence: TGG
aacctcctctggcatccacc

SEQ ID NO: 72265 - DNA, 20 bp, Artificial Sequence
  Description of Artificial Sequence: Synthetic oligonucleotide
  Target: ATXN1; (-) strand; PAM type: NRG; PAM sequence: TGG
agaagagaaataacctcctc

SEQ ID NO: 72266 - DNA, 20 bp, Artificial Sequence
  Description of Artificial Sequence: Synthetic oligonucleotide
  Target: ATXN1; (-) strand; PAM type: NRG; PAM sequence: GAG
aaagaagcagatgggaagaa

SEQ ID NO: 72267 - DNA, 20 bp, Artificial Sequence
  Description of Artificial Sequence: Synthetic oligonucleotide
  Target: ATXN1; (-) strand; PAM type: NRG; PAM sequence: AAG
ttaaagaagcagatgggaag

SEQ ID NO: 72268 - DNA, 20 bp, Artificial Sequence
  Description of Artificial Sequence: Synthetic oligonucleotide
  Target: ATXN1; (-) strand; PAM type: NRG; PAM sequence: AAG
gatttaaagaagcagatggg

SEQ ID NO: 72269 - DNA, 20 bp, Artificial Sequence
  Description of Artificial Sequence: Synthetic oligonucleotide
  Target: ATXN1; (-) strand; PAM type: NRG; PAM sequence: GGG
taagatttaaagaagcagat

SEQ ID NO: 72270 - DNA, 20 bp, Artificial Sequence
  Description of Artificial Sequence: Synthetic oligonucleotide
  Target: ATXN1; (-) strand; PAM type: NRG; PAM sequence: TGG
ctaagatttaaagaagcaga

SEQ ID NO: 72271 - DNA, 20 bp, Artificial Sequence
  Description of Artificial Sequence: Synthetic oligonucleotide
  Target: ATXN1; (-) strand; PAM type: NRG; PAM sequence: CAG
ggagctaagatttaaagaag

SEQ ID NO: 72272 - DNA, 20 bp, Artificial Sequence
  Description of Artificial Sequence: Synthetic oligonucleotide
  Target: ATXN1; (-) strand; PAM type: NRG; PAM sequence: AAG
gcaggagctaagatttaaag

SEQ ID NO: 72273 - DNA, 20 bp, Artificial Sequence
  Description of Artificial Sequence: Synthetic oligonucleotide
  Target: ATXN1; (-) strand; PAM type: NRG; PAM sequence: AAG
aatgcaggagctaagattta

SEQ ID NO: 72274 - DNA, 20 bp, Artificial Sequence
  Description of Artificial Sequence: Synthetic oligonucleotide
  Target: ATXN1; (-) strand; PAM type: NRG; PAM sequence: AAG
ggaaacagaatgcaggagct

SEQ ID NO: 72275 - DNA, 20 bp, Artificial Sequence
  Description of Artificial Sequence: Synthetic oligonucleotide
  Target: ATXN1; (-) strand; PAM type: NRG; PAM sequence: GAG
tatggggaaacagaatgcag

SEQ ID NO: 72276 - DNA, 20 bp, Artificial Sequence
  Description of Artificial Sequence: Synthetic oligonucleotide
  Target: ATXN1; (-) strand; PAM type: NRG; PAM sequence: AGG
catatggggaaacagaatgc

SEQ ID NO: 72277 - DNA, 20 bp, Artificial Sequence
  Description of Artificial Sequence: Synthetic oligonucleotide
  Target: ATXN1; (-) strand; PAM type: NRG; PAM sequence: CAG
tcatatggggaaacagaatg

SEQ ID NO: 72278 - DNA, 20 bp, Artificial Sequence
  Description of Artificial Sequence: Synthetic oligonucleotide
  Target: ATXN1; (-) strand; PAM type: NRG; PAM sequence: CAG
actatgctcatatggggaaa

SEQ ID NO: 72279 - DNA, 20 bp, Artificial Sequence
  Description of Artificial Sequence: Synthetic oligonucleotide
  Target: ATXN1; (-) strand; PAM type: NRG; PAM sequence: GGG
ttaaccactatgctcatatg

SEQ ID NO: 72280 - DNA, 20 bp, Artificial Sequence
  Description of Artificial Sequence: Synthetic oligonucleotide
  Target: ATXN1; (-) strand; PAM type: NRG; PAM sequence: GGG
tttaaccactatgctcatat

SEQ ID NO: 72281 - DNA, 20 bp, Artificial Sequence
  Description of Artificial Sequence: Synthetic oligonucleotide
  Target: ATXN1; (-) strand; PAM type: NRG; PAM sequence: TGG
ttttaaccactatgctcata

SEQ ID NO: 72282 - DNA, 20 bp, Artificial Sequence
  Description of Artificial Sequence: Synthetic oligonucleotide
  Target: ATXN1; (-) strand; PAM type: NRG; PAM sequence: GAG
tcgcctgtgaagataaagca

SEQ ID NO: 72283 - DNA, 20 bp, Artificial Sequence
  Description of Artificial Sequence: Synthetic oligonucleotide
  Target: ATXN1; (-) strand; PAM type: NRG; PAM sequence: CAG
tttcgcctgtgaagataaag

SEQ ID NO: 72284 - DNA, 20 bp, Artificial Sequence
  Description of Artificial Sequence: Synthetic oligonucleotide
  Target: ATXN1; (-) strand; PAM type: NRG; PAM sequence: AAG
agctttcgcctgtgaagata

SEQ ID NO: 72285 - DNA, 20 bp, Artificial Sequence
  Description of Artificial Sequence: Synthetic oligonucleotide
  Target: ATXN1; (-) strand; PAM type: NRG; PAM sequence: AAG
ctttaaagctttcgcctgtg

SEQ ID NO: 72286 - DNA, 20 bp, Artificial Sequence
  Description of Artificial Sequence: Synthetic oligonucleotide
  Target: ATXN1; (-) strand; PAM type: NRG; PAM sequence: AAG
tgaaagacctgtccacttta

SEQ ID NO: 72287 - DNA, 20 bp, Artificial Sequence
  Description of Artificial Sequence: Synthetic oligonucleotide
  Target: ATXN1; (-) strand; PAM type: NRG; PAM sequence: AAG
aaacttcaaactaggtatga

SEQ ID NO: 72288 - DNA, 20 bp, Artificial Sequence
  Description of Artificial Sequence: Synthetic oligonucleotide
  Target: ATXN1; (-) strand; PAM type: NRG; PAM sequence: AGG
tttttcataaacttcaaact

SEQ ID NO: 72289 - DNA, 20 bp, Artificial Sequence
  Description of Artificial Sequence: Synthetic oligonucleotide
  Target: ATXN1; (-) strand; PAM type: NRG; PAM sequence: TAG
ctttttcataaacttcaaac

SEQ ID NO: 72290 - DNA, 20 bp, Artificial Sequence
  Description of Artificial Sequence: Synthetic oligonucleotide
  Target: ATXN1; (-) strand; PAM type: NRG; PAM sequence: TAG
aaactcacagtactccagag

SEQ ID NO: 72291 - DNA, 20 bp, Artificial Sequence
  Description of Artificial Sequence: Synthetic oligonucleotide
  Target: ATXN1; (-) strand; PAM type: NRG; PAM sequence: GAG
aaaaaactcacagtactcca

SEQ ID NO: 72292 - DNA, 20 bp, Artificial Sequence
  Description of Artificial Sequence: Synthetic oligonucleotide
  Target: ATXN1; (-) strand; PAM type: NRG; PAM sequence: CAG
agaaaaaactcacagtactc

SEQ ID NO: 72293 - DNA, 20 bp, Artificial Sequence
  Description of Artificial Sequence: Synthetic oligonucleotide
  Target: ATXN1; (-) strand; PAM type: NRG; PAM sequence: CAG
ggagaagcagaaaaaactca

SEQ ID NO: 72294 - DNA, 20 bp, Artificial Sequence
  Description of Artificial Sequence: Synthetic oligonucleotide
  Target: ATXN1; (-) strand; PAM type: NRG; PAM sequence: CAG
gtccttatggtgtggagaag

SEQ ID NO: 72295 - DNA, 20 bp, Artificial Sequence
  Description of Artificial Sequence: Synthetic oligonucleotide
  Target: ATXN1; (-) strand; PAM type: NRG; PAM sequence: AAG
cctgtccttatggtgtggag

SEQ ID NO: 72296 - DNA, 20 bp, Artificial Sequence
  Description of Artificial Sequence: Synthetic oligonucleotide
  Target: ATXN1; (-) strand; PAM type: NRG; PAM sequence: GAG
gaccctgtccttatggtgtg

SEQ ID NO: 72297 - DNA, 20 bp, Artificial Sequence
  Description of Artificial Sequence: Synthetic oligonucleotide
  Target: ATXN1; (-) strand; PAM type: NRG; PAM sequence: TGG
gggaccctgtccttatggtg

SEQ ID NO: 72298 - DNA, 20 bp, Artificial Sequence
  Description of Artificial Sequence: Synthetic oligonucleotide
  Target: ATXN1; (-) strand; PAM type: NRG; PAM sequence: TGG
ttacagggaccctgtcctta

SEQ ID NO: 72299 - DNA, 20 bp, Artificial Sequence
  Description of Artificial Sequence: Synthetic oligonucleotide
  Target: ATXN1; (-) strand; PAM type: NRG; PAM sequence: GGG
ttggaggacaattgcttaca

SEQ ID NO: 72300 - DNA, 20 bp, Artificial Sequence
  Description of Artificial Sequence: Synthetic oligonucleotide
  Target: ATXN1; (-) strand; PAM type: NRG; PAM sequence: AGG
tttggaggacaattgcttac

SEQ ID NO: 72301 - DNA, 20 bp, Artificial Sequence
  Description of Artificial Sequence: Synthetic oligonucleotide
  Target: ATXN1; (-) strand; PAM type: NRG; PAM sequence: CAG
gtttggaggacaattgctta

SEQ ID NO: 72302 - DNA, 20 bp, Artificial Sequence
  Description of Artificial Sequence: Synthetic oligonucleotide
  Target: ATXN1; (-) strand; PAM type: NRG; PAM sequence: AGG
tattaggtggattggtttgg

SEQ ID NO: 72303 - DNA, 20 bp, Artificial Sequence
  Description of Artificial Sequence: Synthetic oligonucleotide
  Target: ATXN1; (-) strand; PAM type: NRG; PAM sequence: GAG
ctattaggtggattggtttg

SEQ ID NO: 72304 - DNA, 20 bp, Artificial Sequence
  Description of Artificial Sequence: Synthetic oligonucleotide
  Target: ATXN1; (-) strand; PAM type: NRG; PAM sequence: TGG
gcctattaggtggattggtt

SEQ ID NO: 72305 - DNA, 20 bp, Artificial Sequence
  Description of Artificial Sequence: Synthetic oligonucleotide
  Target: ATXN1; (-) strand; PAM type: NRG; PAM sequence: TGG
atgtggcctattaggtggat

SEQ ID NO: 72306 - DNA, 20 bp, Artificial Sequence
  Description of Artificial Sequence: Synthetic oligonucleotide
  Target: ATXN1; (-) strand; PAM type: NRG; PAM sequence: TGG
aaatgatgtggcctattagg

SEQ ID NO: 72307 - DNA, 20 bp, Artificial Sequence
  Description of Artificial Sequence: Synthetic oligonucleotide
  Target: ATXN1; (-) strand; PAM type: NRG; PAM sequence: AGG
acaaaatgatgtggcctatt

SEQ ID NO: 72308 - DNA, 20 bp, Artificial Sequence
  Description of Artificial Sequence: Synthetic oligonucleotide
  Target: ATXN1; (-) strand; PAM type: NRG; PAM sequence: TAG
aacaaaatgatgtggcctat

SEQ ID NO: 72309 - DNA, 20 bp, Artificial Sequence
  Description of Artificial Sequence: Synthetic oligonucleotide
  Target: ATXN1; (-) strand; PAM type: NRG; PAM sequence: TGG
cttccctaaacaaaatgatg

SEQ ID NO: 72310 - DNA, 20 bp, Artificial Sequence
  Description of Artificial Sequence: Synthetic oligonucleotide
  Target: ATXN1; (-) strand; PAM type: NRG; PAM sequence: CAG
ttttcagtaatctctttttg

SEQ ID NO: 72311 - DNA, 20 bp, Artificial Sequence
  Description of Artificial Sequence: Synthetic oligonucleotide
  Target: ATXN1; (-) strand; PAM type: NRG; PAM sequence: CAG
gattatggggaatgattttt

SEQ ID NO: 72312 - DNA, 20 bp, Artificial Sequence
  Description of Artificial Sequence: Synthetic oligonucleotide
  Target: ATXN1; (-) strand; PAM type: NRG; PAM sequence: GGG
catcaaataaatagattatg

SEQ ID NO: 72313 - DNA, 20 bp, Artificial Sequence
  Description of Artificial Sequence: Synthetic oligonucleotide
  Target: ATXN1; (-) strand; PAM type: NRG; PAM sequence: GGG
acatcaaataaatagattat

SEQ ID NO: 72314 - DNA, 20 bp, Artificial Sequence
  Description of Artificial Sequence: Synthetic oligonucleotide
  Target: ATXN1; (-) strand; PAM type: NRG; PAM sequence: TGG
aacatcaaataaatagatta

SEQ ID NO: 72315 - DNA, 20 bp, Artificial Sequence
  Description of Artificial Sequence: Synthetic oligonucleotide
  Target: ATXN1; (-) strand; PAM type: NRG; PAM sequence: TAG
taaatcaaacatcaaataaa

SEQ ID NO: 72316 - DNA, 20 bp, Artificial Sequence
  Description of Artificial Sequence: Synthetic oligonucleotide
  Target: ATXN1; (-) strand; PAM type: NRG; PAM sequence: CAG
caatattttggcatgtttat

SEQ ID NO: 72317 - DNA, 20 bp, Artificial Sequence
  Description of Artificial Sequence: Synthetic oligonucleotide
  Target: ATXN1; (-) strand; PAM type: NRG; PAM sequence: TGG
ttactttttaggcaatattt

SEQ ID NO: 72318 - DNA, 20 bp, Artificial Sequence
  Description of Artificial Sequence: Synthetic oligonucleotide
  Target: ATXN1; (-) strand; PAM type: NRG; PAM sequence: AGG
gatgttagagattacttttt

SEQ ID NO: 72319 - DNA, 20 bp, Artificial Sequence
  Description of Artificial Sequence: Synthetic oligonucleotide
  Target: ATXN1; (-) strand; PAM type: NRG; PAM sequence: TAG
tgatgttagagattactttt

SEQ ID NO: 72320 - DNA, 20 bp, Artificial Sequence
  Description of Artificial Sequence: Synthetic oligonucleotide
  Target: ATXN1; (-) strand; PAM type: NRG; PAM sequence: GAG
gaagtaataatatgatgtta

SEQ ID NO: 72321 - DNA, 20 bp, Artificial Sequence
  Description of Artificial Sequence: Synthetic oligonucleotide
  Target: ATXN1; (-) strand; PAM type: NRG; PAM sequence: TAG
tggaagtaataatatgatgt

SEQ ID NO: 72322 - DNA, 20 bp, Artificial Sequence
  Description of Artificial Sequence: Synthetic oligonucleotide
  Target: ATXN1; (-) strand; PAM type: NRG; PAM sequence: AAG
ggagaaggttgatttcctgg

SEQ ID NO: 72323 - DNA, 20 bp, Artificial Sequence
  Description of Artificial Sequence: Synthetic oligonucleotide
  Target: ATXN1; (-) strand; PAM type: NRG; PAM sequence: TGG
tatggagaaggttgatttcc

SEQ ID NO: 72324 - DNA, 20 bp, Artificial Sequence
  Description of Artificial Sequence: Synthetic oligonucleotide
  Target: ATXN1; (-) strand; PAM type: NRG; PAM sequence: AGG
actgttgatttttatggaga

SEQ ID NO: 72325 - DNA, 20 bp, Artificial Sequence
  Description of Artificial Sequence: Synthetic oligonucleotide
  Target: ATXN1; (-) strand; PAM type: NRG; PAM sequence: AAG
cactgttgatttttatggag

SEQ ID NO: 72326 - DNA, 20 bp, Artificial Sequence
  Description of Artificial Sequence: Synthetic oligonucleotide
  Target: ATXN1; (-) strand; PAM type: NRG; PAM sequence: GAG
aaacactgttgatttttatg

SEQ ID NO: 72327 - DNA, 20 bp, Artificial Sequence
  Description of Artificial Sequence: Synthetic oligonucleotide
  Target: ATXN1; (-) strand; PAM type: NRG; PAM sequence: TGG
aaaaacactgttgattttta

SEQ ID NO: 72328 - DNA, 20 bp, Artificial Sequence
  Description of Artificial Sequence: Synthetic oligonucleotide
  Target: ATXN1; (-) strand; PAM type: NRG; PAM sequence: TGG
cagagaccttctggttcatg

SEQ ID NO: 72329 - DNA, 20 bp, Artificial Sequence
  Description of Artificial Sequence: Synthetic oligonucleotide
  Target: ATXN1; (-) strand; PAM type: NRG; PAM sequence: TGG
agcattacccagagaccttc

SEQ ID NO: 72330 - DNA, 20 bp, Artificial Sequence
  Description of Artificial Sequence: Synthetic oligonucleotide
  Target: ATXN1; (-) strand; PAM type: NRG; PAM sequence: GAG
ttaaaagccagcattaccca

SEQ ID NO: 72331 - DNA, 20 bp, Artificial Sequence
  Description of Artificial Sequence: Synthetic oligonucleotide
  Target: ATXN1; (-) strand; PAM type: NRG; PAM sequence: CAG
ggttaaaagccagcattacc

SEQ ID NO: 72332 - DNA, 20 bp, Artificial Sequence
  Description of Artificial Sequence: Synthetic oligonucleotide
  Target: ATXN1; (-) strand; PAM type: NRG; PAM sequence: CAG
gtgtgtttgtggttaaaagc

SEQ ID NO: 72333 - DNA, 20 bp, Artificial Sequence
  Description of Artificial Sequence: Synthetic oligonucleotide
  Target: ATXN1; (-) strand; PAM type: NRG; PAM sequence: AAG
atgtgtgtgtttgtggttaa

SEQ ID NO: 72334 - DNA, 20 bp, Artificial Sequence
  Description of Artificial Sequence: Synthetic oligonucleotide
  Target: ATXN1; (-) strand; PAM type: NRG; PAM sequence: TGG
ggtgtgcatgtgtgtgtttg

SEQ ID NO: 72335 - DNA, 20 bp, Artificial Sequence
  Description of Artificial Sequence: Synthetic oligonucleotide
  Target: ATXN1; (-) strand; PAM type: NRG; PAM sequence: TGG
atagcaaaggcagtttctgt

SEQ ID NO: 72336 - DNA, 20 bp, Artificial Sequence
  Description of Artificial Sequence: Synthetic oligonucleotide
  Target: ATXN1; (-) strand; PAM type: NRG; PAM sequence: CAG
gaatgttcaaatagcaaagg

SEQ ID NO: 72337 - DNA, 20 bp, Artificial Sequence
  Description of Artificial Sequence: Synthetic oligonucleotide
  Target: ATXN1; (-) strand; PAM type: NRG; PAM sequence: AGG
ctggaatgttcaaatagcaa

SEQ ID NO: 72338 - DNA, 20 bp, Artificial Sequence
  Description of Artificial Sequence: Synthetic oligonucleotide
  Target: ATXN1; (-) strand; PAM type: NRG; PAM sequence: AAG
cctggaatgttcaaatagca

SEQ ID NO: 72339 - DNA, 20 bp, Artificial Sequence
  Description of Artificial Sequence: Synthetic oligonucleotide
  Target: ATXN1; (-) strand; PAM type: NRG; PAM sequence: TAG
tgattcctggaatgttcaaa

SEQ ID NO: 72340 - DNA, 20 bp, Artificial Sequence
  Description of Artificial Sequence: Synthetic oligonucleotide
  Target: ATXN1; (-) strand; PAM type: NRG; PAM sequence: TGG
caatgttttcatttgattcc

SEQ ID NO: 72341 - DNA, 20 bp, Artificial Sequence
  Description of Artificial Sequence: Synthetic oligonucleotide
  Target: ATXN1; (-) strand; PAM type: NRG; PAM sequence: GAG
ggtttacctggaaatttttt

SEQ ID NO: 72342 - DNA, 20 bp, Artificial Sequence
  Description of Artificial Sequence: Synthetic oligonucleotide
  Target: ATXN1; (-) strand; PAM type: NRG; PAM sequence: TGG
agatattaacatggtttacc

SEQ ID NO: 72343 - DNA, 20 bp, Artificial Sequence
  Description of Artificial Sequence: Synthetic oligonucleotide
  Target: ATXN1; (-) strand; PAM type: NRG; PAM sequence: TGG
attaaccctagatattaaca

SEQ ID NO: 72344 - DNA, 20 bp, Artificial Sequence
  Description of Artificial Sequence: Synthetic oligonucleotide
  Target: ATXN1; (-) strand; PAM type: NRG; PAM sequence: TAG
taaagagactttattaaccc

SEQ ID NO: 72345 - DNA, 20 bp, Artificial Sequence
  Description of Artificial Sequence: Synthetic oligonucleotide
  Target: ATXN1; (-) strand; PAM type: NRG; PAM sequence: GAG
agactttattaacatttaaa

SEQ ID NO: 72346 - DNA, 20 bp, Artificial Sequence
  Description of Artificial Sequence: Synthetic oligonucleotide
  Target: ATXN1; (-) strand; PAM type: NRG; PAM sequence: AAG
agagactttattaacattta

SEQ ID NO: 72347 - DNA, 20 bp, Artificial Sequence
  Description of Artificial Sequence: Synthetic oligonucleotide
  Target: ATXN1; (-) strand; PAM type: NRG; PAM sequence: GAG
agggctgaacattttatgga

SEQ ID NO: 72348 - DNA, 20 bp, Artificial Sequence
  Description of Artificial Sequence: Synthetic oligonucleotide
  Target: ATXN1; (-) strand; PAM type: NRG; PAM sequence: GAG
tcagggctgaacattttatg

SEQ ID NO: 72349 - DNA, 20 bp, Artificial Sequence
  Description of Artificial Sequence: Synthetic oligonucleotide
  Target: ATXN1; (-) strand; PAM type: NRG; PAM sequence: TGG
cttcagggctgaacatttta

SEQ ID NO: 72350 - DNA, 20 bp, Artificial Sequence
  Description of Artificial Sequence: Synthetic oligonucleotide
  Target: ATXN1; (-) strand; PAM type: NRG; PAM sequence: GGG
tcatttgttctgtgtcttca

SEQ ID NO: 72351 - DNA, 20 bp, Artificial Sequence
  Description of Artificial Sequence: Synthetic oligonucleotide
  Target: ATXN1; (-) strand; PAM type: NRG; PAM sequence: AGG
atcatttgttctgtgtcttc

SEQ ID NO: 72352 - DNA, 20 bp, Artificial Sequence
  Description of Artificial Sequence: Synthetic oligonucleotide
  Target: ATXN1; (-) strand; PAM type: NRG; PAM sequence: CAG
tatcatttgttctgtgtctt

SEQ ID NO: 72353 - DNA, 20 bp, Artificial Sequence
  Description of Artificial Sequence: Synthetic oligonucleotide
  Target: ATXN1; (-) strand; PAM type: NRG; PAM sequence: TAG
agctgatactccattgacca

SEQ ID NO: 72354 - DNA, 20 bp, Artificial Sequence
  Description of Artificial Sequence: Synthetic oligonucleotide
  Target: ATXN1; (-) strand; PAM type: NRG; PAM sequence: TAG
cagtagaagtttatatttta

SEQ ID NO: 72355 - DNA, 20 bp, Artificial Sequence
  Description of Artificial Sequence: Synthetic oligonucleotide
  Target: ATXN1; (-) strand; PAM type: NRG; PAM sequence: AAG
ggatgtgctttcctcagtag

SEQ ID NO: 72356 - DNA, 20 bp, Artificial Sequence
  Description of Artificial Sequence: Synthetic oligonucleotide
  Target: ATXN1; (-) strand; PAM type: NRG; PAM sequence: TAG
gccggatgtgctttcctcag

SEQ ID NO: 72357 - DNA, 20 bp, Artificial Sequence
  Description of Artificial Sequence: Synthetic oligonucleotide
  Target: ATXN1; (-) strand; PAM type: NRG; PAM sequence: CAG
cttgccggatgtgctttcct

SEQ ID NO: 72358 - DNA, 20 bp, Artificial Sequence
  Description of Artificial Sequence: Synthetic oligonucleotide
  Target: ATXN1; (-) strand; PAM type: NRG; PAM sequence: CGG
gtgggctattttacacttgc

SEQ ID NO: 72359 - DNA, 20 bp, Artificial Sequence
  Description of Artificial Sequence: Synthetic oligonucleotide
  Target: ATXN1; (-) strand; PAM type: NRG; PAM sequence: GGG
tcatggaaattggacccagt

SEQ ID NO: 72360 - DNA, 20 bp, Artificial Sequence
  Description of Artificial Sequence: Synthetic oligonucleotide
  Target: ATXN1; (-) strand; PAM type: NRG; PAM sequence: TGG
ttcatggaaattggacccag

SEQ ID NO: 72361 - DNA, 20 bp, Artificial Sequence
  Description of Artificial Sequence: Synthetic oligonucleotide
  Target: ATXN1; (-) strand; PAM type: NRG; PAM sequence: CAG
ctcttcatggaaattggacc

SEQ ID NO: 72362 - DNA, 20 bp, Artificial Sequence
  Description of Artificial Sequence: Synthetic oligonucleotide
  Target: ATXN1; (-) strand; PAM type: NRG; PAM sequence: TGG
tggcacctcttcatggaaat

SEQ ID NO: 72363 - DNA, 20 bp, Artificial Sequence
  Description of Artificial Sequence: Synthetic oligonucleotide
  Target: ATXN1; (-) strand; PAM type: NRG; PAM sequence: TGG
atggagctggcacctcttca

SEQ ID NO: 72364 - DNA, 20 bp, Artificial Sequence
  Description of Artificial Sequence: Synthetic oligonucleotide
  Target: ATXN1; (-) strand; PAM type: NRG; PAM sequence: TGG
ttgtacataccaaatggagc

SEQ ID NO: 72365 - DNA, 20 bp, Artificial Sequence
  Description of Artificial Sequence: Synthetic oligonucleotide
  Target: ATXN1; (-) strand; PAM type: NRG; PAM sequence: GAG
tagattgtacataccaaatg

SEQ ID NO: 72366 - DNA, 20 bp, Artificial Sequence
  Description of Artificial Sequence: Synthetic oligonucleotide
  Target: ATXN1; (-) strand; PAM type: NRG; PAM sequence: TGG
tgtagattgtacataccaaa

SEQ ID NO: 72367 - DNA, 20 bp, Artificial Sequence
  Description of Artificial Sequence: Synthetic oligonucleotide
  Target: ATXN1; (-) strand; PAM type: NRG; PAM sequence: TAG
atagtgcttggattcatttg

SEQ ID NO: 72368 - DNA, 20 bp, Artificial Sequence
  Description of Artificial Sequence: Synthetic oligonucleotide
  Target: ATXN1; (-) strand; PAM type: NRG; PAM sequence: TGG
ttaacagttctgatagtgct

SEQ ID NO: 72369 - DNA, 20 bp, Artificial Sequence
  Description of Artificial Sequence: Synthetic oligonucleotide
  Target: ATXN1; (-) strand; PAM type: NRG; PAM sequence: TAG
catgcagttaacagttctga

SEQ ID NO: 72370 - DNA, 20 bp, Artificial Sequence
  Description of Artificial Sequence: Synthetic oligonucleotide
  Target: ATXN1; (-) strand; PAM type: NRG; PAM sequence: CAG
atccagagtcatgcagttaa

SEQ ID NO: 72371 - DNA, 20 bp, Artificial Sequence
  Description of Artificial Sequence: Synthetic oligonucleotide
  Target: ATXN1; (-) strand; PAM type: NRG; PAM sequence: CAG
ccctaccatccagagtcatg

SEQ ID NO: 72372 - DNA, 20 bp, Artificial Sequence
  Description of Artificial Sequence: Synthetic oligonucleotide
  Target: ATXN1; (-) strand; PAM type: NRG; PAM sequence: GAG
ttccctccccctaccatcca

SEQ ID NO: 72373 - DNA, 20 bp, Artificial Sequence
  Description of Artificial Sequence: Synthetic oligonucleotide
  Target: ATXN1; (-) strand; PAM type: NRG; PAM sequence: CAG
ccttccctccccctaccatc

SEQ ID NO: 72374 - DNA, 20 bp, Artificial Sequence
  Description of Artificial Sequence: Synthetic oligonucleotide
  Target: ATXN1; (-) strand; PAM type: NRG; PAM sequence: GAG
atcctttttctctctttttt

SEQ ID NO: 72375 - DNA, 20 bp, Artificial Sequence
  Description of Artificial Sequence: Synthetic oligonucleotide
  Target: ATXN1; (-) strand; PAM type: NRG; PAM sequence: CAG
tataatctgctctcaatttc

SEQ ID NO: 72376 - DNA, 20 bp, Artificial Sequence
  Description of Artificial Sequence: Synthetic oligonucleotide
  Target: ATXN1; (-) strand; PAM type: NRG; PAM sequence: AAG
tttcacatagagatacatga

SEQ ID NO: 72377 - DNA, 20 bp, Artificial Sequence
  Description of Artificial Sequence: Synthetic oligonucleotide
  Target: ATXN1; (-) strand; PAM type: NRG; PAM sequence: GAG
taggctatttttttcacata

SEQ ID NO: 72378 - DNA, 20 bp, Artificial Sequence
  Description of Artificial Sequence: Synthetic oligonucleotide
  Target: ATXN1; (-) strand; PAM type: NRG; PAM sequence: TAG
tctaggctatttttttcaca

SEQ ID NO: 72379 - DNA, 20 bp, Artificial Sequence
  Description of Artificial Sequence: Synthetic oligonucleotide
  Target: ATXN1; (-) strand; PAM type: NRG; PAM sequence: AGG
gttggagtttacagatttct

SEQ ID NO: 72380 - DNA, 20 bp, Artificial Sequence
  Description of Artificial Sequence: Synthetic oligonucleotide
  Target: ATXN1; (-) strand; PAM type: NRG; PAM sequence: TAG
agttggagtttacagatttc

SEQ ID NO: 72381 - DNA, 20 bp, Artificial Sequence
  Description of Artificial Sequence: Synthetic oligonucleotide
  Target: ATXN1; (-) strand; PAM type: NRG; PAM sequence: CAG
ttatgacaagttggagttta

SEQ ID NO: 72382 - DNA, 20 bp, Artificial Sequence
  Description of Artificial Sequence: Synthetic oligonucleotide
  Target: ATXN1; (-) strand; PAM type: NRG; PAM sequence: GAG
ttatgttttatgacaagttg

SEQ ID NO: 72383 - DNA, 20 bp, Artificial Sequence
  Description of Artificial Sequence: Synthetic oligonucleotide
  Target: ATXN1; (-) strand; PAM type: NRG; PAM sequence: TGG
atttatgttttatgacaagt

SEQ ID NO: 72384 - DNA, 20 bp, Artificial Sequence
  Description of Artificial Sequence: Synthetic oligonucleotide
  Target: ATXN1; (-) strand; PAM type: NRG; PAM sequence: AAG
acggatttatgttttatgac

SEQ ID NO: 72385 - DNA, 20 bp, Artificial Sequence
  Description of Artificial Sequence: Synthetic oligonucleotide
  Target: ATXN1; (-) strand; PAM type: NRG; PAM sequence: CGG
ttataagtcattaagtgtca

SEQ ID NO: 72386 - DNA, 20 bp, Artificial Sequence
  Description of Artificial Sequence: Synthetic oligonucleotide
  Target: ATXN1; (-) strand; PAM type: NRG; PAM sequence: AAG
attgtagattataagtcatt

SEQ ID NO: 72387 - DNA, 20 bp, Artificial Sequence
  Description of Artificial Sequence: Synthetic oligonucleotide
  Target: ATXN1; (-) strand; PAM type: NRG; PAM sequence: AAG
aaatgttaattgtagattat

SEQ ID NO: 72388 - DNA, 20 bp, Artificial Sequence
  Description of Artificial Sequence: Synthetic oligonucleotide
  Target: ATXN1; (-) strand; PAM type: NRG; PAM sequence: TAG
aaaacatgaaatgttaattg

SEQ ID NO: 72389 - DNA, 20 bp, Artificial Sequence
  Description of Artificial Sequence: Synthetic oligonucleotide
  Target: ATXN1; (-) strand; PAM type: NRG; PAM sequence: TGG
ggcattgtatttcttatatc

SEQ ID NO: 72390 - DNA, 20 bp, Artificial Sequence
  Description of Artificial Sequence: Synthetic oligonucleotide
  Target: ATXN1; (-) strand; PAM type: NRG; PAM sequence: GGG
acccaagcaaaaacagaata

SEQ ID NO: 72391 - DNA, 20 bp, Artificial Sequence
  Description of Artificial Sequence: Synthetic oligonucleotide
  Target: ATXN1; (-) strand; PAM type: NRG; PAM sequence: AGG
cacccaagcaaaaacagaat

SEQ ID NO: 72392 - DNA, 20 bp, Artificial Sequence
  Description of Artificial Sequence: Synthetic oligonucleotide
  Target: ATXN1; (-) strand; PAM type: NRG; PAM sequence: TAG
tcacccaagcaaaaacagaa

SEQ ID NO: 72393 - DNA, 20 bp, Artificial Sequence
  Description of Artificial Sequence: Synthetic oligonucleotide
  Target: ATXN1; (-) strand; PAM type: NRG; PAM sequence: CAG
tagcctcacccaagcaaaaa

SEQ ID NO: 72394 - DNA, 20 bp, Artificial Sequence
  Description of Artificial Sequence: Synthetic oligonucleotide
  Target: ATXN1; (-) strand; PAM type: NRG; PAM sequence: AAG
tgagttttttagcctcaccc

SEQ ID NO: 72395 - DNA, 20 bp, Artificial Sequence
  Description of Artificial Sequence: Synthetic oligonucleotide
  Target: ATXN1; (-) strand; PAM type: NRG; PAM sequence: TAG
catggtggtactgagttttt

SEQ ID NO: 72396 - DNA, 20 bp, Artificial Sequence
  Description of Artificial Sequence: Synthetic oligonucleotide
  Target: ATXN1; (-) strand; PAM type: NRG; PAM sequence: GAG
acaaaaaacatggtggtact

SEQ ID NO: 72397 - DNA, 20 bp, Artificial Sequence
  Description of Artificial Sequence: Synthetic oligonucleotide
  Target: ATXN1; (-) strand; PAM type: NRG; PAM sequence: TGG
tgaccctacaaaaaacatgg

SEQ ID NO: 72398 - DNA, 20 bp, Artificial Sequence
  Description of Artificial Sequence: Synthetic oligonucleotide
  Target: ATXN1; (-) strand; PAM type: NRG; PAM sequence: TGG
ctttgaccctacaaaaaaca

SEQ ID NO: 72399 - DNA, 20 bp, Artificial Sequence
  Description of Artificial Sequence: Synthetic oligonucleotide
  Target: ATXN1; (-) strand; PAM type: NRG; PAM sequence: TAG
tattaattaaggggatctct

SEQ ID NO: 72400 - DNA, 20 bp, Artificial Sequence
  Description of Artificial Sequence: Synthetic oligonucleotide
  Target: ATXN1; (-) strand; PAM type: NRG; PAM sequence: GGG
aacaaaaattattaattaag

SEQ ID NO: 72401 - DNA, 20 bp, Artificial Sequence
  Description of Artificial Sequence: Synthetic oligonucleotide
  Target: ATXN1; (-) strand; PAM type: NRG; PAM sequence: GGG
caacaaaaattattaattaa

SEQ ID NO: 72402 - DNA, 20 bp, Artificial Sequence
  Description of Artificial Sequence: Synthetic oligonucleotide
  Target: ATXN1; (-) strand; PAM type: NRG; PAM sequence: AGG
ccaacaaaaattattaatta

SEQ ID NO: 72403 - DNA, 20 bp, Artificial Sequence
  Description of Artificial Sequence: Synthetic oligonucleotide
  Target: ATXN1; (-) strand; PAM type: NRG; PAM sequence: AAG
gccaacaaaaattattaatt

SEQ ID NO: 72404 - DNA, 20 bp, Artificial Sequence
  Description of Artificial Sequence: Synthetic oligonucleotide
  Target: ATXN1; (-) strand; PAM type: NRG; PAM sequence: GAG
caggagtttgggggaatcca

SEQ ID NO: 72405 - DNA, 20 bp, Artificial Sequence
  Description of Artificial Sequence: Synthetic oligonucleotide
  Target: ATXN1; (-) strand; PAM type: NRG; PAM sequence: CAG
tgcaggagtttgggggaatc

SEQ ID NO: 72406 - DNA, 20 bp, Artificial Sequence
  Description of Artificial Sequence: Synthetic oligonucleotide
  Target: ATXN1; (-) strand; PAM type: NRG; PAM sequence: GGG
ccaatgctgcaggagtttgg

SEQ ID NO: 72407 - DNA, 20 bp, Artificial Sequence
  Description of Artificial Sequence: Synthetic oligonucleotide
  Target: ATXN1; (-) strand; PAM type: NRG; PAM sequence: GGG
accaatgctgcaggagtttg

SEQ ID NO: 72408 - DNA, 20 bp, Artificial Sequence
  Description of Artificial Sequence: Synthetic oligonucleotide
  Target: ATXN1; (-) strand; PAM type: NRG; PAM sequence: GGG
caccaatgctgcaggagttt

SEQ ID NO: 72409 - DNA, 20 bp, Artificial Sequence
  Description of Artificial Sequence: Synthetic oligonucleotide
  Target: ATXN1; (-) strand; PAM type: NRG; PAM sequence: TGG
acaccaatgctgcaggagtt

SEQ ID NO: 72410 - DNA, 20 bp, Artificial Sequence
  Description of Artificial Sequence: Synthetic oligonucleotide
  Target: ATXN1; (-) strand; PAM type: NRG; PAM sequence: GAG
aagttacaccaatgctgcag

SEQ ID NO: 72411 - DNA, 20 bp, Artificial Sequence
  Description of Artificial Sequence: Synthetic oligonucleotide
  Target: ATXN1; (-) strand; PAM type: NRG; PAM sequence: AGG
agaagttacaccaatgctgc

SEQ ID NO: 72412 - DNA, 20 bp, Artificial Sequence
  Description of Artificial Sequence: Synthetic oligonucleotide
  Target: ATXN1; (-) strand; PAM type: NRG; PAM sequence: CAG
tagaagttacaccaatgctg

SEQ ID NO: 72413 - DNA, 20 bp, Artificial Sequence
  Description of Artificial Sequence: Synthetic oligonucleotide
  Target: ATXN1; (-) strand; PAM type: NRG; PAM sequence: AAG
aatgttatgagagtagctag

SEQ ID NO: 72414 - DNA, 20 bp, Artificial Sequence
  Description of Artificial Sequence: Synthetic oligonucleotide
  Target: ATXN1; (-) strand; PAM type: NRG; PAM sequence: TAG
agcaatgttatgagagtagc

SEQ ID NO: 72415 - DNA, 20 bp, Artificial Sequence
  Description of Artificial Sequence: Synthetic oligonucleotide
  Target: ATXN1; (-) strand; PAM type: NRG; PAM sequence: TAG
ttacagcaatgttatgagag

SEQ ID NO: 72416 - DNA, 20 bp, Artificial Sequence
  Description of Artificial Sequence: Synthetic oligonucleotide
  Target: ATXN1; (-) strand; PAM type: NRG; PAM sequence: GAG
agattacagcaatgttatga

SEQ ID NO: 72417 - DNA, 20 bp, Artificial Sequence
  Description of Artificial Sequence: Synthetic oligonucleotide
  Target: ATXN1; (-) strand; PAM type: NRG; PAM sequence: GAG
tgagattacagcaatgttat

SEQ ID NO: 72418 - DNA, 20 bp, Artificial Sequence
  Description of Artificial Sequence: Synthetic oligonucleotide
  Target: ATXN1; (-) strand; PAM type: NRG; PAM sequence: CAG
agcccaggagtttgagatta

SEQ ID NO: 72419 - DNA, 20 bp, Artificial Sequence
  Description of Artificial Sequence: Synthetic oligonucleotide
  Target: ATXN1; (-) strand; PAM type: NRG; PAM sequence: GAG
tcgcttgagcccaggagttt

SEQ ID NO: 72420 - DNA, 20 bp, Artificial Sequence
  Description of Artificial Sequence: Synthetic oligonucleotide
  Target: ATXN1; (-) strand; PAM type: NRG; PAM sequence: GAG
ggaggatcgcttgagcccag

SEQ ID NO: 72421 - DNA, 20 bp, Artificial Sequence
  Description of Artificial Sequence: Synthetic oligonucleotide
  Target: ATXN1; (-) strand; PAM type: NRG; PAM sequence: AGG
cgggaggatcgcttgagccc

SEQ ID NO: 72422 - DNA, 20 bp, Artificial Sequence
  Description of Artificial Sequence: Synthetic oligonucleotide
  Target: ATXN1; (-) strand; PAM type: NRG; PAM sequence: CAG
gcgggaggatcgcttgagcc

SEQ ID NO: 72423 - DNA, 20 bp, Artificial Sequence
  Description of Artificial Sequence: Synthetic oligonucleotide
  Target: ATXN1; (-) strand; PAM type: NRG; PAM sequence: GAG
ctgaggcgggaggatcgctt

SEQ ID NO: 72424 - DNA, 20 bp, Artificial Sequence
  Description of Artificial Sequence: Synthetic oligonucleotide
  Target: ATXN1; (-) strand; PAM type: NRG; PAM sequence: AGG
actctggaggctgaggcggg

SEQ ID NO: 72425 - DNA, 20 bp, Artificial Sequence
  Description of Artificial Sequence: Synthetic oligonucleotide
  Target: ATXN1; (-) strand; PAM type: NRG; PAM sequence: GAG
tactctggaggctgaggcgg

SEQ ID NO: 72426 - DNA, 20 bp, Artificial Sequence
  Description of Artificial Sequence: Synthetic oligonucleotide
  Target: ATXN1; (-) strand; PAM type: NRG; PAM sequence: GGG
gctactctggaggctgaggc

SEQ ID NO: 72427 - DNA, 20 bp, Artificial Sequence
  Description of Artificial Sequence: Synthetic oligonucleotide
  Target: ATXN1; (-) strand; PAM type: NRG; PAM sequence: CGG
agctactctggaggctgagg

SEQ ID NO: 72428 - DNA, 20 bp, Artificial Sequence
  Description of Artificial Sequence: Synthetic oligonucleotide
  Target: ATXN1; (-) strand; PAM type: NRG; PAM sequence: AGG
tccagctactctggaggctg

SEQ ID NO: 72429 - DNA, 20 bp, Artificial Sequence
  Description of Artificial Sequence: Synthetic oligonucleotide
  Target: ATXN1; (-) strand; PAM type: NRG; PAM sequence: GAG
gtccagctactctggaggct

SEQ ID NO: 72430 - DNA, 20 bp, Artificial Sequence
  Description of Artificial Sequence: Synthetic oligonucleotide
  Target: ATXN1; (-) strand; PAM type: NRG; PAM sequence: AGG
ttatagtccagctactctgg

SEQ ID NO: 72431 - DNA, 20 bp, Artificial Sequence
  Description of Artificial Sequence: Synthetic oligonucleotide
  Target: ATXN1; (-) strand; PAM type: NRG; PAM sequence: GAG
cttatagtccagctactctg

SEQ ID NO: 72432 - DNA, 20 bp, Artificial Sequence
  Description of Artificial Sequence: Synthetic oligonucleotide
  Target: ATXN1; (-) strand; PAM type: NRG; PAM sequence: TGG
tgcttatagtccagctactc

SEQ ID NO: 72433 - DNA, 20 bp, Artificial Sequence
  Description of Artificial Sequence: Synthetic oligonucleotide
  Target: ATXN1; (-) strand; PAM type: NRG; PAM sequence: CAG
ggtgagatgtgcttatagtc

SEQ ID NO: 72434 - DNA, 20 bp, Artificial Sequence
  Description of Artificial Sequence: Synthetic oligonucleotide
  Target: ATXN1; (-) strand; PAM type: NRG; PAM sequence: TAG
ggcatggtgagatgtgctta

SEQ ID NO: 72435 - DNA, 20 bp, Artificial Sequence
  Description of Artificial Sequence: Synthetic oligonucleotide
  Target: ATXN1; (-) strand; PAM type: NRG; PAM sequence: GAG
tttaattggccaggcatggt

SEQ ID NO: 72436 - DNA, 20 bp, Artificial Sequence
  Description of Artificial Sequence: Synthetic oligonucleotide
  Target: ATXN1; (-) strand; PAM type: NRG; PAM sequence: TGG
gttttttaattggccaggca

SEQ ID NO: 72437 - DNA, 20 bp, Artificial Sequence
  Description of Artificial Sequence: Synthetic oligonucleotide
  Target: ATXN1; (-) strand; PAM type: NRG; PAM sequence: AGG
tgtttgttttttaattggcc

SEQ ID NO: 72438 - DNA, 20 bp, Artificial Sequence
  Description of Artificial Sequence: Synthetic oligonucleotide
  Target: ATXN1; (-) strand; PAM type: NRG; PAM sequence: CAG
ttgtttgttttttaattggc

SEQ ID NO: 72439 - DNA, 20 bp, Artificial Sequence
  Description of Artificial Sequence: Synthetic oligonucleotide
  Target: ATXN1; (-) strand; PAM type: NRG; PAM sequence: TGG
ttgtttgtttgttttttaat

SEQ ID NO: 72440 - DNA, 20 bp, Artificial Sequence
  Description of Artificial Sequence: Synthetic oligonucleotide
  Target: ATXN1; (-) strand; PAM type: NRG; PAM sequence: CAG
cagtcgtgagccaccgcgcc

SEQ ID NO: 72441 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacagtcgt

SEQ ID NO: 72442 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 72443 - DNA, 20 bp, Artificial Sequence
  Description of Artificial Sequence: Synthetic oligonucleotide
  Target: ATXN1; (-) strand; PAM type: NRG; PAM sequence: GGG
ccgtggcctcccaaagtgct

SEQ ID NO: 72444 - DNA, 20 bp, Artificial Sequence
  Description of Artificial Sequence: Synthetic oligonucleotide
  Target: ATXN1; (-) strand; PAM type: NRG; PAM sequence: TGG
gccgtggcctcccaaagtgc

SEQ ID NO: 72445 - DNA, 20 bp, Artificial Sequence
  Description of Artificial Sequence: Synthetic oligonucleotide
  Target: ATXN1; (-) strand; PAM type: NRG; PAM sequence: AAG
ccgcccgccgtggcctccca

SEQ ID NO: 72446 - DNA, 20 bp, Artificial Sequence
  Description of Artificial Sequence: Synthetic oligonucleotide
  Target: ATXN1; (-) strand; PAM type: NRG; PAM sequence: TGG
acctcgtgatccgcccgccg

SEQ ID NO: 72447 - DNA, 20 bp, Artificial Sequence
  Description of Artificial Sequence: Synthetic oligonucleotide
  Target: ATXN1; (-) strand; PAM type: NRG; PAM sequence: TGG
tttcacagtgttcgccagga

SEQ ID NO: 72448 - DNA, 20 bp, Artificial Sequence
  Description of Artificial Sequence: Synthetic oligonucleotide
  Target: ATXN1; (-) strand; PAM type: NRG; PAM sequence: AGG
ggggtttcacagtgttcgcc

SEQ ID NO: 72449 - DNA, 20 bp, Artificial Sequence
  Description of Artificial Sequence: Synthetic oligonucleotide
  Target: ATXN1; (-) strand; PAM type: NRG; PAM sequence: CAG
cggggtttcacagtgttcgc

SEQ ID NO: 72450 - DNA, 20 bp, Artificial Sequence
  Description of Artificial Sequence: Synthetic oligonucleotide
  Target: ATXN1; (-) strand; PAM type: NRG; PAM sequence: CAG
ttagtagagacggggtttca

SEQ ID NO: 72451 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagacg

SEQ ID NO: 72452 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 72453 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 72454 - DNA, 20 bp, Artificial Sequence
  Description of Artificial Sequence: Synthetic oligonucleotide
  Target: ATXN1; (-) strand; PAM type: NRG; PAM sequence: GAG
ttttttttgtatttttagta

SEQ ID NO: 72455 - DNA, 20 bp, Artificial Sequence
  Description of Artificial Sequence: Synthetic oligonucleotide
  Target: ATXN1; (-) strand; PAM type: NRG; PAM sequence: TAG
atttttttttgtatttttag

SEQ ID NO: 72456 - DNA, 20 bp, Artificial Sequence
  Description of Artificial Sequence: Synthetic oligonucleotide
  Target: ATXN1; (-) strand; PAM type: NRG; PAM sequence: TAG
ctaatttttttttgtatttt

SEQ ID NO: 72457 - DNA, 20 bp, Artificial Sequence
  Description of Artificial Sequence: Synthetic oligonucleotide
  Target: ATXN1; (-) strand; PAM type: NRG; PAM sequence: CGG
caggaacccaccaccatgcc

SEQ ID NO: 72458 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgagattac

SEQ ID NO: 72459 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgagatta

SEQ ID NO: 72460 - DNA, 20 bp, Artificial Sequence
  Description of Artificial Sequence: Synthetic oligonucleotide
  Target: ATXN1; (-) strand; PAM type: NRG; PAM sequence: GAG
cctcagcctcccgagtagct

SEQ ID NO: 72461 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 72462 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 72463 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcct

SEQ ID NO: 72464 - DNA, 20 bp, Artificial Sequence
  Description of Artificial Sequence: Synthetic oligonucleotide
  Target: ATXN1; (-) strand; PAM type: NRG; PAM sequence: AAG
aacctttgcctcccagattc

SEQ ID NO: 72465 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctttgcctcc

SEQ ID NO: 72466 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggtgtgatct

SEQ ID NO: 72467 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcag

SEQ ID NO: 72468 - DNA, 20 bp, Artificial Sequence
  Description of Artificial Sequence: Synthetic oligonucleotide
  Target: ATXN1; (-) strand; PAM type: NRG; PAM sequence: CAG
ctgttgcccaggctggagtg

SEQ ID NO: 72469 - DNA, 20 bp, Artificial Sequence
  Description of Artificial Sequence: Synthetic oligonucleotide
  Target: ATXN1; (-) strand; PAM type: NRG; PAM sequence: GAG
tcactctgttgcccaggctg

SEQ ID NO: 72470 - DNA, 20 bp, Artificial Sequence
  Description of Artificial Sequence: Synthetic oligonucleotide
  Target: ATXN1; (-) strand; PAM type: NRG; PAM sequence: TGG
tctcactctgttgcccaggc

SEQ ID NO: 72471 - DNA, 20 bp, Artificial Sequence
  Description of Artificial Sequence: Synthetic oligonucleotide
  Target: ATXN1; (-) strand; PAM type: NRG; PAM sequence: AGG
ggagtctcactctgttgccc

SEQ ID NO: 72472 - DNA, 20 bp, Artificial Sequence
  Description of Artificial Sequence: Synthetic oligonucleotide
  Target: ATXN1; (-) strand; PAM type: NRG; PAM sequence: CAG
cggagtctcactctgttgcc

SEQ ID NO: 72473 - DNA, 20 bp, Artificial Sequence
  Description of Artificial Sequence: Synthetic oligonucleotide
  Target: ATXN1; (-) strand; PAM type: NRG; PAM sequence: GAG
ttgttgttgtttttgagacg

SEQ ID NO: 72474 - DNA, 20 bp, Artificial Sequence
  Description of Artificial Sequence: Synthetic oligonucleotide
  Target: ATXN1; (-) strand; PAM type: NRG; PAM sequence: CGG
tgttgttgttgtttttgaga

SEQ ID NO: 72475 - DNA, 20 bp, Artificial Sequence
  Description of Artificial Sequence: Synthetic oligonucleotide
  Target: ATXN1; (-) strand; PAM type: NRG; PAM sequence: GAG
ttgttgttgttgttgttttt

SEQ ID NO: 72476 - DNA, 20 bp, Artificial Sequence
  Description of Artificial Sequence: Synthetic oligonucleotide
  Target: ATXN1; (-) strand; PAM type: NRG; PAM sequence: AGG
ctagcctaggcaacacagtg

SEQ ID NO: 72477 - DNA, 20 bp, Artificial Sequence
  Description of Artificial Sequence: Synthetic oligonucleotide
  Target: ATXN1; (-) strand; PAM type: NRG; PAM sequence: GAG
actagcctaggcaacacagt

SEQ ID NO: 72478 - DNA, 20 bp, Artificial Sequence
  Description of Artificial Sequence: Synthetic oligonucleotide
  Target: ATXN1; (-) strand; PAM type: NRG; PAM sequence: CAG
tgagactagcctaggcaaca

SEQ ID NO: 72479 - DNA, 20 bp, Artificial Sequence
  Description of Artificial Sequence: Synthetic oligonucleotide
  Target: ATXN1; (-) strand; PAM type: NRG; PAM sequence: AGG
caggagtttgagactagcct

SEQ ID NO: 72480 - DNA, 20 bp, Artificial Sequence
  Description of Artificial Sequence: Synthetic oligonucleotide
  Target: ATXN1; (-) strand; PAM type: NRG; PAM sequence: TAG
ccaggagtttgagactagcc

SEQ ID NO: 72481 - DNA, 20 bp, Artificial Sequence
  Description of Artificial Sequence: Synthetic oligonucleotide
  Target: ATXN1; (-) strand; PAM type: NRG; PAM sequence: TAG
cgatgccaggagtttgagac

SEQ ID NO: 72482 - DNA, 20 bp, Artificial Sequence
  Description of Artificial Sequence: Synthetic oligonucleotide
  Target: ATXN1; (-) strand; PAM type: NRG; PAM sequence: GAG
acttacgatgccaggagttt

SEQ ID NO: 72483 - DNA, 20 bp, Artificial Sequence
  Description of Artificial Sequence: Synthetic oligonucleotide
  Target: ATXN1; (-) strand; PAM type: NRG; PAM sequence: GAG
aagacaacttacgatgccag

SEQ ID NO: 72484 - DNA, 20 bp, Artificial Sequence
  Description of Artificial Sequence: Synthetic oligonucleotide
  Target: ATXN1; (-) strand; PAM type: NRG; PAM sequence: AGG
gaaagacaacttacgatgcc

SEQ ID NO: 72485 - DNA, 20 bp, Artificial Sequence
  Description of Artificial Sequence: Synthetic oligonucleotide
  Target: ATXN1; (-) strand; PAM type: NRG; PAM sequence: CAG
tgaaagacaacttacgatgc

SEQ ID NO: 72486 - DNA, 20 bp, Artificial Sequence
  Description of Artificial Sequence: Synthetic oligonucleotide
  Target: ATXN1; (-) strand; PAM type: NRG; PAM sequence: AAG
ttgaatgccaaagcatatga

SEQ ID NO: 72487 - DNA, 20 bp, Artificial Sequence
  Description of Artificial Sequence: Synthetic oligonucleotide
  Target: ATXN1; (-) strand; PAM type: NRG; PAM sequence: AAG
ttactgagcattgaatgcca

SEQ ID NO: 72488 - DNA, 20 bp, Artificial Sequence
  Description of Artificial Sequence: Synthetic oligonucleotide
  Target: ATXN1; (-) strand; PAM type: NRG; PAM sequence: GAG
aatatgctcaggttgttact

SEQ ID NO: 72489 - DNA, 20 bp, Artificial Sequence
  Description of Artificial Sequence: Synthetic oligonucleotide
  Target: ATXN1; (-) strand; PAM type: NRG; PAM sequence: AGG
cattataattaaatatgctc

SEQ ID NO: 72490 - DNA, 20 bp, Artificial Sequence
  Description of Artificial Sequence: Synthetic oligonucleotide
  Target: ATXN1; (-) strand; PAM type: NRG; PAM sequence: CAG
gcattataattaaatatgct

SEQ ID NO: 72491 - DNA, 20 bp, Artificial Sequence
  Description of Artificial Sequence: Synthetic oligonucleotide
  Target: ATXN1; (-) strand; PAM type: NRG; PAM sequence: AGG
tagagtactatttaaaggtg

SEQ ID NO: 72492 - DNA, 20 bp, Artificial Sequence
  Description of Artificial Sequence: Synthetic oligonucleotide
  Target: ATXN1; (-) strand; PAM type: NRG; PAM sequence: GAG
gtagagtactatttaaaggt

SEQ ID NO: 72493 - DNA, 20 bp, Artificial Sequence
  Description of Artificial Sequence: Synthetic oligonucleotide
  Target: ATXN1; (-) strand; PAM type: NRG; PAM sequence: AGG
aactgtagagtactatttaa

SEQ ID NO: 72494 - DNA, 20 bp, Artificial Sequence
  Description of Artificial Sequence: Synthetic oligonucleotide
  Target: ATXN1; (-) strand; PAM type: NRG; PAM sequence: AAG
gaactgtagagtactattta

SEQ ID NO: 72495 - DNA, 20 bp, Artificial Sequence
  Description of Artificial Sequence: Synthetic oligonucleotide
  Target: ATXN1; (-) strand; PAM type: NRG; PAM sequence: GAG
aaagcactttatgaactgta

SEQ ID NO: 72496 - DNA, 20 bp, Artificial Sequence
  Description of Artificial Sequence: Synthetic oligonucleotide
  Target: ATXN1; (-) strand; PAM type: NRG; PAM sequence: TAG
agaaagcactttatgaactg

SEQ ID NO: 72497 - DNA, 20 bp, Artificial Sequence
  Description of Artificial Sequence: Synthetic oligonucleotide
  Target: ATXN1; (-) strand; PAM type: NRG; PAM sequence: AAG
ggctacatcagtgtgaaaga

SEQ ID NO: 72498 - DNA, 20 bp, Artificial Sequence
  Description of Artificial Sequence: Synthetic oligonucleotide
  Target: ATXN1; (-) strand; PAM type: NRG; PAM sequence: AAG
ggaaggctacatcagtgtga

SEQ ID NO: 72499 - DNA, 20 bp, Artificial Sequence
  Description of Artificial Sequence: Synthetic oligonucleotide
  Target: ATXN1; (-) strand; PAM type: NRG; PAM sequence: CAG
taatacaaggaaggctacat

SEQ ID NO: 72500 - DNA, 20 bp, Artificial Sequence
  Description of Artificial Sequence: Synthetic oligonucleotide
  Target: ATXN1; (-) strand; PAM type: NRG; PAM sequence: AGG
gctgtgatttaatacaagga

SEQ ID NO: 72501 - DNA, 20 bp, Artificial Sequence
  Description of Artificial Sequence: Synthetic oligonucleotide
  Target: ATXN1; (-) strand; PAM type: NRG; PAM sequence: AAG
agctgtgatttaatacaagg

SEQ ID NO: 72502 - DNA, 20 bp, Artificial Sequence
  Description of Artificial Sequence: Synthetic oligonucleotide
  Target: ATXN1; (-) strand; PAM type: NRG; PAM sequence: AGG
caaagctgtgatttaataca

SEQ ID NO: 72503 - DNA, 20 bp, Artificial Sequence
  Description of Artificial Sequence: Synthetic oligonucleotide
  Target: ATXN1; (-) strand; PAM type: NRG; PAM sequence: AAG
gcaaagctgtgatttaatac

SEQ ID NO: 72504 - DNA, 20 bp, Artificial Sequence
  Description of Artificial Sequence: Synthetic oligonucleotide
  Target: ATXN1; (-) strand; PAM type: NRG; PAM sequence: AAG
tttgcaaaaattgaactgca

SEQ ID NO: 72505 - DNA, 20 bp, Artificial Sequence
  Description of Artificial Sequence: Synthetic oligonucleotide
  Target: ATXN1; (-) strand; PAM type: NRG; PAM sequence: GGG
attgacaagtacctttgaaa

SEQ ID NO: 72506 - DNA, 20 bp, Artificial Sequence
  Description of Artificial Sequence: Synthetic oligonucleotide
  Target: ATXN1; (-) strand; PAM type: NRG; PAM sequence: AGG
aattgacaagtacctttgaa

SEQ ID NO: 72507 - DNA, 20 bp, Artificial Sequence
  Description of Artificial Sequence: Synthetic oligonucleotide
  Target: ATXN1; (-) strand; PAM type: NRG; PAM sequence: AAG
taattgacaagtacctttga

SEQ ID NO: 72508 - DNA, 20 bp, Artificial Sequence
  Description of Artificial Sequence: Synthetic oligonucleotide
  Target: ATXN1; (-) strand; PAM type: NRG; PAM sequence: AAG
tttaatcttcattaattgac

SEQ ID NO: 72509 - DNA, 20 bp, Artificial Sequence
  Description of Artificial Sequence: Synthetic oligonucleotide
  Target: ATXN1; (-) strand; PAM type: NRG; PAM sequence: CAG
cagattgtcctcatagattc

SEQ ID NO: 72510 - DNA, 20 bp, Artificial Sequence
  Description of Artificial Sequence: Synthetic oligonucleotide
  Target: ATXN1; (-) strand; PAM type: NRG; PAM sequence: TAG
atccccccagattgtcctca

SEQ ID NO: 72511 - DNA, 20 bp, Artificial Sequence
  Description of Artificial Sequence: Synthetic oligonucleotide
  Target: ATXN1; (-) strand; PAM type: NRG; PAM sequence: CAG
agttggcagtcatatccccc

SEQ ID NO: 72512 - DNA, 20 bp, Artificial Sequence
  Description of Artificial Sequence: Synthetic oligonucleotide
  Target: ATXN1; (-) strand; PAM type: NRG; PAM sequence: CAG
tttctgccatcttcagttgg

SEQ ID NO: 72513 - DNA, 20 bp, Artificial Sequence
  Description of Artificial Sequence: Synthetic oligonucleotide
  Target: ATXN1; (-) strand; PAM type: NRG; PAM sequence: TGG
ttttttctgccatcttcagt

SEQ ID NO: 72514 - DNA, 20 bp, Artificial Sequence
  Description of Artificial Sequence: Synthetic oligonucleotide
  Target: ATXN1; (-) strand; PAM type: NRG; PAM sequence: CAG
catgttttttctgccatctt

SEQ ID NO: 72515 - DNA, 20 bp, Artificial Sequence
  Description of Artificial Sequence: Synthetic oligonucleotide
  Target: ATXN1; (-) strand; PAM type: NRG; PAM sequence: TGG
aactgtgagaataatttcaa

SEQ ID NO: 72516 - DNA, 20 bp, Artificial Sequence
  Description of Artificial Sequence: Synthetic oligonucleotide
  Target: ATXN1; (-) strand; PAM type: NRG; PAM sequence: GAG
ttctctactgtcaaaactgt

SEQ ID NO: 72517 - DNA, 20 bp, Artificial Sequence
  Description of Artificial Sequence: Synthetic oligonucleotide
  Target: ATXN1; (-) strand; PAM type: NRG; PAM sequence: TGG
cattttgtggtatcttttga

SEQ ID NO: 72518 - DNA, 20 bp, Artificial Sequence
  Description of Artificial Sequence: Synthetic oligonucleotide
  Target: ATXN1; (-) strand; PAM type: NRG; PAM sequence: TGG
ctttaattttatgcattttg

SEQ ID NO: 72519 - DNA, 20 bp, Artificial Sequence
  Description of Artificial Sequence: Synthetic oligonucleotide
  Target: ATXN1; (-) strand; PAM type: NRG; PAM sequence: AAG
aacagtactgcagcccatgc

SEQ ID NO: 72520 - DNA, 20 bp, Artificial Sequence
  Description of Artificial Sequence: Synthetic oligonucleotide
  Target: ATXN1; (-) strand; PAM type: NRG; PAM sequence: CAG
ttctgtttaaaacagtactg

SEQ ID NO: 72521 - DNA, 20 bp, Artificial Sequence
  Description of Artificial Sequence: Synthetic oligonucleotide
  Target: ATXN1; (-) strand; PAM type: NRG; PAM sequence: CAG
tctttcccttctgtttaaaa

SEQ ID NO: 72522 - DNA, 20 bp, Artificial Sequence
  Description of Artificial Sequence: Synthetic oligonucleotide
  Target: ATXN1; (-) strand; PAM type: NRG; PAM sequence: TGG
tgaataccagtcatgtttaa

SEQ ID NO: 72523 - DNA, 20 bp, Artificial Sequence
  Description of Artificial Sequence: Synthetic oligonucleotide
  Target: ATXN1; (-) strand; PAM type: NRG; PAM sequence: CAG
agttaaaatttagtgaatac

SEQ ID NO: 72524 - DNA, 20 bp, Artificial Sequence
  Description of Artificial Sequence: Synthetic oligonucleotide
  Target: ATXN1; (-) strand; PAM type: NRG; PAM sequence: TAG
atgccagtgtagttaaaatt

SEQ ID NO: 72525 - DNA, 20 bp, Artificial Sequence
  Description of Artificial Sequence: Synthetic oligonucleotide
  Target: ATXN1; (-) strand; PAM type: NRG; PAM sequence: TAG
ctcagactttgatgccagtg

SEQ ID NO: 72526 - DNA, 20 bp, Artificial Sequence
  Description of Artificial Sequence: Synthetic oligonucleotide
  Target: ATXN1; (-) strand; PAM type: NRG; PAM sequence: CAG
acaggctcagactttgatgc

SEQ ID NO: 72527 - DNA, 20 bp, Artificial Sequence
  Description of Artificial Sequence: Synthetic oligonucleotide
  Target: ATXN1; (-) strand; PAM type: NRG; PAM sequence: CAG
ctgacttgcactcacaggct

SEQ ID NO: 72528 - DNA, 20 bp, Artificial Sequence
  Description of Artificial Sequence: Synthetic oligonucleotide
  Target: ATXN1; (-) strand; PAM type: NRG; PAM sequence: AGG
ttattctgacttgcactcac

SEQ ID NO: 72529 - DNA, 20 bp, Artificial Sequence
  Description of Artificial Sequence: Synthetic oligonucleotide
  Target: ATXN1; (-) strand; PAM type: NRG; PAM sequence: CAG
gttattctgacttgcactca

SEQ ID NO: 72530 - DNA, 20 bp, Artificial Sequence
  Description of Artificial Sequence: Synthetic oligonucleotide
  Target: ATXN1; (-) strand; PAM type: NRG; PAM sequence: AAG
atttatttcagaataagcgc

SEQ ID NO: 72531 - DNA, 20 bp, Artificial Sequence
  Description of Artificial Sequence: Synthetic oligonucleotide
  Target: ATXN1; (-) strand; PAM type: NRG; PAM sequence: AAG
agaaacatttatttcagaat

SEQ ID NO: 72532 - DNA, 20 bp, Artificial Sequence
  Description of Artificial Sequence: Synthetic oligonucleotide
  Target: ATXN1; (-) strand; PAM type: NRG; PAM sequence: CAG
gtggaaagaaacatttattt

SEQ ID NO: 72533 - DNA, 20 bp, Artificial Sequence
  Description of Artificial Sequence: Synthetic oligonucleotide
  Target: ATXN1; (-) strand; PAM type: NRG; PAM sequence: AAG
acatgcacccttgcagtgga

SEQ ID NO: 72534 - DNA, 20 bp, Artificial Sequence
  Description of Artificial Sequence: Synthetic oligonucleotide
  Target: ATXN1; (-) strand; PAM type: NRG; PAM sequence: TGG
tcacacatgcacccttgcag

SEQ ID NO: 72535 - DNA, 20 bp, Artificial Sequence
  Description of Artificial Sequence: Synthetic oligonucleotide
  Target: ATXN1; (-) strand; PAM type: NRG; PAM sequence: CAG
ccctcacacatgcacccttg

SEQ ID NO: 72536 - DNA, 20 bp, Artificial Sequence
  Description of Artificial Sequence: Synthetic oligonucleotide
  Target: ATXN1; (-) strand; PAM type: NRG; PAM sequence: AAG
tgatgtgcttccatattaaa

SEQ ID NO: 72537 - DNA, 20 bp, Artificial Sequence
  Description of Artificial Sequence: Synthetic oligonucleotide
  Target: ATXN1; (-) strand; PAM type: NRG; PAM sequence: GGG
ttgtcagagttagattgtca

SEQ ID NO: 72538 - DNA, 20 bp, Artificial Sequence
  Description of Artificial Sequence: Synthetic oligonucleotide
  Target: ATXN1; (-) strand; PAM type: NRG; PAM sequence: AGG
cttgtcagagttagattgtc

SEQ ID NO: 72539 - DNA, 20 bp, Artificial Sequence
  Description of Artificial Sequence: Synthetic oligonucleotide
  Target: ATXN1; (-) strand; PAM type: NRG; PAM sequence: CAG
gcttgtcagagttagattgt

SEQ ID NO: 72540 - DNA, 20 bp, Artificial Sequence
  Description of Artificial Sequence: Synthetic oligonucleotide
  Target: ATXN1; (-) strand; PAM type: NRG; PAM sequence: TAG
ctatgcaagcttgtcagagt

SEQ ID NO: 72541 - DNA, 20 bp, Artificial Sequence
  Description of Artificial Sequence: Synthetic oligonucleotide
  Target: ATXN1; (-) strand; PAM type: NRG; PAM sequence: GAG
aggactatgcaagcttgtca

SEQ ID NO: 72542 - DNA, 20 bp, Artificial Sequence
  Description of Artificial Sequence: Synthetic oligonucleotide
  Target: ATXN1; (-) strand; PAM type: NRG; PAM sequence: CAG
ctaggactatgcaagcttgt

SEQ ID NO: 72543 - DNA, 20 bp, Artificial Sequence
  Description of Artificial Sequence: Synthetic oligonucleotide
  Target: ATXN1; (-) strand; PAM type: NRG; PAM sequence: AAG
tagaatgcctaggactatgc

SEQ ID NO: 72544 - DNA, 20 bp, Artificial Sequence
  Description of Artificial Sequence: Synthetic oligonucleotide
  Target: ATXN1; (-) strand; PAM type: NRG; PAM sequence: AGG
gaggtagaaatagaatgcct

SEQ ID NO: 72545 - DNA, 20 bp, Artificial Sequence
  Description of Artificial Sequence: Synthetic oligonucleotide
  Target: ATXN1; (-) strand; PAM type: NRG; PAM sequence: TAG
ggaggtagaaatagaatgcc

SEQ ID NO: 72546 - DNA, 20 bp, Artificial Sequence
  Description of Artificial Sequence: Synthetic oligonucleotide
  Target: ATXN1; (-) strand; PAM type: NRG; PAM sequence: TAG
gttctgttaggaggtagaaa

SEQ ID NO: 72547 - DNA, 20 bp, Artificial Sequence
  Description of Artificial Sequence: Synthetic oligonucleotide
  Target: ATXN1; (-) strand; PAM type: NRG; PAM sequence: TAG
gatgctgttctgttaggagg

SEQ ID NO: 72548 - DNA, 20 bp, Artificial Sequence
  Description of Artificial Sequence: Synthetic oligonucleotide
  Target: ATXN1; (-) strand; PAM type: NRG; PAM sequence: AGG
gctgatgctgttctgttagg

SEQ ID NO: 72549 - DNA, 20 bp, Artificial Sequence
  Description of Artificial Sequence: Synthetic oligonucleotide
  Target: ATXN1; (-) strand; PAM type: NRG; PAM sequence: GAG
tgctgatgctgttctgttag

SEQ ID NO: 72550 - DNA, 20 bp, Artificial Sequence
  Description of Artificial Sequence: Synthetic oligonucleotide
  Target: ATXN1; (-) strand; PAM type: NRG; PAM sequence: AGG
gttgctgatgctgttctgtt

SEQ ID NO: 72551 - DNA, 20 bp, Artificial Sequence
  Description of Artificial Sequence: Synthetic oligonucleotide
  Target: ATXN1; (-) strand; PAM type: NRG; PAM sequence: TAG
tgttgctgatgctgttctgt

SEQ ID NO: 72552 - DNA, 20 bp, Artificial Sequence
  Description of Artificial Sequence: Synthetic oligonucleotide
  Target: ATXN1; (-) strand; PAM type: NRG; PAM sequence: CAG
attgttagcagagcagctga

SEQ ID NO: 72553 - DNA, 20 bp, Artificial Sequence
  Description of Artificial Sequence: Synthetic oligonucleotide
  Target: ATXN1; (-) strand; PAM type: NRG; PAM sequence: CAG
atttctcattgttagcagag

SEQ ID NO: 72554 - DNA, 20 bp, Artificial Sequence
  Description of Artificial Sequence: Synthetic oligonucleotide
  Target: ATXN1; (-) strand; PAM type: NRG; PAM sequence: GAG
aaaatttctcattgttagca

SEQ ID NO: 72555 - DNA, 20 bp, Artificial Sequence
  Description of Artificial Sequence: Synthetic oligonucleotide
  Target: ATXN1; (-) strand; PAM type: NRG; PAM sequence: CAG
taaaaatttctcattgttag

SEQ ID NO: 72556 - DNA, 20 bp, Artificial Sequence
  Description of Artificial Sequence: Synthetic oligonucleotide
  Target: ATXN1; (-) strand; PAM type: NRG; PAM sequence: TAG
aagtaaaaatttctcattgt

SEQ ID NO: 72557 - DNA, 20 bp, Artificial Sequence
  Description of Artificial Sequence: Synthetic oligonucleotide
  Target: ATXN1; (-) strand; PAM type: NRG; PAM sequence: AAG
ggaacttactatccatatac

SEQ ID NO: 72558 - DNA, 20 bp, Artificial Sequence
  Description of Artificial Sequence: Synthetic oligonucleotide
  Target: ATXN1; (-) strand; PAM type: NRG; PAM sequence: GGG
cctggagatatgccttctca

SEQ ID NO: 72559 - DNA, 20 bp, Artificial Sequence
  Description of Artificial Sequence: Synthetic oligonucleotide
  Target: ATXN1; (-) strand; PAM type: NRG; PAM sequence: AGG
tcctggagatatgccttctc

SEQ ID NO: 72560 - DNA, 20 bp, Artificial Sequence
  Description of Artificial Sequence: Synthetic oligonucleotide
  Target: ATXN1; (-) strand; PAM type: NRG; PAM sequence: CAG
gtcctggagatatgccttct

SEQ ID NO: 72561 - DNA, 20 bp, Artificial Sequence
  Description of Artificial Sequence: Synthetic oligonucleotide
  Target: ATXN1; (-) strand; PAM type: NRG; PAM sequence: GAG
aaggcggaacactggtcctg

SEQ ID NO: 72562 - DNA, 20 bp, Artificial Sequence
  Description of Artificial Sequence: Synthetic oligonucleotide
  Target: ATXN1; (-) strand; PAM type: NRG; PAM sequence: TGG
aaaaggcggaacactggtcc

SEQ ID NO: 72563 - DNA, 20 bp, Artificial Sequence
  Description of Artificial Sequence: Synthetic oligonucleotide
  Target: ATXN1; (-) strand; PAM type: NRG; PAM sequence: TGG
aaagtaaaaaggcggaacac

SEQ ID NO: 72564 - DNA, 20 bp, Artificial Sequence
  Description of Artificial Sequence: Synthetic oligonucleotide
  Target: ATXN1; (-) strand; PAM type: NRG; PAM sequence: CGG
tagattgtaaagtaaaaagg

SEQ ID NO: 72565 - DNA, 20 bp, Artificial Sequence
  Description of Artificial Sequence: Synthetic oligonucleotide
  Target: ATXN1; (-) strand; PAM type: NRG; PAM sequence: AGG
cattagattgtaaagtaaaa

SEQ ID NO: 72566 - DNA, 20 bp, Artificial Sequence
  Description of Artificial Sequence: Synthetic oligonucleotide
  Target: ATXN1; (-) strand; PAM type: NRG; PAM sequence: AAG
acattagattgtaaagtaaa

SEQ ID NO: 72567 - DNA, 20 bp, Artificial Sequence
  Description of Artificial Sequence: Synthetic oligonucleotide
  Target: ATXN1; (-) strand; PAM type: NRG; PAM sequence: AAG
cttgctgacattagattgta

SEQ ID NO: 72568 - DNA, 20 bp, Artificial Sequence
  Description of Artificial Sequence: Synthetic oligonucleotide
  Target: ATXN1; (-) strand; PAM type: NRG; PAM sequence: TAG
aaaaatactcttgctgacat

SEQ ID NO: 72569 - DNA, 20 bp, Artificial Sequence
  Description of Artificial Sequence: Synthetic oligonucleotide
  Target: ATXN1; (-) strand; PAM type: NRG; PAM sequence: GGG
tatttctaagctgtgtgcat

SEQ ID NO: 72570 - DNA, 20 bp, Artificial Sequence
  Description of Artificial Sequence: Synthetic oligonucleotide
  Target: ATXN1; (-) strand; PAM type: NRG; PAM sequence: TGG
ttatttctaagctgtgtgca

SEQ ID NO: 72571 - DNA, 20 bp, Artificial Sequence
  Description of Artificial Sequence: Synthetic oligonucleotide
  Target: ATXN1; (-) strand; PAM type: NRG; PAM sequence: AAG
tacacaccttgtttatttct

SEQ ID NO: 72572 - DNA, 20 bp, Artificial Sequence
  Description of Artificial Sequence: Synthetic oligonucleotide
  Target: ATXN1; (-) strand; PAM type: NRG; PAM sequence: CAG
tgctctgtggaaccaatttg

SEQ ID NO: 72573 - DNA, 20 bp, Artificial Sequence
  Description of Artificial Sequence: Synthetic oligonucleotide
  Target: ATXN1; (-) strand; PAM type: NRG; PAM sequence: TGG
tgaatcagttatttgctctg

SEQ ID NO: 72574 - DNA, 20 bp, Artificial Sequence
  Description of Artificial Sequence: Synthetic oligonucleotide
  Target: ATXN1; (-) strand; PAM type: NRG; PAM sequence: CAG
tttacagatatctggtgaat

SEQ ID NO: 72575 - DNA, 20 bp, Artificial Sequence
  Description of Artificial Sequence: Synthetic oligonucleotide
  Target: ATXN1; (-) strand; PAM type: NRG; PAM sequence: TGG
tatttgcttttacagatatc

SEQ ID NO: 72576 - DNA, 20 bp, Artificial Sequence
  Description of Artificial Sequence: Synthetic oligonucleotide
  Target: ATXN1; (-) strand; PAM type: NRG; PAM sequence: CAG
ggattttatatttgctttta

SEQ ID NO: 72577 - DNA, 20 bp, Artificial Sequence
  Description of Artificial Sequence: Synthetic oligonucleotide
  Target: ATXN1; (-) strand; PAM type: NRG; PAM sequence: TGG
caatacagagacataattca

SEQ ID NO: 72578 - DNA, 20 bp, Artificial Sequence
  Description of Artificial Sequence: Synthetic oligonucleotide
  Target: ATXN1; (-) strand; PAM type: NRG; PAM sequence: GAG
ttttatggtttttcaataca

SEQ ID NO: 72579 - DNA, 20 bp, Artificial Sequence
  Description of Artificial Sequence: Synthetic oligonucleotide
  Target: ATXN1; (-) strand; PAM type: NRG; PAM sequence: CAG
cattttatggtttttcaata

SEQ ID NO: 72580 - DNA, 20 bp, Artificial Sequence
  Description of Artificial Sequence: Synthetic oligonucleotide
  Target: ATXN1; (-) strand; PAM type: NRG; PAM sequence: TGG
taaaggtcctgagcatttta

SEQ ID NO: 72581 - DNA, 20 bp, Artificial Sequence
  Description of Artificial Sequence: Synthetic oligonucleotide
  Target: ATXN1; (-) strand; PAM type: NRG; PAM sequence: GAG
ttagttaacataaaggtcct

SEQ ID NO: 72582 - DNA, 20 bp, Artificial Sequence
  Description of Artificial Sequence: Synthetic oligonucleotide
  Target: ATXN1; (-) strand; PAM type: NRG; PAM sequence: AGG
aaatactttagttaacataa

SEQ ID NO: 72583 - DNA, 20 bp, Artificial Sequence
  Description of Artificial Sequence: Synthetic oligonucleotide
  Target: ATXN1; (-) strand; PAM type: NRG; PAM sequence: AAG
aaaatactttagttaacata

SEQ ID NO: 72584 - DNA, 20 bp, Artificial Sequence
  Description of Artificial Sequence: Synthetic oligonucleotide
  Target: ATXN1; (-) strand; PAM type: NRG; PAM sequence: TAG
cacatggaaggaaaatactt

SEQ ID NO: 72585 - DNA, 20 bp, Artificial Sequence
  Description of Artificial Sequence: Synthetic oligonucleotide
  Target: ATXN1; (-) strand; PAM type: NRG; PAM sequence: AGG
gggaaaatctaacacatgga

SEQ ID NO: 72586 - DNA, 20 bp, Artificial Sequence
  Description of Artificial Sequence: Synthetic oligonucleotide
  Target: ATXN1; (-) strand; PAM type: NRG; PAM sequence: AAG
ggggaaaatctaacacatgg

SEQ ID NO: 72587 - DNA, 20 bp, Artificial Sequence
  Description of Artificial Sequence: Synthetic oligonucleotide
  Target: ATXN1; (-) strand; PAM type: NRG; PAM sequence: TGG
taaggggaaaatctaacaca

SEQ ID NO: 72588 - DNA, 20 bp, Artificial Sequence
  Description of Artificial Sequence: Synthetic oligonucleotide
  Target: ATXN1; (-) strand; PAM type: NRG; PAM sequence: GGG
gtgtgttctacacatataag

SEQ ID NO: 72589 - DNA, 20 bp, Artificial Sequence
  Description of Artificial Sequence: Synthetic oligonucleotide
  Target: ATXN1; (-) strand; PAM type: NRG; PAM sequence: GGG
tgtgtgttctacacatataa

SEQ ID NO: 72590 - DNA, 20 bp, Artificial Sequence
  Description of Artificial Sequence: Synthetic oligonucleotide
  Target: ATXN1; (-) strand; PAM type: NRG; PAM sequence: AGG
gtgtgtgttctacacatata

SEQ ID NO: 72591 - DNA, 20 bp, Artificial Sequence
  Description of Artificial Sequence: Synthetic oligonucleotide
  Target: ATXN1; (-) strand; PAM type: NRG; PAM sequence: AAG
tgtgtgtgttctacacatat

SEQ ID NO: 72592 - DNA, 20 bp, Artificial Sequence
  Description of Artificial Sequence: Synthetic oligonucleotide
  Target: ATXN1; (-) strand; PAM type: NRG; PAM sequence: GAG
ttggtttttaaaggttaaaa

SEQ ID NO: 72593 - DNA, 20 bp, Artificial Sequence
  Description of Artificial Sequence: Synthetic oligonucleotide
  Target: ATXN1; (-) strand; PAM type: NRG; PAM sequence: AAG
tgttggtttttaaaggttaa

SEQ ID NO: 72594 - DNA, 20 bp, Artificial Sequence
  Description of Artificial Sequence: Synthetic oligonucleotide
  Target: ATXN1; (-) strand; PAM type: NRG; PAM sequence: AGG
attactgtgttggtttttaa

SEQ ID NO: 72595 - DNA, 20 bp, Artificial Sequence
  Description of Artificial Sequence: Synthetic oligonucleotide
  Target: ATXN1; (-) strand; PAM type: NRG; PAM sequence: AAG
aattactgtgttggttttta

SEQ ID NO: 72596 - DNA, 20 bp, Artificial Sequence
  Description of Artificial Sequence: Synthetic oligonucleotide
  Target: ATXN1; (-) strand; PAM type: NRG; PAM sequence: TGG
ttgcaatataattactgtgt

SEQ ID NO: 72597 - DNA, 20 bp, Artificial Sequence
  Description of Artificial Sequence: Synthetic oligonucleotide
  Target: ATXN1; (-) strand; PAM type: NRG; PAM sequence: CAG
ctagtattactctgggttgt

SEQ ID NO: 72598 - DNA, 20 bp, Artificial Sequence
  Description of Artificial Sequence: Synthetic oligonucleotide
  Target: ATXN1; (-) strand; PAM type: NRG; PAM sequence: GGG
tccttttctagtattactct

SEQ ID NO: 72599 - DNA, 20 bp, Artificial Sequence
  Description of Artificial Sequence: Synthetic oligonucleotide
  Target: ATXN1; (-) strand; PAM type: NRG; PAM sequence: TGG
atccttttctagtattactc

SEQ ID NO: 72600 - DNA, 20 bp, Artificial Sequence
  Description of Artificial Sequence: Synthetic oligonucleotide
  Target: ATXN1; (-) strand; PAM type: NRG; PAM sequence: TAG
gcgcagaaataatccttttc

SEQ ID NO: 72601 - DNA, 20 bp, Artificial Sequence
  Description of Artificial Sequence: Synthetic oligonucleotide
  Target: ATXN1; (-) strand; PAM type: NRG; PAM sequence: CAG
ctatttaaaagaagggggcg

SEQ ID NO: 72602 - DNA, 20 bp, Artificial Sequence
  Description of Artificial Sequence: Synthetic oligonucleotide
  Target: ATXN1; (-) strand; PAM type: NRG; PAM sequence: GGG
gagaactatttaaaagaagg

SEQ ID NO: 72603 - DNA, 20 bp, Artificial Sequence
  Description of Artificial Sequence: Synthetic oligonucleotide
  Target: ATXN1; (-) strand; PAM type: NRG; PAM sequence: GGG
tgagaactatttaaaagaag

SEQ ID NO: 72604 - DNA, 20 bp, Artificial Sequence
  Description of Artificial Sequence: Synthetic oligonucleotide
  Target: ATXN1; (-) strand; PAM type: NRG; PAM sequence: GGG
ttgagaactatttaaaagaa

SEQ ID NO: 72605 - DNA, 20 bp, Artificial Sequence
  Description of Artificial Sequence: Synthetic oligonucleotide
  Target: ATXN1; (-) strand; PAM type: NRG; PAM sequence: AGG
attgagaactatttaaaaga

SEQ ID NO: 72606 - DNA, 20 bp, Artificial Sequence
  Description of Artificial Sequence: Synthetic oligonucleotide
  Target: ATXN1; (-) strand; PAM type: NRG; PAM sequence: AAG
aattgagaactatttaaaag

SEQ ID NO: 72607 - DNA, 20 bp, Artificial Sequence
  Description of Artificial Sequence: Synthetic oligonucleotide
  Target: ATXN1; (-) strand; PAM type: NRG; PAM sequence: AAG
aaaaattgagaactatttaa

SEQ ID NO: 72608 - DNA, 20 bp, Artificial Sequence
  Description of Artificial Sequence: Synthetic oligonucleotide
  Target: ATXN1; (-) strand; PAM type: NRG; PAM sequence: GAG
ctataaattgtagaaaaatt

SEQ ID NO: 72609 - DNA, 20 bp, Artificial Sequence
  Description of Artificial Sequence: Synthetic oligonucleotide
  Target: ATXN1; (-) strand; PAM type: NRG; PAM sequence: TAG
cacagtccgcctataaattg

SEQ ID NO: 72610 - DNA, 20 bp, Artificial Sequence
  Description of Artificial Sequence: Synthetic oligonucleotide
  Target: ATXN1; (-) strand; PAM type: NRG; PAM sequence: CAG
ggctatgaaaatcttttgca

SEQ ID NO: 72611 - DNA, 20 bp, Artificial Sequence
  Description of Artificial Sequence: Synthetic oligonucleotide
  Target: ATXN1; (-) strand; PAM type: NRG; PAM sequence: TGG
tgtatctttaataggattca

SEQ ID NO: 72612 - DNA, 20 bp, Artificial Sequence
  Description of Artificial Sequence: Synthetic oligonucleotide
  Target: ATXN1; (-) strand; PAM type: NRG; PAM sequence: AGG
tctcccaatgtatctttaat

SEQ ID NO: 72613 - DNA, 20 bp, Artificial Sequence
  Description of Artificial Sequence: Synthetic oligonucleotide
  Target: ATXN1; (-) strand; PAM type: NRG; PAM sequence: TAG
atctcccaatgtatctttaa

SEQ ID NO: 72614 - DNA, 20 bp, Artificial Sequence
  Description of Artificial Sequence: Synthetic oligonucleotide
  Target: ATXN1; (-) strand; PAM type: NRG; PAM sequence: TAG
aatattcttgcgaattggaa

SEQ ID NO: 72615 - DNA, 20 bp, Artificial Sequence
  Description of Artificial Sequence: Synthetic oligonucleotide
  Target: ATXN1; (-) strand; PAM type: NRG; PAM sequence: TGG
tttcaaatattcttgcgaat

SEQ ID NO: 72616 - DNA, 20 bp, Artificial Sequence
  Description of Artificial Sequence: Synthetic oligonucleotide
  Target: ATXN1; (-) strand; PAM type: NRG; PAM sequence: CAG
tggagaaacattccctttgg

SEQ ID NO: 72617 - DNA, 20 bp, Artificial Sequence
  Description of Artificial Sequence: Synthetic oligonucleotide
  Target: ATXN1; (-) strand; PAM type: NRG; PAM sequence: TGG
gtttggagaaacattccctt

SEQ ID NO: 72618 - DNA, 20 bp, Artificial Sequence
  Description of Artificial Sequence: Synthetic oligonucleotide
  Target: ATXN1; (-) strand; PAM type: NRG; PAM sequence: GAG
taatactctctttatgtttg

SEQ ID NO: 72619 - DNA, 20 bp, Artificial Sequence
  Description of Artificial Sequence: Synthetic oligonucleotide
  Target: ATXN1; (-) strand; PAM type: NRG; PAM sequence: TGG
tttaatactctctttatgtt

SEQ ID NO: 72620 - DNA, 20 bp, Artificial Sequence
  Description of Artificial Sequence: Synthetic oligonucleotide
  Target: ATXN1; (-) strand; PAM type: NRG; PAM sequence: TAG
ctctgccttcgttttgatga

SEQ ID NO: 72621 - DNA, 20 bp, Artificial Sequence
  Description of Artificial Sequence: Synthetic oligonucleotide
  Target: ATXN1; (-) strand; PAM type: NRG; PAM sequence: AGG
tttatcaatatgggcttgtc

SEQ ID NO: 72622 - DNA, 20 bp, Artificial Sequence
  Description of Artificial Sequence: Synthetic oligonucleotide
  Target: ATXN1; (-) strand; PAM type: NRG; PAM sequence: CAG
ctttatcaatatgggcttgt

SEQ ID NO: 72623 - DNA, 20 bp, Artificial Sequence
  Description of Artificial Sequence: Synthetic oligonucleotide
  Target: ATXN1; (-) strand; PAM type: NRG; PAM sequence: GGG
tatctctgctttatcaatat

SEQ ID NO: 72624 - DNA, 20 bp, Artificial Sequence
  Description of Artificial Sequence: Synthetic oligonucleotide
  Target: ATXN1; (-) strand; PAM type: NRG; PAM sequence: TGG
ttatctctgctttatcaata

SEQ ID NO: 72625 - DNA, 20 bp, Artificial Sequence
  Description of Artificial Sequence: Synthetic oligonucleotide
  Target: ATXN1; (-) strand; PAM type: NRG; PAM sequence: GAG
tgtaccgggcatgtaacctg

SEQ ID NO: 72626 - DNA, 20 bp, Artificial Sequence
  Description of Artificial Sequence: Synthetic oligonucleotide
  Target: ATXN1; (-) strand; PAM type: NRG; PAM sequence: TGG
cctgtaccgggcatgtaacc

SEQ ID NO: 72627 - DNA, 20 bp, Artificial Sequence
  Description of Artificial Sequence: Synthetic oligonucleotide
  Target: ATXN1; (-) strand; PAM type: NRG; PAM sequence: GGG
cattgagaactgcctgtacc

SEQ ID NO: 72628 - DNA, 20 bp, Artificial Sequence
  Description of Artificial Sequence: Synthetic oligonucleotide
  Target: ATXN1; (-) strand; PAM type: NRG; PAM sequence: CGG
acattgagaactgcctgtac

SEQ ID NO: 72629 - DNA, 20 bp, Artificial Sequence
  Description of Artificial Sequence: Synthetic oligonucleotide
  Target: ATXN1; (-) strand; PAM type: NRG; PAM sequence: GAG
atacaactcattcatacatt

SEQ ID NO: 72630 - DNA, 20 bp, Artificial Sequence
  Description of Artificial Sequence: Synthetic oligonucleotide
  Target: ATXN1; (-) strand; PAM type: NRG; PAM sequence: GAG
tctctgagaaaatgtgtttg

SEQ ID NO: 72631 - DNA, 20 bp, Artificial Sequence
  Description of Artificial Sequence: Synthetic oligonucleotide
  Target: ATXN1; (-) strand; PAM type: NRG; PAM sequence: TGG
tttctctgagaaaatgtgtt

SEQ ID NO: 72632 - DNA, 20 bp, Artificial Sequence
  Description of Artificial Sequence: Synthetic oligonucleotide
  Target: ATXN1; (-) strand; PAM type: NRG; PAM sequence: GAG
atttataacactgtttctct

SEQ ID NO: 72633 - DNA, 20 bp, Artificial Sequence
  Description of Artificial Sequence: Synthetic oligonucleotide
  Target: ATXN1; (-) strand; PAM type: NRG; PAM sequence: AAG
ttttgccttcctgcaaaact

SEQ ID NO: 72634 - DNA, 20 bp, Artificial Sequence
  Description of Artificial Sequence: Synthetic oligonucleotide
  Target: ATXN1; (-) strand; PAM type: NRG; PAM sequence: TAG
tgtctatattataagctcta

SEQ ID NO: 72635 - DNA, 20 bp, Artificial Sequence
  Description of Artificial Sequence: Synthetic oligonucleotide
  Target: ATXN1; (-) strand; PAM type: NRG; PAM sequence: AAG
ctagagtttgtctatattat

SEQ ID NO: 72636 - DNA, 20 bp, Artificial Sequence
  Description of Artificial Sequence: Synthetic oligonucleotide
  Target: ATXN1; (-) strand; PAM type: NRG; PAM sequence: GAG
gtcccctgctcatggtacta

SEQ ID NO: 72637 - DNA, 20 bp, Artificial Sequence
  Description of Artificial Sequence: Synthetic oligonucleotide
  Target: ATXN1; (-) strand; PAM type: NRG; PAM sequence: TAG
ctgtcccctgctcatggtac

SEQ ID NO: 72638 - DNA, 20 bp, Artificial Sequence
  Description of Artificial Sequence: Synthetic oligonucleotide
  Target: ATXN1; (-) strand; PAM type: NRG; PAM sequence: TGG
cacctcctgtcccctgctca

SEQ ID NO: 72639 - DNA, 20 bp, Artificial Sequence
  Description of Artificial Sequence: Synthetic oligonucleotide
  Target: ATXN1; (-) strand; PAM type: NRG; PAM sequence: AAG
gaaaaagaaagttcatttgt

SEQ ID NO: 72640 - DNA, 20 bp, Artificial Sequence
  Description of Artificial Sequence: Synthetic oligonucleotide
  Target: ATXN1; (-) strand; PAM type: NRG; PAM sequence: AAG
tttccaggtaccgaaaaaga

SEQ ID NO: 72641 - DNA, 20 bp, Artificial Sequence
  Description of Artificial Sequence: Synthetic oligonucleotide
  Target: ATXN1; (-) strand; PAM type: NRG; PAM sequence: AAG
gttgtttccaggtaccgaaa

SEQ ID NO: 72642 - DNA, 20 bp, Artificial Sequence
  Description of Artificial Sequence: Synthetic oligonucleotide
  Target: ATXN1; (-) strand; PAM type: NRG; PAM sequence: AGG
aaaaaactttggttgtttcc

SEQ ID NO: 72643 - DNA, 20 bp, Artificial Sequence
  Description of Artificial Sequence: Synthetic oligonucleotide
  Target: ATXN1; (-) strand; PAM type: NRG; PAM sequence: CAG
aaaaaaactttggttgtttc

SEQ ID NO: 72644 - DNA, 20 bp, Artificial Sequence
  Description of Artificial Sequence: Synthetic oligonucleotide
  Target: ATXN1; (-) strand; PAM type: NRG; PAM sequence: TGG
atgccagaaaaaaaaaactt

SEQ ID NO: 72645 - DNA, 20 bp, Artificial Sequence
  Description of Artificial Sequence: Synthetic oligonucleotide
  Target: ATXN1; (-) strand; PAM type: NRG; PAM sequence: CAG
taggagaggcagacagatgc

SEQ ID NO: 72646 - DNA, 20 bp, Artificial Sequence
  Description of Artificial Sequence: Synthetic oligonucleotide
  Target: ATXN1; (-) strand; PAM type: NRG; PAM sequence: CAG
agaagtataggagaggcaga

SEQ ID NO: 72647 - DNA, 20 bp, Artificial Sequence
  Description of Artificial Sequence: Synthetic oligonucleotide
  Target: ATXN1; (-) strand; PAM type: NRG; PAM sequence: CAG
tgggagaagtataggagagg

SEQ ID NO: 72648 - DNA, 20 bp, Artificial Sequence
  Description of Artificial Sequence: Synthetic oligonucleotide
  Target: ATXN1; (-) strand; PAM type: NRG; PAM sequence: AGG
cagtgggagaagtataggag

SEQ ID NO: 72649 - DNA, 20 bp, Artificial Sequence
  Description of Artificial Sequence: Synthetic oligonucleotide
  Target: ATXN1; (-) strand; PAM type: NRG; PAM sequence: GAG
acagtgggagaagtatagga

SEQ ID NO: 72650 - DNA, 20 bp, Artificial Sequence
  Description of Artificial Sequence: Synthetic oligonucleotide
  Target: ATXN1; (-) strand; PAM type: NRG; PAM sequence: GAG
agacagtgggagaagtatag

SEQ ID NO: 72651 - DNA, 20 bp, Artificial Sequence
  Description of Artificial Sequence: Synthetic oligonucleotide
  Target: ATXN1; (-) strand; PAM type: NRG; PAM sequence: AGG
ttagacagtgggagaagtat

SEQ ID NO: 72652 - DNA, 20 bp, Artificial Sequence
  Description of Artificial Sequence: Synthetic oligonucleotide
  Target: ATXN1; (-) strand; PAM type: NRG; PAM sequence: TAG
tttagacagtgggagaagta

SEQ ID NO: 72653 - DNA, 20 bp, Artificial Sequence
  Description of Artificial Sequence: Synthetic oligonucleotide
  Target: ATXN1; (-) strand; PAM type: NRG; PAM sequence: AAG
aagcatttagacagtgggag

SEQ ID NO: 72654 - DNA, 20 bp, Artificial Sequence
  Description of Artificial Sequence: Synthetic oligonucleotide
  Target: ATXN1; (-) strand; PAM type: NRG; PAM sequence: GAG
atgaagcatttagacagtgg

SEQ ID NO: 72655 - DNA, 20 bp, Artificial Sequence
  Description of Artificial Sequence: Synthetic oligonucleotide
  Target: ATXN1; (-) strand; PAM type: NRG; PAM sequence: GGG
ggatgaagcatttagacagt

SEQ ID NO: 72656 - DNA, 20 bp, Artificial Sequence
  Description of Artificial Sequence: Synthetic oligonucleotide
  Target: ATXN1; (-) strand; PAM type: NRG; PAM sequence: TGG
gggatgaagcatttagacag

SEQ ID NO: 72657 - DNA, 20 bp, Artificial Sequence
  Description of Artificial Sequence: Synthetic oligonucleotide
  Target: ATXN1; (-) strand; PAM type: NRG; PAM sequence: CAG
gctgggatgaagcatttaga

SEQ ID NO: 72658 - DNA, 20 bp, Artificial Sequence
  Description of Artificial Sequence: Synthetic oligonucleotide
  Target: ATXN1; (-) strand; PAM type: NRG; PAM sequence: TAG
atgggctgggatgaagcatt

SEQ ID NO: 72659 - DNA, 20 bp, Artificial Sequence
  Description of Artificial Sequence: Synthetic oligonucleotide
  Target: ATXN1; (-) strand; PAM type: NRG; PAM sequence: AAG
ctcttatatgggctgggatg

SEQ ID NO: 72660 - DNA, 20 bp, Artificial Sequence
  Description of Artificial Sequence: Synthetic oligonucleotide
  Target: ATXN1; (-) strand; PAM type: NRG; PAM sequence: GGG
ggtgctctcttatatgggct

SEQ ID NO: 72661 - DNA, 20 bp, Artificial Sequence
  Description of Artificial Sequence: Synthetic oligonucleotide
  Target: ATXN1; (-) strand; PAM type: NRG; PAM sequence: TGG
tggtgctctcttatatgggc

SEQ ID NO: 72662 - DNA, 20 bp, Artificial Sequence
  Description of Artificial Sequence: Synthetic oligonucleotide
  Target: ATXN1; (-) strand; PAM type: NRG; PAM sequence: GGG
tttttggtgctctcttatat

SEQ ID NO: 72663 - DNA, 20 bp, Artificial Sequence
  Description of Artificial Sequence: Synthetic oligonucleotide
  Target: ATXN1; (-) strand; PAM type: NRG; PAM sequence: TGG
ttttttggtgctctcttata

SEQ ID NO: 72664 - DNA, 20 bp, Artificial Sequence
  Description of Artificial Sequence: Synthetic oligonucleotide
  Target: ATXN1; (-) strand; PAM type: NRG; PAM sequence: TGG
ttaactatattaaatttttt

SEQ ID NO: 72665 - DNA, 20 bp, Artificial Sequence
  Description of Artificial Sequence: Synthetic oligonucleotide
  Target: ATXN1; (-) strand; PAM type: NRG; PAM sequence: GGG
gaaggggagtttgggaaaaa

SEQ ID NO: 72666 - DNA, 20 bp, Artificial Sequence
  Description of Artificial Sequence: Synthetic oligonucleotide
  Target: ATXN1; (-) strand; PAM type: NRG; PAM sequence: AGG
ggaaggggagtttgggaaaa

SEQ ID NO: 72667 - DNA, 20 bp, Artificial Sequence
  Description of Artificial Sequence: Synthetic oligonucleotide
  Target: ATXN1; (-) strand; PAM type: NRG; PAM sequence: AAG
gggaaggggagtttgggaaa

SEQ ID NO: 72668 - DNA, 20 bp, Artificial Sequence
  Description of Artificial Sequence: Synthetic oligonucleotide
  Target: ATXN1; (-) strand; PAM type: NRG; PAM sequence: GGG
ggacttgggaaggggagttt

SEQ ID NO: 72669 - DNA, 20 bp, Artificial Sequence
  Description of Artificial Sequence: Synthetic oligonucleotide
  Target: ATXN1; (-) strand; PAM type: NRG; PAM sequence: TGG
tggacttgggaaggggagtt

SEQ ID NO: 72670 - DNA, 20 bp, Artificial Sequence
  Description of Artificial Sequence: Synthetic oligonucleotide
  Target: ATXN1; (-) strand; PAM type: NRG; PAM sequence: GAG
ataactggacttgggaaggg

SEQ ID NO: 72671 - DNA, 20 bp, Artificial Sequence
  Description of Artificial Sequence: Synthetic oligonucleotide
  Target: ATXN1; (-) strand; PAM type: NRG; PAM sequence: GGG
agataactggacttgggaag

SEQ ID NO: 72672 - DNA, 20 bp, Artificial Sequence
  Description of Artificial Sequence: Synthetic oligonucleotide
  Target: ATXN1; (-) strand; PAM type: NRG; PAM sequence: GGG
cagataactggacttgggaa

SEQ ID NO: 72673 - DNA, 20 bp, Artificial Sequence
  Description of Artificial Sequence: Synthetic oligonucleotide
  Target: ATXN1; (-) strand; PAM type: NRG; PAM sequence: AGG
ccagataactggacttggga

SEQ ID NO: 72674 - DNA, 20 bp, Artificial Sequence
  Description of Artificial Sequence: Synthetic oligonucleotide
  Target: ATXN1; (-) strand; PAM type: NRG; PAM sequence: AAG
gccagataactggacttggg

SEQ ID NO: 72675 - DNA, 20 bp, Artificial Sequence
  Description of Artificial Sequence: Synthetic oligonucleotide
  Target: ATXN1; (-) strand; PAM type: NRG; PAM sequence: GGG
attgccagataactggactt

SEQ ID NO: 72676 - DNA, 20 bp, Artificial Sequence
  Description of Artificial Sequence: Synthetic oligonucleotide
  Target: ATXN1; (-) strand; PAM type: NRG; PAM sequence: TGG
gattgccagataactggact

SEQ ID NO: 72677 - DNA, 20 bp, Artificial Sequence
  Description of Artificial Sequence: Synthetic oligonucleotide
  Target: ATXN1; (-) strand; PAM type: NRG; PAM sequence: TGG
gcctttgattgccagataac

SEQ ID NO: 72678 - DNA, 20 bp, Artificial Sequence
  Description of Artificial Sequence: Synthetic oligonucleotide
  Target: ATXN1; (-) strand; PAM type: NRG; PAM sequence: CAG
ctttattagcctttgattgc

SEQ ID NO: 72679 - DNA, 20 bp, Artificial Sequence
  Description of Artificial Sequence: Synthetic oligonucleotide
  Target: ATXN1; (-) strand; PAM type: NRG; PAM sequence: TAG
tactgaactgaactctttat

SEQ ID NO: 72680 - DNA, 20 bp, Artificial Sequence
  Description of Artificial Sequence: Synthetic oligonucleotide
  Target: ATXN1; (-) strand; PAM type: NRG; PAM sequence: AAG
tgctgtcaaaacctagaaac

SEQ ID NO: 72681 - DNA, 20 bp, Artificial Sequence
  Description of Artificial Sequence: Synthetic oligonucleotide
  Target: ATXN1; (-) strand; PAM type: NRG; PAM sequence: TAG
ttagatctgctgtcaaaacc

SEQ ID NO: 72682 - DNA, 20 bp, Artificial Sequence
  Description of Artificial Sequence: Synthetic oligonucleotide
  Target: ATXN1; (-) strand; PAM type: NRG; PAM sequence: TAG
ccattcctctctctcaagat

SEQ ID NO: 72683 - DNA, 20 bp, Artificial Sequence
  Description of Artificial Sequence: Synthetic oligonucleotide
  Target: ATXN1; (-) strand; PAM type: NRG; PAM sequence: AAG
tgtccccattcctctctctc

SEQ ID NO: 72684 - DNA, 20 bp, Artificial Sequence
  Description of Artificial Sequence: Synthetic oligonucleotide
  Target: ATXN1; (-) strand; PAM type: NRG; PAM sequence: TGG
ttgtgtgtatacccagagct

SEQ ID NO: 72685 - DNA, 20 bp, Artificial Sequence
  Description of Artificial Sequence: Synthetic oligonucleotide
  Target: ATXN1; (-) strand; PAM type: NRG; PAM sequence: GAG
attctttgtgtgtataccca

SEQ ID NO: 72686 - DNA, 20 bp, Artificial Sequence
  Description of Artificial Sequence: Synthetic oligonucleotide
  Target: ATXN1; (-) strand; PAM type: NRG; PAM sequence: CAG
tcattctttgtgtgtatacc

SEQ ID NO: 72687 - DNA, 20 bp, Artificial Sequence
  Description of Artificial Sequence: Synthetic oligonucleotide
  Target: ATXN1; (-) strand; PAM type: NRG; PAM sequence: TGG
aattatccagtcctcccaga

SEQ ID NO: 72688 - DNA, 20 bp, Artificial Sequence
  Description of Artificial Sequence: Synthetic oligonucleotide
  Target: ATXN1; (-) strand; PAM type: NRG; PAM sequence: CAG
ctgaaattatccagtcctcc

SEQ ID NO: 72689 - DNA, 20 bp, Artificial Sequence
  Description of Artificial Sequence: Synthetic oligonucleotide
  Target: ATXN1; (-) strand; PAM type: NRG; PAM sequence: CAG
gggaaattcctgaaattatc

SEQ ID NO: 72690 - DNA, 20 bp, Artificial Sequence
  Description of Artificial Sequence: Synthetic oligonucleotide
  Target: ATXN1; (-) strand; PAM type: NRG; PAM sequence: GGG
tttaccattactaaattacg

SEQ ID NO: 72691 - DNA, 20 bp, Artificial Sequence
  Description of Artificial Sequence: Synthetic oligonucleotide
  Target: ATXN1; (-) strand; PAM type: NRG; PAM sequence: GGG
gtttaccattactaaattac

SEQ ID NO: 72692 - DNA, 20 bp, Artificial Sequence
  Description of Artificial Sequence: Synthetic oligonucleotide
  Target: ATXN1; (-) strand; PAM type: NRG; PAM sequence: CGG
tgtttaccattactaaatta

SEQ ID NO: 72693 - DNA, 20 bp, Artificial Sequence
  Description of Artificial Sequence: Synthetic oligonucleotide
  Target: ATXN1; (-) strand; PAM type: NRG; PAM sequence: GGG
atctgcacttcttaggagct

SEQ ID NO: 72694 - DNA, 20 bp, Artificial Sequence
  Description of Artificial Sequence: Synthetic oligonucleotide
  Target: ATXN1; (-) strand; PAM type: NRG; PAM sequence: TGG
catctgcacttcttaggagc

SEQ ID NO: 72695 - DNA, 20 bp, Artificial Sequence
  Description of Artificial Sequence: Synthetic oligonucleotide
  Target: ATXN1; (-) strand; PAM type: NRG; PAM sequence: GAG
cattcatctgcacttcttag

SEQ ID NO: 72696 - DNA, 20 bp, Artificial Sequence
  Description of Artificial Sequence: Synthetic oligonucleotide
  Target: ATXN1; (-) strand; PAM type: NRG; PAM sequence: AGG
ttcattcatctgcacttctt

SEQ ID NO: 72697 - DNA, 20 bp, Artificial Sequence
  Description of Artificial Sequence: Synthetic oligonucleotide
  Target: ATXN1; (-) strand; PAM type: NRG; PAM sequence: TAG
cttcattcatctgcacttct

SEQ ID NO: 72698 - DNA, 20 bp, Artificial Sequence
  Description of Artificial Sequence: Synthetic oligonucleotide
  Target: ATXN1; (-) strand; PAM type: NRG; PAM sequence: AGG
ttgatctatacctgttggtc

SEQ ID NO: 72699 - DNA, 20 bp, Artificial Sequence
  Description of Artificial Sequence: Synthetic oligonucleotide
  Target: ATXN1; (-) strand; PAM type: NRG; PAM sequence: CAG
tttgatctatacctgttggt

SEQ ID NO: 72700 - DNA, 20 bp, Artificial Sequence
  Description of Artificial Sequence: Synthetic oligonucleotide
  Target: ATXN1; (-) strand; PAM type: NRG; PAM sequence: TGG
tgcctttgatctatacctgt

SEQ ID NO: 72701 - DNA, 20 bp, Artificial Sequence
  Description of Artificial Sequence: Synthetic oligonucleotide
  Target: ATXN1; (-) strand; PAM type: NRG; PAM sequence: AAG
agaaaccaggtgtgggatag

SEQ ID NO: 72702 - DNA, 20 bp, Artificial Sequence
  Description of Artificial Sequence: Synthetic oligonucleotide
  Target: ATXN1; (-) strand; PAM type: NRG; PAM sequence: TAG
gctagaaaccaggtgtggga

SEQ ID NO: 72703 - DNA, 20 bp, Artificial Sequence
  Description of Artificial Sequence: Synthetic oligonucleotide
  Target: ATXN1; (-) strand; PAM type: NRG; PAM sequence: GGG
tgccgctagaaaccaggtgt

SEQ ID NO: 72704 - DNA, 20 bp, Artificial Sequence
  Description of Artificial Sequence: Synthetic oligonucleotide
  Target: ATXN1; (-) strand; PAM type: NRG; PAM sequence: TGG
ctgccgctagaaaccaggtg

SEQ ID NO: 72705 - DNA, 20 bp, Artificial Sequence
  Description of Artificial Sequence: Synthetic oligonucleotide
  Target: ATXN1; (-) strand; PAM type: NRG; PAM sequence: AGG
agatactgccgctagaaacc

SEQ ID NO: 72706 - DNA, 20 bp, Artificial Sequence
  Description of Artificial Sequence: Synthetic oligonucleotide
  Target: ATXN1; (-) strand; PAM type: NRG; PAM sequence: CAG
tagatactgccgctagaaac

SEQ ID NO: 72707 - DNA, 20 bp, Artificial Sequence
  Description of Artificial Sequence: Synthetic oligonucleotide
  Target: ATXN1; (-) strand; PAM type: NRG; PAM sequence: TAG
aaccttctagatactgccgc

SEQ ID NO: 72708 - DNA, 20 bp, Artificial Sequence
  Description of Artificial Sequence: Synthetic oligonucleotide
  Target: ATXN1; (-) strand; PAM type: NRG; PAM sequence: TAG
tgaaaaggcaaggaaccttc

SEQ ID NO: 72709 - DNA, 20 bp, Artificial Sequence
  Description of Artificial Sequence: Synthetic oligonucleotide
  Target: ATXN1; (-) strand; PAM type: NRG; PAM sequence: AGG
tggctccccatgaaaaggca

SEQ ID NO: 72710 - DNA, 20 bp, Artificial Sequence
  Description of Artificial Sequence: Synthetic oligonucleotide
  Target: ATXN1; (-) strand; PAM type: NRG; PAM sequence: AAG
gtggctccccatgaaaaggc

SEQ ID NO: 72711 - DNA, 20 bp, Artificial Sequence
  Description of Artificial Sequence: Synthetic oligonucleotide
  Target: ATXN1; (-) strand; PAM type: NRG; PAM sequence: AGG
atgtgtggctccccatgaaa

SEQ ID NO: 72712 - DNA, 20 bp, Artificial Sequence
  Description of Artificial Sequence: Synthetic oligonucleotide
  Target: ATXN1; (-) strand; PAM type: NRG; PAM sequence: AAG
catgtgtggctccccatgaa

SEQ ID NO: 72713 - DNA, 20 bp, Artificial Sequence
  Description of Artificial Sequence: Synthetic oligonucleotide
  Target: ATXN1; (-) strand; PAM type: NRG; PAM sequence: TGG
gaagagcaggcagtcatgtg

SEQ ID NO: 72714 - DNA, 20 bp, Artificial Sequence
  Description of Artificial Sequence: Synthetic oligonucleotide
  Target: ATXN1; (-) strand; PAM type: NRG; PAM sequence: CAG
ttcatgggaagaagagcagg

SEQ ID NO: 72715 - DNA, 20 bp, Artificial Sequence
  Description of Artificial Sequence: Synthetic oligonucleotide
  Target: ATXN1; (-) strand; PAM type: NRG; PAM sequence: AGG
atcttcatgggaagaagagc

SEQ ID NO: 72716 - DNA, 20 bp, Artificial Sequence
  Description of Artificial Sequence: Synthetic oligonucleotide
  Target: ATXN1; (-) strand; PAM type: NRG; PAM sequence: CAG
tatcttcatgggaagaagag

SEQ ID NO: 72717 - DNA, 20 bp, Artificial Sequence
  Description of Artificial Sequence: Synthetic oligonucleotide
  Target: ATXN1; (-) strand; PAM type: NRG; PAM sequence: GAG
tgttatcttcatgggaagaa

SEQ ID NO: 72718 - DNA, 20 bp, Artificial Sequence
  Description of Artificial Sequence: Synthetic oligonucleotide
  Target: ATXN1; (-) strand; PAM type: NRG; PAM sequence: AAG
tatgttatcttcatgggaag

SEQ ID NO: 72719 - DNA, 20 bp, Artificial Sequence
  Description of Artificial Sequence: Synthetic oligonucleotide
  Target: ATXN1; (-) strand; PAM type: NRG; PAM sequence: AAG
ccttatgttatcttcatggg

SEQ ID NO: 72720 - DNA, 20 bp, Artificial Sequence
  Description of Artificial Sequence: Synthetic oligonucleotide
  Target: ATXN1; (-) strand; PAM type: NRG; PAM sequence: GGG
gtcccttatgttatcttcat

SEQ ID NO: 72721 - DNA, 20 bp, Artificial Sequence
  Description of Artificial Sequence: Synthetic oligonucleotide
  Target: ATXN1; (-) strand; PAM type: NRG; PAM sequence: TGG
agtcccttatgttatcttca

SEQ ID NO: 72722 - DNA, 20 bp, Artificial Sequence
  Description of Artificial Sequence: Synthetic oligonucleotide
  Target: ATXN1; (-) strand; PAM type: NRG; PAM sequence: CAG
accacccgggtctgaactga

SEQ ID NO: 72723 - DNA, 20 bp, Artificial Sequence
  Description of Artificial Sequence: Synthetic oligonucleotide
  Target: ATXN1; (-) strand; PAM type: NRG; PAM sequence: GGG
cttcatcttttaaaccaccc

SEQ ID NO: 72724 - DNA, 20 bp, Artificial Sequence
  Description of Artificial Sequence: Synthetic oligonucleotide
  Target: ATXN1; (-) strand; PAM type: NRG; PAM sequence: CGG
tcttcatcttttaaaccacc

SEQ ID NO: 72725 - DNA, 20 bp, Artificial Sequence
  Description of Artificial Sequence: Synthetic oligonucleotide
  Target: ATXN1; (-) strand; PAM type: NRG; PAM sequence: AGG
agccaccaccacgccaggcc

SEQ ID NO: 72726 - DNA, 20 bp, Artificial Sequence
  Description of Artificial Sequence: Synthetic oligonucleotide
  Target: ATXN1; (-) strand; PAM type: NRG; PAM sequence: CAG
gagccaccaccacgccaggc

SEQ ID NO: 72727 - DNA, 20 bp, Artificial Sequence
  Description of Artificial Sequence: Synthetic oligonucleotide
  Target: ATXN1; (-) strand; PAM type: NRG; PAM sequence: AGG
gcgtgagccaccaccacgcc

SEQ ID NO: 72728 - DNA, 20 bp, Artificial Sequence
  Description of Artificial Sequence: Synthetic oligonucleotide
  Target: ATXN1; (-) strand; PAM type: NRG; PAM sequence: CAG
ggcgtgagccaccaccacgc

SEQ ID NO: 72729 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 72730 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 72731 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 72732 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 72733 - DNA, 20 bp, Artificial Sequence
  Description of Artificial Sequence: Synthetic oligonucleotide
  Target: ATXN1; (-) strand; PAM type: NRG; PAM sequence: TGG
accttggcctcccaaagtgc

SEQ ID NO: 72734 - DNA, 20 bp, Artificial Sequence
  Description of Artificial Sequence: Synthetic oligonucleotide
  Target: ATXN1; (-) strand; PAM type: NRG; PAM sequence: AAG
ccgcccaccttggcctccca

SEQ ID NO: 72735 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgatccgcccacct

SEQ ID NO: 72736 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacctc

SEQ ID NO: 72737 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgacct

SEQ ID NO: 72738 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggtcaggc

SEQ ID NO: 72739 - DNA, 20 bp, Artificial Sequence
  Description of Artificial Sequence: Synthetic oligonucleotide
  Target: ATXN1; (-) strand; PAM type: NRG; PAM sequence: AGG
gaggtttcaccatgttggtc

SEQ ID NO: 72740 - DNA, 20 bp, Artificial Sequence
  Description of Artificial Sequence: Synthetic oligonucleotide
  Target: ATXN1; (-) strand; PAM type: NRG; PAM sequence: CAG
cgaggtttcaccatgttggt

SEQ ID NO: 72741 - DNA, 20 bp, Artificial Sequence
  Description of Artificial Sequence: Synthetic oligonucleotide
  Target: ATXN1; (-) strand; PAM type: NRG; PAM sequence: TGG
gagacgaggtttcaccatgt

SEQ ID NO: 72742 - DNA, 20 bp, Artificial Sequence
  Description of Artificial Sequence: Synthetic oligonucleotide
  Target: ATXN1; (-) strand; PAM type: NRG; PAM sequence: AGG
ttttatttttagcagagacg

SEQ ID NO: 72743 - DNA, 20 bp, Artificial Sequence
  Description of Artificial Sequence: Synthetic oligonucleotide
  Target: ATXN1; (-) strand; PAM type: NRG; PAM sequence: GAG
tttttatttttagcagagac

SEQ ID NO: 72744 - DNA, 20 bp, Artificial Sequence
  Description of Artificial Sequence: Synthetic oligonucleotide
  Target: ATXN1; (-) strand; PAM type: NRG; PAM sequence: GAG
tttattttttatttttagca

SEQ ID NO: 72745 - DNA, 20 bp, Artificial Sequence
  Description of Artificial Sequence: Synthetic oligonucleotide
  Target: ATXN1; (-) strand; PAM type: NRG; PAM sequence: CAG
tttttattttttatttttag

SEQ ID NO: 72746 - DNA, 20 bp, Artificial Sequence
  Description of Artificial Sequence: Synthetic oligonucleotide
  Target: ATXN1; (-) strand; PAM type: NRG; PAM sequence: TAG
aattttttattttttatttt

SEQ ID NO: 72747 - DNA, 20 bp, Artificial Sequence
  Description of Artificial Sequence: Synthetic oligonucleotide
  Target: ATXN1; (-) strand; PAM type: NRG; PAM sequence: CAG
aaggctcacaccaccatgcc

SEQ ID NO: 72748 - DNA, 20 bp, Artificial Sequence
  Description of Artificial Sequence: Synthetic oligonucleotide
  Target: ATXN1; (-) strand; PAM type: NRG; PAM sequence: AGG
ccccagtagctaggattaca

SEQ ID NO: 72749 - DNA, 20 bp, Artificial Sequence
  Description of Artificial Sequence: Synthetic oligonucleotide
  Target: ATXN1; (-) strand; PAM type: NRG; PAM sequence: AAG
tccccagtagctaggattac

SEQ ID NO: 72750 - DNA, 20 bp, Artificial Sequence
  Description of Artificial Sequence: Synthetic oligonucleotide
  Target: ATXN1; (-) strand; PAM type: NRG; PAM sequence: AGG
tcttagcctccccagtagct

SEQ ID NO: 72751 - DNA, 20 bp, Artificial Sequence
  Description of Artificial Sequence: Synthetic oligonucleotide
  Target: ATXN1; (-) strand; PAM type: NRG; PAM sequence: TAG
gtcttagcctccccagtagc

SEQ ID NO: 72752 - DNA, 20 bp, Artificial Sequence
  Description of Artificial Sequence: Synthetic oligonucleotide
  Target: ATXN1; (-) strand; PAM type: NRG; PAM sequence: TAG
tcctgtcttagcctccccag

SEQ ID NO: 72753 - DNA, 20 bp, Artificial Sequence
  Description of Artificial Sequence: Synthetic oligonucleotide
  Target: ATXN1; (-) strand; PAM type: NRG; PAM sequence: CAG
ttctcctgtcttagcctccc

SEQ ID NO: 72754 - DNA, 20 bp, Artificial Sequence
  Description of Artificial Sequence: Synthetic oligonucleotide
  Target: ATXN1; (-) strand; PAM type: NRG; PAM sequence: TAG
ttcaagcgattctcctgtct

SEQ ID NO: 72755 - DNA, 20 bp, Artificial Sequence
  Description of Artificial Sequence: Synthetic oligonucleotide
  Target: ATXN1; (-) strand; PAM type: NRG; PAM sequence: AAG
agcctccacctcctgggttc

SEQ ID NO: 72756 - DNA, 20 bp, Artificial Sequence
  Description of Artificial Sequence: Synthetic oligonucleotide
  Target: ATXN1; (-) strand; PAM type: NRG; PAM sequence: GGG
cactacagcctccacctcct

SEQ ID NO: 72757 - DNA, 20 bp, Artificial Sequence
  Description of Artificial Sequence: Synthetic oligonucleotide
  Target: ATXN1; (-) strand; PAM type: NRG; PAM sequence: TGG
tcactacagcctccacctcc

SEQ ID NO: 72758 - DNA, 20 bp, Artificial Sequence
  Description of Artificial Sequence: Synthetic oligonucleotide
  Target: ATXN1; (-) strand; PAM type: NRG; PAM sequence: CAG
ggtgtgagcttggctcacta

SEQ ID NO: 72759 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggtgtgagct

SEQ ID NO: 72760 - DNA, 20 bp, Artificial Sequence
  Description of Artificial Sequence: Synthetic oligonucleotide
  Target: ATXN1; (-) strand; PAM type: NRG; PAM sequence: GAG
aggctggagtgcagtggtgt

SEQ ID NO: 72761 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 72762 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggctggagtg

SEQ ID NO: 72763 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcgcccaggctg

SEQ ID NO: 72764 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtcgcccaggc

SEQ ID NO: 72765 - DNA, 20 bp, Artificial Sequence
  Description of Artificial Sequence: Synthetic oligonucleotide
  Target: ATXN1; (-) strand; PAM type: NRG; PAM sequence: AGG
ggagtctcactctgtcgccc

SEQ ID NO: 72766 - DNA, 20 bp, Artificial Sequence
  Description of Artificial Sequence: Synthetic oligonucleotide
  Target: ATXN1; (-) strand; PAM type: NRG; PAM sequence: CAG
cggagtctcactctgtcgcc

SEQ ID NO: 72767 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttctgagacg

SEQ ID NO: 72768 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttctgaga

SEQ ID NO: 72769 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttttttct

SEQ ID NO: 72770 - DNA, 20 bp, Artificial Sequence
  Description of Artificial Sequence: Synthetic oligonucleotide
  Target: ATXN1; (-) strand; PAM type: NRG; PAM sequence: CGG
caggagaccactgagtcaat

SEQ ID NO: 72771 - DNA, 20 bp, Artificial Sequence
  Description of Artificial Sequence: Synthetic oligonucleotide
  Target: ATXN1; (-) strand; PAM type: NRG; PAM sequence: GAG
aggaacagcaggagaccact

SEQ ID NO: 72772 - DNA, 20 bp, Artificial Sequence
  Description of Artificial Sequence: Synthetic oligonucleotide
  Target: ATXN1; (-) strand; PAM type: NRG; PAM sequence: GAG
ctctgtctcaggaacagcag

SEQ ID NO: 72773 - DNA, 20 bp, Artificial Sequence
  Description of Artificial Sequence: Synthetic oligonucleotide
  Target: ATXN1; (-) strand; PAM type: NRG; PAM sequence: AGG
atctctgtctcaggaacagc

SEQ ID NO: 72774 - DNA, 20 bp, Artificial Sequence
  Description of Artificial Sequence: Synthetic oligonucleotide
  Target: ATXN1; (-) strand; PAM type: NRG; PAM sequence: CAG
tatctctgtctcaggaacag

SEQ ID NO: 72775 - DNA, 20 bp, Artificial Sequence
  Description of Artificial Sequence: Synthetic oligonucleotide
  Target: ATXN1; (-) strand; PAM type: NRG; PAM sequence: CAG
ttatatctctgtctcaggaa

SEQ ID NO: 72776 - DNA, 20 bp, Artificial Sequence
  Description of Artificial Sequence: Synthetic oligonucleotide
  Target: ATXN1; (-) strand; PAM type: NRG; PAM sequence: AGG
gggcattatatctctgtctc

SEQ ID NO: 72777 - DNA, 20 bp, Artificial Sequence
  Description of Artificial Sequence: Synthetic oligonucleotide
  Target: ATXN1; (-) strand; PAM type: NRG; PAM sequence: CAG
agggcattatatctctgtct

SEQ ID NO: 72778 - DNA, 20 bp, Artificial Sequence
  Description of Artificial Sequence: Synthetic oligonucleotide
  Target: ATXN1; (-) strand; PAM type: NRG; PAM sequence: GGG
tgagtaccctgtaatttgca

SEQ ID NO: 72779 - DNA, 20 bp, Artificial Sequence
  Description of Artificial Sequence: Synthetic oligonucleotide
  Target: ATXN1; (-) strand; PAM type: NRG; PAM sequence: AGG
atgagtaccctgtaatttgc

SEQ ID NO: 72780 - DNA, 20 bp, Artificial Sequence
  Description of Artificial Sequence: Synthetic oligonucleotide
  Target: ATXN1; (-) strand; PAM type: NRG; PAM sequence: CAG
catgagtaccctgtaatttg

SEQ ID NO: 72781 - DNA, 20 bp, Artificial Sequence
  Description of Artificial Sequence: Synthetic oligonucleotide
  Target: ATXN1; (-) strand; PAM type: NRG; PAM sequence: GAG
cccacccgagatttggccat

SEQ ID NO: 72782 - DNA, 20 bp, Artificial Sequence
  Description of Artificial Sequence: Synthetic oligonucleotide
  Target: ATXN1; (-) strand; PAM type: NRG; PAM sequence: TGG
tcccagccccacccgagatt

SEQ ID NO: 72783 - DNA, 20 bp, Artificial Sequence
  Description of Artificial Sequence: Synthetic oligonucleotide
  Target: ATXN1; (-) strand; PAM type: NRG; PAM sequence: GAG
ctcccatcccagccccaccc

SEQ ID NO: 72784 - DNA, 20 bp, Artificial Sequence
  Description of Artificial Sequence: Synthetic oligonucleotide
  Target: ATXN1; (-) strand; PAM type: NRG; PAM sequence: CAG
cgtcatctttactcccatcc

SEQ ID NO: 72785 - DNA, 20 bp, Artificial Sequence
  Description of Artificial Sequence: Synthetic oligonucleotide
  Target: ATXN1; (-) strand; PAM type: NRG; PAM sequence: TGG
taaccagtttctgccacaac

SEQ ID NO: 72786 - DNA, 20 bp, Artificial Sequence
  Description of Artificial Sequence: Synthetic oligonucleotide
  Target: ATXN1; (-) strand; PAM type: NRG; PAM sequence: CAG
ctgttttttcaacaactaac

SEQ ID NO: 72787 - DNA, 20 bp, Artificial Sequence
  Description of Artificial Sequence: Synthetic oligonucleotide
  Target: ATXN1; (-) strand; PAM type: NRG; PAM sequence: GGG
cctgtatgtcaaggagtaca

SEQ ID NO: 72788 - DNA, 20 bp, Artificial Sequence
  Description of Artificial Sequence: Synthetic oligonucleotide
  Target: ATXN1; (-) strand; PAM type: NRG; PAM sequence: AGG
gcctgtatgtcaaggagtac

SEQ ID NO: 72789 - DNA, 20 bp, Artificial Sequence
  Description of Artificial Sequence: Synthetic oligonucleotide
  Target: ATXN1; (-) strand; PAM type: NRG; PAM sequence: CAG
agcctgtatgtcaaggagta

SEQ ID NO: 72790 - DNA, 20 bp, Artificial Sequence
  Description of Artificial Sequence: Synthetic oligonucleotide
  Target: ATXN1; (-) strand; PAM type: NRG; PAM sequence: GAG
ttgtcagcctgtatgtcaag

SEQ ID NO: 72791 - DNA, 20 bp, Artificial Sequence
  Description of Artificial Sequence: Synthetic oligonucleotide
  Target: ATXN1; (-) strand; PAM type: NRG; PAM sequence: AGG
aattgtcagcctgtatgtca

SEQ ID NO: 72792 - DNA, 20 bp, Artificial Sequence
  Description of Artificial Sequence: Synthetic oligonucleotide
  Target: ATXN1; (-) strand; PAM type: NRG; PAM sequence: AAG
gaattgtcagcctgtatgtc

SEQ ID NO: 72793 - DNA, 20 bp, Artificial Sequence
  Description of Artificial Sequence: Synthetic oligonucleotide
  Target: ATXN1; (-) strand; PAM type: NRG; PAM sequence: CAG
caggtaaagtggagaattgt

SEQ ID NO: 72794 - DNA, 20 bp, Artificial Sequence
  Description of Artificial Sequence: Synthetic oligonucleotide
  Target: ATXN1; (-) strand; PAM type: NRG; PAM sequence: GAG
agtcaactgcaggtaaagtg

SEQ ID NO: 72795 - DNA, 20 bp, Artificial Sequence
  Description of Artificial Sequence: Synthetic oligonucleotide
  Target: ATXN1; (-) strand; PAM type: NRG; PAM sequence: TGG
atagtcaactgcaggtaaag

SEQ ID NO: 72796 - DNA, 20 bp, Artificial Sequence
  Description of Artificial Sequence: Synthetic oligonucleotide
  Target: ATXN1; (-) strand; PAM type: NRG; PAM sequence: AAG
gacatagtcaactgcaggta

SEQ ID NO: 72797 - DNA, 20 bp, Artificial Sequence
  Description of Artificial Sequence: Synthetic oligonucleotide
  Target: ATXN1; (-) strand; PAM type: NRG; PAM sequence: AGG
atgtggacatagtcaactgc

SEQ ID NO: 72798 - DNA, 20 bp, Artificial Sequence
  Description of Artificial Sequence: Synthetic oligonucleotide
  Target: ATXN1; (-) strand; PAM type: NRG; PAM sequence: CAG
catgtggacatagtcaactg

SEQ ID NO: 72799 - DNA, 20 bp, Artificial Sequence
  Description of Artificial Sequence: Synthetic oligonucleotide
  Target: ATXN1; (-) strand; PAM type: NRG; PAM sequence: TAG
agaatttagtcatgtggaca

SEQ ID NO: 72800 - DNA, 20 bp, Artificial Sequence
  Description of Artificial Sequence: Synthetic oligonucleotide
  Target: ATXN1; (-) strand; PAM type: NRG; PAM sequence: TGG
ttgaccagaatttagtcatg

SEQ ID NO: 72801 - DNA, 20 bp, Artificial Sequence
  Description of Artificial Sequence: Synthetic oligonucleotide
  Target: ATXN1; (-) strand; PAM type: NRG; PAM sequence: TAG
atgttcccttgaccagaatt

SEQ ID NO: 72802 - DNA, 20 bp, Artificial Sequence
  Description of Artificial Sequence: Synthetic oligonucleotide
  Target: ATXN1; (-) strand; PAM type: NRG; PAM sequence: CAG
tccttccatgttcccttgac

SEQ ID NO: 72803 - DNA, 20 bp, Artificial Sequence
  Description of Artificial Sequence: Synthetic oligonucleotide
  Target: ATXN1; (-) strand; PAM type: NRG; PAM sequence: TGG
gggaggtttgttggtgaaat

SEQ ID NO: 72804 - DNA, 20 bp, Artificial Sequence
  Description of Artificial Sequence: Synthetic oligonucleotide
  Target: ATXN1; (-) strand; PAM type: NRG; PAM sequence: TGG
cagtctcctgggaggtttgt

SEQ ID NO: 72805 - DNA, 20 bp, Artificial Sequence
  Description of Artificial Sequence: Synthetic oligonucleotide
  Target: ATXN1; (-) strand; PAM type: NRG; PAM sequence: AGG
agagtgagcagtctcctggg

SEQ ID NO: 72806 - DNA, 20 bp, Artificial Sequence
  Description of Artificial Sequence: Synthetic oligonucleotide
  Target: ATXN1; (-) strand; PAM type: NRG; PAM sequence: GAG
gagagtgagcagtctcctgg

SEQ ID NO: 72807 - DNA, 20 bp, Artificial Sequence
  Description of Artificial Sequence: Synthetic oligonucleotide
  Target: ATXN1; (-) strand; PAM type: NRG; PAM sequence: GGG
gagagagtgagcagtctcct

SEQ ID NO: 72808 - DNA, 20 bp, Artificial Sequence
  Description of Artificial Sequence: Synthetic oligonucleotide
  Target: ATXN1; (-) strand; PAM type: NRG; PAM sequence: TGG
cgagagagtgagcagtctcc

SEQ ID NO: 72809 - DNA, 20 bp, Artificial Sequence
  Description of Artificial Sequence: Synthetic oligonucleotide
  Target: ATXN1; (-) strand; PAM type: NRG; PAM sequence: CAG
tggggaagcgagagagtgag

SEQ ID NO: 72810 - DNA, 20 bp, Artificial Sequence
  Description of Artificial Sequence: Synthetic oligonucleotide
  Target: ATXN1; (-) strand; PAM type: NRG; PAM sequence: GAG
aagtggggaagcgagagagt

SEQ ID NO: 72811 - DNA, 20 bp, Artificial Sequence
  Description of Artificial Sequence: Synthetic oligonucleotide
  Target: ATXN1; (-) strand; PAM type: NRG; PAM sequence: GAG
agagaagtggggaagcgaga

SEQ ID NO: 72812 - DNA, 20 bp, Artificial Sequence
  Description of Artificial Sequence: Synthetic oligonucleotide
  Target: ATXN1; (-) strand; PAM type: NRG; PAM sequence: GAG
agagagaagtggggaagcga

SEQ ID NO: 72813 - DNA, 20 bp, Artificial Sequence
  Description of Artificial Sequence: Synthetic oligonucleotide
  Target: ATXN1; (-) strand; PAM type: NRG; PAM sequence: GAG
gaagagagaagtggggaagc

SEQ ID NO: 72814 - DNA, 20 bp, Artificial Sequence
  Description of Artificial Sequence: Synthetic oligonucleotide
  Target: ATXN1; (-) strand; PAM type: NRG; PAM sequence: AAG
ggcagaagagagaagtgggg

SEQ ID NO: 72815 - DNA, 20 bp, Artificial Sequence
  Description of Artificial Sequence: Synthetic oligonucleotide
  Target: ATXN1; (-) strand; PAM type: NRG; PAM sequence: GGG
cctggcagaagagagaagtg

SEQ ID NO: 72816 - DNA, 20 bp, Artificial Sequence
  Description of Artificial Sequence: Synthetic oligonucleotide
  Target: ATXN1; (-) strand; PAM type: NRG; PAM sequence: GGG
acctggcagaagagagaagt

SEQ ID NO: 72817 - DNA, 20 bp, Artificial Sequence
  Description of Artificial Sequence: Synthetic oligonucleotide
  Target: ATXN1; (-) strand; PAM type: NRG; PAM sequence: TGG
cacctggcagaagagagaag

SEQ ID NO: 72818 - DNA, 20 bp, Artificial Sequence
  Description of Artificial Sequence: Synthetic oligonucleotide
  Target: ATXN1; (-) strand; PAM type: NRG; PAM sequence: AAG
ctgcacctggcagaagagag

SEQ ID NO: 72819 - DNA, 20 bp, Artificial Sequence
  Description of Artificial Sequence: Synthetic oligonucleotide
  Target: ATXN1; (-) strand; PAM type: NRG; PAM sequence: GAG
cttctgcacctggcagaaga

SEQ ID NO: 72820 - DNA, 20 bp, Artificial Sequence
  Description of Artificial Sequence: Synthetic oligonucleotide
  Target: ATXN1; (-) strand; PAM type: NRG; PAM sequence: GAG
atcttctgcacctggcagaa

SEQ ID NO: 72821 - DNA, 20 bp, Artificial Sequence
  Description of Artificial Sequence: Synthetic oligonucleotide
  Target: ATXN1; (-) strand; PAM type: NRG; PAM sequence: AAG
ggatcttctgcacctggcag

SEQ ID NO: 72822 - DNA, 20 bp, Artificial Sequence
  Description of Artificial Sequence: Synthetic oligonucleotide
  Target: ATXN1; (-) strand; PAM type: NRG; PAM sequence: CAG
taaggatcttctgcacctgg

SEQ ID NO: 72823 - DNA, 20 bp, Artificial Sequence
  Description of Artificial Sequence: Synthetic oligonucleotide
  Target: ATXN1; (-) strand; PAM type: NRG; PAM sequence: TGG
ccctaaggatcttctgcacc

SEQ ID NO: 72824 - DNA, 20 bp, Artificial Sequence
  Description of Artificial Sequence: Synthetic oligonucleotide
  Target: ATXN1; (-) strand; PAM type: NRG; PAM sequence: AGG
ctcagtgttgggagacccta

SEQ ID NO: 72825 - DNA, 20 bp, Artificial Sequence
  Description of Artificial Sequence: Synthetic oligonucleotide
  Target: ATXN1; (-) strand; PAM type: NRG; PAM sequence: AAG
cctcagtgttgggagaccct

SEQ ID NO: 72826 - DNA, 20 bp, Artificial Sequence
  Description of Artificial Sequence: Synthetic oligonucleotide
  Target: ATXN1; (-) strand; PAM type: NRG; PAM sequence: GAG
agacattccctcagtgttgg

SEQ ID NO: 72827 - DNA, 20 bp, Artificial Sequence
  Description of Artificial Sequence: Synthetic oligonucleotide
  Target: ATXN1; (-) strand; PAM type: NRG; PAM sequence: GGG
tcagacattccctcagtgtt

SEQ ID NO: 72828 - DNA, 20 bp, Artificial Sequence
  Description of Artificial Sequence: Synthetic oligonucleotide
  Target: ATXN1; (-) strand; PAM type: NRG; PAM sequence: TGG
ctcagacattccctcagtgt

SEQ ID NO: 72829 - DNA, 20 bp, Artificial Sequence
  Description of Artificial Sequence: Synthetic oligonucleotide
  Target: ATXN1; (-) strand; PAM type: NRG; PAM sequence: CAG
gcaaggctcagacattccct

SEQ ID NO: 72830 - DNA, 20 bp, Artificial Sequence
  Description of Artificial Sequence: Synthetic oligonucleotide
  Target: ATXN1; (-) strand; PAM type: NRG; PAM sequence: CAG
ggtccttgtatcgcaaggct

SEQ ID NO: 72831 - DNA, 20 bp, Artificial Sequence
  Description of Artificial Sequence: Synthetic oligonucleotide
  Target: ATXN1; (-) strand; PAM type: NRG; PAM sequence: AGG
cccagggtccttgtatcgca

SEQ ID NO: 72832 - DNA, 20 bp, Artificial Sequence
  Description of Artificial Sequence: Synthetic oligonucleotide
  Target: ATXN1; (-) strand; PAM type: NRG; PAM sequence: AAG
acccagggtccttgtatcgc

SEQ ID NO: 72833 - DNA, 20 bp, Artificial Sequence
  Description of Artificial Sequence: Synthetic oligonucleotide
  Target: ATXN1; (-) strand; PAM type: NRG; PAM sequence: GGG
ggtggtgattccctgaccca

SEQ ID NO: 72834 - DNA, 20 bp, Artificial Sequence
  Description of Artificial Sequence: Synthetic oligonucleotide
  Target: ATXN1; (-) strand; PAM type: NRG; PAM sequence: AGG
tggtggtgattccctgaccc

SEQ ID NO: 72835 - DNA, 20 bp, Artificial Sequence
  Description of Artificial Sequence: Synthetic oligonucleotide
  Target: ATXN1; (-) strand; PAM type: NRG; PAM sequence: CAG
atggtggtgattccctgacc

SEQ ID NO: 72836 - DNA, 20 bp, Artificial Sequence
  Description of Artificial Sequence: Synthetic oligonucleotide
  Target: ATXN1; (-) strand; PAM type: NRG; PAM sequence: TGG
tggagagggcgtctgtatgg

SEQ ID NO: 72837 - DNA, 20 bp, Artificial Sequence
  Description of Artificial Sequence: Synthetic oligonucleotide
  Target: ATXN1; (-) strand; PAM type: NRG; PAM sequence: TGG
agttggagagggcgtctgta

SEQ ID NO: 72838 - DNA, 20 bp, Artificial Sequence
  Description of Artificial Sequence: Synthetic oligonucleotide
  Target: ATXN1; (-) strand; PAM type: NRG; PAM sequence: GGG
gggtgttctgcagttggaga

SEQ ID NO: 72839 - DNA, 20 bp, Artificial Sequence
  Description of Artificial Sequence: Synthetic oligonucleotide
  Target: ATXN1; (-) strand; PAM type: NRG; PAM sequence: AGG
ggggtgttctgcagttggag

SEQ ID NO: 72840 - DNA, 20 bp, Artificial Sequence
  Description of Artificial Sequence: Synthetic oligonucleotide
  Target: ATXN1; (-) strand; PAM type: NRG; PAM sequence: GAG
tggggtgttctgcagttgga

SEQ ID NO: 72841 - DNA, 20 bp, Artificial Sequence
  Description of Artificial Sequence: Synthetic oligonucleotide
  Target: ATXN1; (-) strand; PAM type: NRG; PAM sequence: GAG
cttggggtgttctgcagttg

SEQ ID NO: 72842 - DNA, 20 bp, Artificial Sequence
  Description of Artificial Sequence: Synthetic oligonucleotide
  Target: ATXN1; (-) strand; PAM type: NRG; PAM sequence: TGG
aacttggggtgttctgcagt

SEQ ID NO: 72843 - DNA, 20 bp, Artificial Sequence
  Description of Artificial Sequence: Synthetic oligonucleotide
  Target: ATXN1; (-) strand; PAM type: NRG; PAM sequence: CAG
ggataacttggggtgttctg

SEQ ID NO: 72844 - DNA, 20 bp, Artificial Sequence
  Description of Artificial Sequence: Synthetic oligonucleotide
  Target: ATXN1; (-) strand; PAM type: NRG; PAM sequence: GGG
atggtgttacggataacttg

SEQ ID NO: 72845 - DNA, 20 bp, Artificial Sequence
  Description of Artificial Sequence: Synthetic oligonucleotide
  Target: ATXN1; (-) strand; PAM type: NRG; PAM sequence: GGG
gatggtgttacggataactt

SEQ ID NO: 72846 - DNA, 20 bp, Artificial Sequence
  Description of Artificial Sequence: Synthetic oligonucleotide
  Target: ATXN1; (-) strand; PAM type: NRG; PAM sequence: TGG
tgatggtgttacggataact

SEQ ID NO: 72847 - DNA, 20 bp, Artificial Sequence
  Description of Artificial Sequence: Synthetic oligonucleotide
  Target: ATXN1; (-) strand; PAM type: NRG; PAM sequence: CGG
gttcctttttgatggtgtta

SEQ ID NO: 72848 - DNA, 20 bp, Artificial Sequence
  Description of Artificial Sequence: Synthetic oligonucleotide
  Target: ATXN1; (-) strand; PAM type: NRG; PAM sequence: TGG
cagtagaagttcctttttga

SEQ ID NO: 72849 - DNA, 20 bp, Artificial Sequence
  Description of Artificial Sequence: Synthetic oligonucleotide
  Target: ATXN1; (-) strand; PAM type: NRG; PAM sequence: AAG
ttcagggtggaacacagtag

SEQ ID NO: 72850 - DNA, 20 bp, Artificial Sequence
  Description of Artificial Sequence: Synthetic oligonucleotide
  Target: ATXN1; (-) strand; PAM type: NRG; PAM sequence: TAG
ctcttcagggtggaacacag

SEQ ID NO: 72851 - DNA, 20 bp, Artificial Sequence
  Description of Artificial Sequence: Synthetic oligonucleotide
  Target: ATXN1; (-) strand; PAM type: NRG; PAM sequence: CAG
caactcttcagggtggaaca

SEQ ID NO: 72852 - DNA, 20 bp, Artificial Sequence
  Description of Artificial Sequence: Synthetic oligonucleotide
  Target: ATXN1; (-) strand; PAM type: NRG; PAM sequence: TGG
gcaaccccaactcttcaggg

SEQ ID NO: 72853 - DNA, 20 bp, Artificial Sequence
  Description of Artificial Sequence: Synthetic oligonucleotide
  Target: ATXN1; (-) strand; PAM type: NRG; PAM sequence: GGG
caagcaaccccaactcttca

SEQ ID NO: 72854 - DNA, 20 bp, Artificial Sequence
  Description of Artificial Sequence: Synthetic oligonucleotide
  Target: ATXN1; (-) strand; PAM type: NRG; PAM sequence: AGG
acaagcaaccccaactcttc

SEQ ID NO: 72855 - DNA, 20 bp, Artificial Sequence
  Description of Artificial Sequence: Synthetic oligonucleotide
  Target: ATXN1; (-) strand; PAM type: NRG; PAM sequence: CAG
aacaagcaaccccaactctt

SEQ ID NO: 72856 - DNA, 20 bp, Artificial Sequence
  Description of Artificial Sequence: Synthetic oligonucleotide
  Target: ATXN1; (-) strand; PAM type: NRG; PAM sequence: AAG
ggcaaggatgttgcaataac

SEQ ID NO: 72857 - DNA, 20 bp, Artificial Sequence
  Description of Artificial Sequence: Synthetic oligonucleotide
  Target: ATXN1; (-) strand; PAM type: NRG; PAM sequence: AGG
agatgatggtacaatgggca

SEQ ID NO: 72858 - DNA, 20 bp, Artificial Sequence
  Description of Artificial Sequence: Synthetic oligonucleotide
  Target: ATXN1; (-) strand; PAM type: NRG; PAM sequence: AAG
gagatgatggtacaatgggc

SEQ ID NO: 72859 - DNA, 20 bp, Artificial Sequence
  Description of Artificial Sequence: Synthetic oligonucleotide
  Target: ATXN1; (-) strand; PAM type: NRG; PAM sequence: GGG
caaagagatgatggtacaat

SEQ ID NO: 72860 - DNA, 20 bp, Artificial Sequence
  Description of Artificial Sequence: Synthetic oligonucleotide
  Target: ATXN1; (-) strand; PAM type: NRG; PAM sequence: TGG
acaaagagatgatggtacaa

SEQ ID NO: 72861 - DNA, 20 bp, Artificial Sequence
  Description of Artificial Sequence: Synthetic oligonucleotide
  Target: ATXN1; (-) strand; PAM type: NRG; PAM sequence: TGG
gagatgcaacaaagagatga

SEQ ID NO: 72862 - DNA, 20 bp, Artificial Sequence
  Description of Artificial Sequence: Synthetic oligonucleotide
  Target: ATXN1; (-) strand; PAM type: NRG; PAM sequence: GAG
atttcctgagatgcaacaaa

SEQ ID NO: 72863 - DNA, 20 bp, Artificial Sequence
  Description of Artificial Sequence: Synthetic oligonucleotide
  Target: ATXN1; (-) strand; PAM type: NRG; PAM sequence: AAG
acatttcctgagatgcaaca

SEQ ID NO: 72864 - DNA, 20 bp, Artificial Sequence
  Description of Artificial Sequence: Synthetic oligonucleotide
  Target: ATXN1; (-) strand; PAM type: NRG; PAM sequence: GAG
gaatgtaaaggacatttcct

SEQ ID NO: 72865 - DNA, 20 bp, Artificial Sequence
  Description of Artificial Sequence: Synthetic oligonucleotide
  Target: ATXN1; (-) strand; PAM type: NRG; PAM sequence: AGG
tccagggcaggtgaatgtaa

SEQ ID NO: 72866 - DNA, 20 bp, Artificial Sequence
  Description of Artificial Sequence: Synthetic oligonucleotide
  Target: ATXN1; (-) strand; PAM type: NRG; PAM sequence: AAG
gtccagggcaggtgaatgta

SEQ ID NO: 72867 - DNA, 20 bp, Artificial Sequence
  Description of Artificial Sequence: Synthetic oligonucleotide
  Target: ATXN1; (-) strand; PAM type: NRG; PAM sequence: AGG
cctagtggattgtccagggc

SEQ ID NO: 72868 - DNA, 20 bp, Artificial Sequence
  Description of Artificial Sequence: Synthetic oligonucleotide
  Target: ATXN1; (-) strand; PAM type: NRG; PAM sequence: CAG
acctagtggattgtccaggg

SEQ ID NO: 72869 - DNA, 20 bp, Artificial Sequence
  Description of Artificial Sequence: Synthetic oligonucleotide
  Target: ATXN1; (-) strand; PAM type: NRG; PAM sequence: GGG
caaacctagtggattgtcca

SEQ ID NO: 72870 - DNA, 20 bp, Artificial Sequence
  Description of Artificial Sequence: Synthetic oligonucleotide
  Target: ATXN1; (-) strand; PAM type: NRG; PAM sequence: AGG
acaaacctagtggattgtcc

SEQ ID NO: 72871 - DNA, 20 bp, Artificial Sequence
  Description of Artificial Sequence: Synthetic oligonucleotide
  Target: ATXN1; (-) strand; PAM type: NRG; PAM sequence: CAG
aacaaacctagtggattgtc

SEQ ID NO: 72872 - DNA, 20 bp, Artificial Sequence
  Description of Artificial Sequence: Synthetic oligonucleotide
  Target: ATXN1; (-) strand; PAM type: NRG; PAM sequence: TGG
ttgaggacaaacaaacctag

SEQ ID NO: 72873 - DNA, 20 bp, Artificial Sequence
  Description of Artificial Sequence: Synthetic oligonucleotide
  Target: ATXN1; (-) strand; PAM type: NRG; PAM sequence: TAG
cgtttgaggacaaacaaacc

SEQ ID NO: 72874 - DNA, 20 bp, Artificial Sequence
  Description of Artificial Sequence: Synthetic oligonucleotide
  Target: ATXN1; (-) strand; PAM type: NRG; PAM sequence: AGG
gtgtgaggccatttcgtttg

SEQ ID NO: 72875 - DNA, 20 bp, Artificial Sequence
  Description of Artificial Sequence: Synthetic oligonucleotide
  Target: ATXN1; (-) strand; PAM type: NRG; PAM sequence: GAG
ggtgtgaggccatttcgttt

SEQ ID NO: 72876 - DNA, 20 bp, Artificial Sequence
  Description of Artificial Sequence: Synthetic oligonucleotide
  Target: ATXN1; (-) strand; PAM type: NRG; PAM sequence: AGG
tataaaatctcagcggtgtg

SEQ ID NO: 72877 - DNA, 20 bp, Artificial Sequence
  Description of Artificial Sequence: Synthetic oligonucleotide
  Target: ATXN1; (-) strand; PAM type: NRG; PAM sequence: GAG
ttataaaatctcagcggtgt

SEQ ID NO: 72878 - DNA, 20 bp, Artificial Sequence
  Description of Artificial Sequence: Synthetic oligonucleotide
  Target: ATXN1; (-) strand; PAM type: NRG; PAM sequence: CGG
gaagtattataaaatctcag

SEQ ID NO: 72879 - DNA, 20 bp, Artificial Sequence
  Description of Artificial Sequence: Synthetic oligonucleotide
  Target: ATXN1; (-) strand; PAM type: NRG; PAM sequence: CAG
cttgaagtattataaaatct

SEQ ID NO: 72880 - DNA, 20 bp, Artificial Sequence
  Description of Artificial Sequence: Synthetic oligonucleotide
  Target: ATXN1; (-) strand; PAM type: NRG; PAM sequence: AAG
agaaaacctataaaaacttg

SEQ ID NO: 72881 - DNA, 20 bp, Artificial Sequence
  Description of Artificial Sequence: Synthetic oligonucleotide
  Target: ATXN1; (-) strand; PAM type: NRG; PAM sequence: GAG
actaaccacagtgaaggaag

SEQ ID NO: 72882 - DNA, 20 bp, Artificial Sequence
  Description of Artificial Sequence: Synthetic oligonucleotide
  Target: ATXN1; (-) strand; PAM type: NRG; PAM sequence: AGG
ttactaaccacagtgaagga

SEQ ID NO: 72883 - DNA, 20 bp, Artificial Sequence
  Description of Artificial Sequence: Synthetic oligonucleotide
  Target: ATXN1; (-) strand; PAM type: NRG; PAM sequence: AAG
cttactaaccacagtgaagg

SEQ ID NO: 72884 - DNA, 20 bp, Artificial Sequence
  Description of Artificial Sequence: Synthetic oligonucleotide
  Target: ATXN1; (-) strand; PAM type: NRG; PAM sequence: AGG
aaacttactaaccacagtga

SEQ ID NO: 72885 - DNA, 20 bp, Artificial Sequence
  Description of Artificial Sequence: Synthetic oligonucleotide
  Target: ATXN1; (-) strand; PAM type: NRG; PAM sequence: AAG
taaacttactaaccacagtg

SEQ ID NO: 72886 - DNA, 20 bp, Artificial Sequence
  Description of Artificial Sequence: Synthetic oligonucleotide
  Target: ATXN1; (-) strand; PAM type: NRG; PAM sequence: CAG
tgggttaaacttactaacca

SEQ ID NO: 72887 - DNA, 20 bp, Artificial Sequence
  Description of Artificial Sequence: Synthetic oligonucleotide
  Target: ATXN1; (-) strand; PAM type: NRG; PAM sequence: GGG
aggaataagagggctttctt

SEQ ID NO: 72888 - DNA, 20 bp, Artificial Sequence
  Description of Artificial Sequence: Synthetic oligonucleotide
  Target: ATXN1; (-) strand; PAM type: NRG; PAM sequence: TGG
aaggaataagagggctttct

SEQ ID NO: 72889 - DNA, 20 bp, Artificial Sequence
  Description of Artificial Sequence: Synthetic oligonucleotide
  Target: ATXN1; (-) strand; PAM type: NRG; PAM sequence: GGG
atagattagaaggaataaga

SEQ ID NO: 72890 - DNA, 20 bp, Artificial Sequence
  Description of Artificial Sequence: Synthetic oligonucleotide
  Target: ATXN1; (-) strand; PAM type: NRG; PAM sequence: AGG
aatagattagaaggaataag

SEQ ID NO: 72891 - DNA, 20 bp, Artificial Sequence
  Description of Artificial Sequence: Synthetic oligonucleotide
  Target: ATXN1; (-) strand; PAM type: NRG; PAM sequence: GAG
aaatagattagaaggaataa

SEQ ID NO: 72892 - DNA, 20 bp, Artificial Sequence
  Description of Artificial Sequence: Synthetic oligonucleotide
  Target: ATXN1; (-) strand; PAM type: NRG; PAM sequence: AAG
ccaaatagattagaaggaat

SEQ ID NO: 72893 - DNA, 20 bp, Artificial Sequence
  Description of Artificial Sequence: Synthetic oligonucleotide
  Target: ATXN1; (-) strand; PAM type: NRG; PAM sequence: AGG
agtttcccaaatagattaga

SEQ ID NO: 72894 - DNA, 20 bp, Artificial Sequence
  Description of Artificial Sequence: Synthetic oligonucleotide
  Target: ATXN1; (-) strand; PAM type: NRG; PAM sequence: AAG
cagtttcccaaatagattag

SEQ ID NO: 72895 - DNA, 20 bp, Artificial Sequence
  Description of Artificial Sequence: Synthetic oligonucleotide
  Target: ATXN1; (-) strand; PAM type: NRG; PAM sequence: TAG
cttcagtttcccaaatagat

SEQ ID NO: 72896 - DNA, 20 bp, Artificial Sequence
  Description of Artificial Sequence: Synthetic oligonucleotide
  Target: ATXN1; (-) strand; PAM type: NRG; PAM sequence: TAG
cacttcttcagtttcccaaa

SEQ ID NO: 72897 - DNA, 20 bp, Artificial Sequence
  Description of Artificial Sequence: Synthetic oligonucleotide
  Target: ATXN1; (-) strand; PAM type: NRG; PAM sequence: CAG
attcaacacattcacttctt

SEQ ID NO: 72898 - DNA, 20 bp, Artificial Sequence
  Description of Artificial Sequence: Synthetic oligonucleotide
  Target: ATXN1; (-) strand; PAM type: NRG; PAM sequence: TAG
aaggacactcaaagtaagat

SEQ ID NO: 72899 - DNA, 20 bp, Artificial Sequence
  Description of Artificial Sequence: Synthetic oligonucleotide
  Target: ATXN1; (-) strand; PAM type: NRG; PAM sequence: AAG
ctcacaaggacactcaaagt

SEQ ID NO: 72900 - DNA, 20 bp, Artificial Sequence
  Description of Artificial Sequence: Synthetic oligonucleotide
  Target: ATXN1; (-) strand; PAM type: NRG; PAM sequence: AAG
ttgactcacaaggacactca

SEQ ID NO: 72901 - DNA, 20 bp, Artificial Sequence
  Description of Artificial Sequence: Synthetic oligonucleotide
  Target: ATXN1; (-) strand; PAM type: NRG; PAM sequence: AGG
cagagccctgttgactcaca

SEQ ID NO: 72902 - DNA, 20 bp, Artificial Sequence
  Description of Artificial Sequence: Synthetic oligonucleotide
  Target: ATXN1; (-) strand; PAM type: NRG; PAM sequence: AAG
ccagagccctgttgactcac

SEQ ID NO: 72903 - DNA, 20 bp, Artificial Sequence
  Description of Artificial Sequence: Synthetic oligonucleotide
  Target: ATXN1; (-) strand; PAM type: NRG; PAM sequence: GAG
atgaagccctggtgaaccca

SEQ ID NO: 72904 - DNA, 20 bp, Artificial Sequence
  Description of Artificial Sequence: Synthetic oligonucleotide
  Target: ATXN1; (-) strand; PAM type: NRG; PAM sequence: CAG
agatgaagccctggtgaacc

SEQ ID NO: 72905 - DNA, 20 bp, Artificial Sequence
  Description of Artificial Sequence: Synthetic oligonucleotide
  Target: ATXN1; (-) strand; PAM type: NRG; PAM sequence: TGG
tatacttatagatgaagccc

SEQ ID NO: 72906 - DNA, 20 bp, Artificial Sequence
  Description of Artificial Sequence: Synthetic oligonucleotide
  Target: ATXN1; (-) strand; PAM type: NRG; PAM sequence: AAG
ctgaattatacttatagatg

SEQ ID NO: 72907 - DNA, 20 bp, Artificial Sequence
  Description of Artificial Sequence: Synthetic oligonucleotide
  Target: ATXN1; (-) strand; PAM type: NRG; PAM sequence: TAG
aaaattctgaattatactta

SEQ ID NO: 72908 - DNA, 20 bp, Artificial Sequence
  Description of Artificial Sequence: Synthetic oligonucleotide
  Target: ATXN1; (-) strand; PAM type: NRG; PAM sequence: GAG
ggaaaaaccttcttgggaag

SEQ ID NO: 72909 - DNA, 20 bp, Artificial Sequence
  Description of Artificial Sequence: Synthetic oligonucleotide
  Target: ATXN1; (-) strand; PAM type: NRG; PAM sequence: AGG
taggaaaaaccttcttggga

SEQ ID NO: 72910 - DNA, 20 bp, Artificial Sequence
  Description of Artificial Sequence: Synthetic oligonucleotide
  Target: ATXN1; (-) strand; PAM type: NRG; PAM sequence: AAG
ataggaaaaaccttcttggg

SEQ ID NO: 72911 - DNA, 20 bp, Artificial Sequence
  Description of Artificial Sequence: Synthetic oligonucleotide
  Target: ATXN1; (-) strand; PAM type: NRG; PAM sequence: GGG
atgataggaaaaaccttctt

SEQ ID NO: 72912 - DNA, 20 bp, Artificial Sequence
  Description of Artificial Sequence: Synthetic oligonucleotide
  Target: ATXN1; (-) strand; PAM type: NRG; PAM sequence: TGG
aatgataggaaaaaccttct

SEQ ID NO: 72913 - DNA, 20 bp, Artificial Sequence
  Description of Artificial Sequence: Synthetic oligonucleotide
  Target: ATXN1; (-) strand; PAM type: NRG; PAM sequence: AGG
acttgaaacctggaaatgat

SEQ ID NO: 72914 - DNA, 20 bp, Artificial Sequence
  Description of Artificial Sequence: Synthetic oligonucleotide
  Target: ATXN1; (-) strand; PAM type: NRG; PAM sequence: TAG
tacttgaaacctggaaatga

SEQ ID NO: 72915 - DNA, 20 bp, Artificial Sequence
  Description of Artificial Sequence: Synthetic oligonucleotide
  Target: ATXN1; (-) strand; PAM type: NRG; PAM sequence: TGG
cgtgggtcctacttgaaacc

SEQ ID NO: 72916 - DNA, 20 bp, Artificial Sequence
  Description of Artificial Sequence: Synthetic oligonucleotide
  Target: ATXN1; (-) strand; PAM type: NRG; PAM sequence: GGG
tctgtgaccctaatctacgt

SEQ ID NO: 72917 - DNA, 20 bp, Artificial Sequence
  Description of Artificial Sequence: Synthetic oligonucleotide
  Target: ATXN1; (-) strand; PAM type: NRG; PAM sequence: TGG
ttctgtgaccctaatctacg

SEQ ID NO: 72918 - DNA, 20 bp, Artificial Sequence
  Description of Artificial Sequence: Synthetic oligonucleotide
  Target: ATXN1; (-) strand; PAM type: NRG; PAM sequence: CAG
atgatcctagttatcttagg

SEQ ID NO: 72919 - DNA, 20 bp, Artificial Sequence
  Description of Artificial Sequence: Synthetic oligonucleotide
  Target: ATXN1; (-) strand; PAM type: NRG; PAM sequence: AGG
gatatgatcctagttatctt

SEQ ID NO: 72920 - DNA, 20 bp, Artificial Sequence
  Description of Artificial Sequence: Synthetic oligonucleotide
  Target: ATXN1; (-) strand; PAM type: NRG; PAM sequence: TAG
tgatatgatcctagttatct

SEQ ID NO: 72921 - DNA, 20 bp, Artificial Sequence
  Description of Artificial Sequence: Synthetic oligonucleotide
  Target: ATXN1; (-) strand; PAM type: NRG; PAM sequence: TAG
ttataaaagtgatatgatcc

SEQ ID NO: 72922 - DNA, 20 bp, Artificial Sequence
  Description of Artificial Sequence: Synthetic oligonucleotide
  Target: ATXN1; (-) strand; PAM type: NRG; PAM sequence: AAG
ttccatggatttagttataa

SEQ ID NO: 72923 - DNA, 20 bp, Artificial Sequence
  Description of Artificial Sequence: Synthetic oligonucleotide
  Target: ATXN1; (-) strand; PAM type: NRG; PAM sequence: TAG
tggtgccacttccatggatt

SEQ ID NO: 72924 - DNA, 20 bp, Artificial Sequence
  Description of Artificial Sequence: Synthetic oligonucleotide
  Target: ATXN1; (-) strand; PAM type: NRG; PAM sequence: TGG
ttcacttggtgccacttcca

SEQ ID NO: 72925 - DNA, 20 bp, Artificial Sequence
  Description of Artificial Sequence: Synthetic oligonucleotide
  Target: ATXN1; (-) strand; PAM type: NRG; PAM sequence: TGG
tgttttcaacaaagttcact

SEQ ID NO: 72926 - DNA, 20 bp, Artificial Sequence
  Description of Artificial Sequence: Synthetic oligonucleotide
  Target: ATXN1; (-) strand; PAM type: NRG; PAM sequence: AAG
tgagcaagctgttttcaaca

SEQ ID NO: 72927 - DNA, 20 bp, Artificial Sequence
  Description of Artificial Sequence: Synthetic oligonucleotide
  Target: ATXN1; (-) strand; PAM type: NRG; PAM sequence: AAG
agtgaatgaatgaagtgagc

SEQ ID NO: 72928 - DNA, 20 bp, Artificial Sequence
  Description of Artificial Sequence: Synthetic oligonucleotide
  Target: ATXN1; (-) strand; PAM type: NRG; PAM sequence: GAG
gaatagtgaatgaatgaagt

SEQ ID NO: 72929 - DNA, 20 bp, Artificial Sequence
  Description of Artificial Sequence: Synthetic oligonucleotide
  Target: ATXN1; (-) strand; PAM type: NRG; PAM sequence: AAG
aaatgaatagtgaatgaatg

SEQ ID NO: 72930 - DNA, 20 bp, Artificial Sequence
  Description of Artificial Sequence: Synthetic oligonucleotide
  Target: ATXN1; (-) strand; PAM type: NRG; PAM sequence: TAG
aggtaaactgaataaatgaa

SEQ ID NO: 72931 - DNA, 20 bp, Artificial Sequence
  Description of Artificial Sequence: Synthetic oligonucleotide
  Target: ATXN1; (-) strand; PAM type: NRG; PAM sequence: AGG
cttctcccctcttccattaa

SEQ ID NO: 72932 - DNA, 20 bp, Artificial Sequence
  Description of Artificial Sequence: Synthetic oligonucleotide
  Target: ATXN1; (-) strand; PAM type: NRG; PAM sequence: AAG
tcttctcccctcttccatta

SEQ ID NO: 72933 - DNA, 20 bp, Artificial Sequence
  Description of Artificial Sequence: Synthetic oligonucleotide
  Target: ATXN1; (-) strand; PAM type: NRG; PAM sequence: CAG
cactttcatctgtctttctt

SEQ ID NO: 72934 - DNA, 20 bp, Artificial Sequence
  Description of Artificial Sequence: Synthetic oligonucleotide
  Target: ATXN1; (-) strand; PAM type: NRG; PAM sequence: TGG
agagagttaggcgtggggaa

SEQ ID NO: 72935 - DNA, 20 bp, Artificial Sequence
  Description of Artificial Sequence: Synthetic oligonucleotide
  Target: ATXN1; (-) strand; PAM type: NRG; PAM sequence: GGG
tatatagagagttaggcgtg

SEQ ID NO: 72936 - DNA, 20 bp, Artificial Sequence
  Description of Artificial Sequence: Synthetic oligonucleotide
  Target: ATXN1; (-) strand; PAM type: NRG; PAM sequence: GGG
atatatagagagttaggcgt

SEQ ID NO: 72937 - DNA, 20 bp, Artificial Sequence
  Description of Artificial Sequence: Synthetic oligonucleotide
  Target: ATXN1; (-) strand; PAM type: NRG; PAM sequence: TGG
aatatatagagagttaggcg

SEQ ID NO: 72938 - DNA, 20 bp, Artificial Sequence
  Description of Artificial Sequence: Synthetic oligonucleotide
  Target: ATXN1; (-) strand; PAM type: NRG; PAM sequence: AGG
aggggaatatatagagagtt

SEQ ID NO: 72939 - DNA, 20 bp, Artificial Sequence
  Description of Artificial Sequence: Synthetic oligonucleotide
  Target: ATXN1; (-) strand; PAM type: NRG; PAM sequence: TAG
aaggggaatatatagagagt

SEQ ID NO: 72940 - DNA, 20 bp, Artificial Sequence
  Description of Artificial Sequence: Synthetic oligonucleotide
  Target: ATXN1; (-) strand; PAM type: NRG; PAM sequence: GAG
aaataaggggaatatataga

SEQ ID NO: 72941 - DNA, 20 bp, Artificial Sequence
  Description of Artificial Sequence: Synthetic oligonucleotide
  Target: ATXN1; (-) strand; PAM type: NRG; PAM sequence: GAG
taaaataaggggaatatata

SEQ ID NO: 72942 - DNA, 20 bp, Artificial Sequence
  Description of Artificial Sequence: Synthetic oligonucleotide
  Target: ATXN1; (-) strand; PAM type: NRG; PAM sequence: TAG
aataaaataaggggaatata

SEQ ID NO: 72943 - DNA, 20 bp, Artificial Sequence
  Description of Artificial Sequence: Synthetic oligonucleotide
  Target: ATXN1; (-) strand; PAM type: NRG; PAM sequence: GGG
caacttatgaataaaataag

SEQ ID NO: 72944 - DNA, 20 bp, Artificial Sequence
  Description of Artificial Sequence: Synthetic oligonucleotide
  Target: ATXN1; (-) strand; PAM type: NRG; PAM sequence: GGG
acaacttatgaataaaataa

SEQ ID NO: 72945 - DNA, 20 bp, Artificial Sequence
  Description of Artificial Sequence: Synthetic oligonucleotide
  Target: ATXN1; (-) strand; PAM type: NRG; PAM sequence: AGG
aacaacttatgaataaaata

SEQ ID NO: 72946 - DNA, 20 bp, Artificial Sequence
  Description of Artificial Sequence: Synthetic oligonucleotide
  Target: ATXN1; (-) strand; PAM type: NRG; PAM sequence: AAG
taacaacttatgaataaaat

SEQ ID NO: 72947 - DNA, 20 bp, Artificial Sequence
  Description of Artificial Sequence: Synthetic oligonucleotide
  Target: ATXN1; (-) strand; PAM type: NRG; PAM sequence: TAG
tttcaaattacatcttaact

SEQ ID NO: 72948 - DNA, 20 bp, Artificial Sequence
  Description of Artificial Sequence: Synthetic oligonucleotide
  Target: ATXN1; (-) strand; PAM type: NRG; PAM sequence: CAG
agctagggttttggattaga

SEQ ID NO: 72949 - DNA, 20 bp, Artificial Sequence
  Description of Artificial Sequence: Synthetic oligonucleotide
  Target: ATXN1; (-) strand; PAM type: NRG; PAM sequence: TAG
agaaagctagggttttggat

SEQ ID NO: 72950 - DNA, 20 bp, Artificial Sequence
  Description of Artificial Sequence: Synthetic oligonucleotide
  Target: ATXN1; (-) strand; PAM type: NRG; PAM sequence: TGG
agggtagaaagctagggttt

SEQ ID NO: 72951 - DNA, 20 bp, Artificial Sequence
  Description of Artificial Sequence: Synthetic oligonucleotide
  Target: ATXN1; (-) strand; PAM type: NRG; PAM sequence: GGG
ggagcaagggtagaaagcta

SEQ ID NO: 72952 - DNA, 20 bp, Artificial Sequence
  Description of Artificial Sequence: Synthetic oligonucleotide
  Target: ATXN1; (-) strand; PAM type: NRG; PAM sequence: AGG
aggagcaagggtagaaagct

SEQ ID NO: 72953 - DNA, 20 bp, Artificial Sequence
  Description of Artificial Sequence: Synthetic oligonucleotide
  Target: ATXN1; (-) strand; PAM type: NRG; PAM sequence: TAG
aaggagcaagggtagaaagc

SEQ ID NO: 72954 - DNA, 20 bp, Artificial Sequence
  Description of Artificial Sequence: Synthetic oligonucleotide
  Target: ATXN1; (-) strand; PAM type: NRG; PAM sequence: AAG
gtgcaaggagcaagggtaga

SEQ ID NO: 72955 - DNA, 20 bp, Artificial Sequence
  Description of Artificial Sequence: Synthetic oligonucleotide
  Target: ATXN1; (-) strand; PAM type: NRG; PAM sequence: TAG
cgctgtgcaaggagcaaggg

SEQ ID NO: 72956 - DNA, 20 bp, Artificial Sequence
  Description of Artificial Sequence: Synthetic oligonucleotide
  Target: ATXN1; (-) strand; PAM type: NRG; PAM sequence: GGG
aatcgctgtgcaaggagcaa

SEQ ID NO: 72957 - DNA, 20 bp, Artificial Sequence
  Description of Artificial Sequence: Synthetic oligonucleotide
  Target: ATXN1; (-) strand; PAM type: NRG; PAM sequence: AGG
aaatcgctgtgcaaggagca

SEQ ID NO: 72958 - DNA, 20 bp, Artificial Sequence
  Description of Artificial Sequence: Synthetic oligonucleotide
  Target: ATXN1; (-) strand; PAM type: NRG; PAM sequence: AAG
aaaatcgctgtgcaaggagc

SEQ ID NO: 72959 - DNA, 20 bp, Artificial Sequence
  Description of Artificial Sequence: Synthetic oligonucleotide
  Target: ATXN1; (-) strand; PAM type: NRG; PAM sequence: GAG
ccagaaaatcgctgtgcaag

SEQ ID NO: 72960 - DNA, 20 bp, Artificial Sequence
  Description of Artificial Sequence: Synthetic oligonucleotide
  Target: ATXN1; (-) strand; PAM type: NRG; PAM sequence: AGG
ctccagaaaatcgctgtgca

SEQ ID NO: 72961 - DNA, 20 bp, Artificial Sequence
  Description of Artificial Sequence: Synthetic oligonucleotide
  Target: ATXN1; (-) strand; PAM type: NRG; PAM sequence: AAG
gctccagaaaatcgctgtgc

SEQ ID NO: 72962 - DNA, 20 bp, Artificial Sequence
  Description of Artificial Sequence: Synthetic oligonucleotide
  Target: ATXN1; (-) strand; PAM type: NRG; PAM sequence: CAG
gtgatgagggtggacagctc

SEQ ID NO: 72963 - DNA, 20 bp, Artificial Sequence
  Description of Artificial Sequence: Synthetic oligonucleotide
  Target: ATXN1; (-) strand; PAM type: NRG; PAM sequence: CAG
aacaaagtgatgagggtgga

SEQ ID NO: 72964 - DNA, 20 bp, Artificial Sequence
  Description of Artificial Sequence: Synthetic oligonucleotide
  Target: ATXN1; (-) strand; PAM type: NRG; PAM sequence: TGG
atgcaacaaagtgatgaggg

SEQ ID NO: 72965 - DNA, 20 bp, Artificial Sequence
  Description of Artificial Sequence: Synthetic oligonucleotide
  Target: ATXN1; (-) strand; PAM type: NRG; PAM sequence: GGG
gagatgcaacaaagtgatga

SEQ ID NO: 72966 - DNA, 20 bp, Artificial Sequence
  Description of Artificial Sequence: Synthetic oligonucleotide
  Target: ATXN1; (-) strand; PAM type: NRG; PAM sequence: AGG
agagatgcaacaaagtgatg

SEQ ID NO: 72967 - DNA, 20 bp, Artificial Sequence
  Description of Artificial Sequence: Synthetic oligonucleotide
  Target: ATXN1; (-) strand; PAM type: NRG; PAM sequence: GAG
tagagatgcaacaaagtgat

SEQ ID NO: 72968 - DNA, 20 bp, Artificial Sequence
  Description of Artificial Sequence: Synthetic oligonucleotide
  Target: ATXN1; (-) strand; PAM type: NRG; PAM sequence: AAG
atctttctagagatgcaaca

SEQ ID NO: 72969 - DNA, 20 bp, Artificial Sequence
  Description of Artificial Sequence: Synthetic oligonucleotide
  Target: ATXN1; (-) strand; PAM type: NRG; PAM sequence: GAG
ttaatccctggatctttcta

SEQ ID NO: 72970 - DNA, 20 bp, Artificial Sequence
  Description of Artificial Sequence: Synthetic oligonucleotide
  Target: ATXN1; (-) strand; PAM type: NRG; PAM sequence: TAG
atttaatccctggatctttc

SEQ ID NO: 72971 - DNA, 20 bp, Artificial Sequence
  Description of Artificial Sequence: Synthetic oligonucleotide
  Target: ATXN1; (-) strand; PAM type: NRG; PAM sequence: TGG
gcacataattatttaatccc

SEQ ID NO: 72972 - DNA, 20 bp, Artificial Sequence
  Description of Artificial Sequence: Synthetic oligonucleotide
  Target: ATXN1; (-) strand; PAM type: NRG; PAM sequence: AAG
ttcttaggccaccacacagg

SEQ ID NO: 72973 - DNA, 20 bp, Artificial Sequence
  Description of Artificial Sequence: Synthetic oligonucleotide
  Target: ATXN1; (-) strand; PAM type: NRG; PAM sequence: AGG
taattcttaggccaccacac

SEQ ID NO: 72974 - DNA, 20 bp, Artificial Sequence
  Description of Artificial Sequence: Synthetic oligonucleotide
  Target: ATXN1; (-) strand; PAM type: NRG; PAM sequence: CAG
ttaattcttaggccaccaca

SEQ ID NO: 72975 - DNA, 20 bp, Artificial Sequence
  Description of Artificial Sequence: Synthetic oligonucleotide
  Target: ATXN1; (-) strand; PAM type: NRG; PAM sequence: AGG
ggtcacttctcttaattctt

SEQ ID NO: 72976 - DNA, 20 bp, Artificial Sequence
  Description of Artificial Sequence: Synthetic oligonucleotide
  Target: ATXN1; (-) strand; PAM type: NRG; PAM sequence: TAG
aggtcacttctcttaattct

SEQ ID NO: 72977 - DNA, 20 bp, Artificial Sequence
  Description of Artificial Sequence: Synthetic oligonucleotide
  Target: ATXN1; (-) strand; PAM type: NRG; PAM sequence: AGG
ggtgcacacaggcatcaaac

SEQ ID NO: 72978 - DNA, 20 bp, Artificial Sequence
  Description of Artificial Sequence: Synthetic oligonucleotide
  Target: ATXN1; (-) strand; PAM type: NRG; PAM sequence: CAG
gggtgcacacaggcatcaaa

SEQ ID NO: 72979 - DNA, 20 bp, Artificial Sequence
  Description of Artificial Sequence: Synthetic oligonucleotide
  Target: ATXN1; (-) strand; PAM type: NRG; PAM sequence: AGG
gtcaaagagagggtgcacac

SEQ ID NO: 72980 - DNA, 20 bp, Artificial Sequence
  Description of Artificial Sequence: Synthetic oligonucleotide
  Target: ATXN1; (-) strand; PAM type: NRG; PAM sequence: CAG
tgtcaaagagagggtgcaca

SEQ ID NO: 72981 - DNA, 20 bp, Artificial Sequence
  Description of Artificial Sequence: Synthetic oligonucleotide
  Target: ATXN1; (-) strand; PAM type: NRG; PAM sequence: GGG
gccatgctttgtcaaagaga

SEQ ID NO: 72982 - DNA, 20 bp, Artificial Sequence
  Description of Artificial Sequence: Synthetic oligonucleotide
  Target: ATXN1; (-) strand; PAM type: NRG; PAM sequence: AGG
ggccatgctttgtcaaagag

SEQ ID NO: 72983 - DNA, 20 bp, Artificial Sequence
  Description of Artificial Sequence: Synthetic oligonucleotide
  Target: ATXN1; (-) strand; PAM type: NRG; PAM sequence: GAG
aggccatgctttgtcaaaga

SEQ ID NO: 72984 - DNA, 20 bp, Artificial Sequence
  Description of Artificial Sequence: Synthetic oligonucleotide
  Target: ATXN1; (-) strand; PAM type: NRG; PAM sequence: GAG
tcaggccatgctttgtcaaa

SEQ ID NO: 72985 - DNA, 20 bp, Artificial Sequence
  Description of Artificial Sequence: Synthetic oligonucleotide
  Target: ATXN1; (-) strand; PAM type: NRG; PAM sequence: AAG
aatcaggccatgctttgtca

SEQ ID NO: 72986 - DNA, 20 bp, Artificial Sequence
  Description of Artificial Sequence: Synthetic oligonucleotide
  Target: ATXN1; (-) strand; PAM type: NRG; PAM sequence: AGG
tccataaggattgggaaatc

SEQ ID NO: 72987 - DNA, 20 bp, Artificial Sequence
  Description of Artificial Sequence: Synthetic oligonucleotide
  Target: ATXN1; (-) strand; PAM type: NRG; PAM sequence: CAG
ctccataaggattgggaaat

SEQ ID NO: 72988 - DNA, 20 bp, Artificial Sequence
  Description of Artificial Sequence: Synthetic oligonucleotide
  Target: ATXN1; (-) strand; PAM type: NRG; PAM sequence: GGG
aacagagctccataaggatt

SEQ ID NO: 72989 - DNA, 20 bp, Artificial Sequence
  Description of Artificial Sequence: Synthetic oligonucleotide
  Target: ATXN1; (-) strand; PAM type: NRG; PAM sequence: TGG
caacagagctccataaggat

SEQ ID NO: 72990 - DNA, 20 bp, Artificial Sequence
  Description of Artificial Sequence: Synthetic oligonucleotide
  Target: ATXN1; (-) strand; PAM type: NRG; PAM sequence: AGG
accctcaacagagctccata

SEQ ID NO: 72991 - DNA, 20 bp, Artificial Sequence
  Description of Artificial Sequence: Synthetic oligonucleotide
  Target: ATXN1; (-) strand; PAM type: NRG; PAM sequence: AAG
aaccctcaacagagctccat

SEQ ID NO: 72992 - DNA, 20 bp, Artificial Sequence
  Description of Artificial Sequence: Synthetic oligonucleotide
  Target: ATXN1; (-) strand; PAM type: NRG; PAM sequence: GAG
ttgctgtgtaaccctcaaca

SEQ ID NO: 72993 - DNA, 20 bp, Artificial Sequence
  Description of Artificial Sequence: Synthetic oligonucleotide
  Target: ATXN1; (-) strand; PAM type: NRG; PAM sequence: CAG
ccttgctgtgtaaccctcaa

SEQ ID NO: 72994 - DNA, 20 bp, Artificial Sequence
  Description of Artificial Sequence: Synthetic oligonucleotide
  Target: ATXN1; (-) strand; PAM type: NRG; PAM sequence: CAG
aattgcaaggtaaaggcagg

SEQ ID NO: 72995 - DNA, 20 bp, Artificial Sequence
  Description of Artificial Sequence: Synthetic oligonucleotide
  Target: ATXN1; (-) strand; PAM type: NRG; PAM sequence: AGG
agcaattgcaaggtaaaggc

SEQ ID NO: 72996 - DNA, 20 bp, Artificial Sequence
  Description of Artificial Sequence: Synthetic oligonucleotide
  Target: ATXN1; (-) strand; PAM type: NRG; PAM sequence: CAG
tagcaattgcaaggtaaagg

SEQ ID NO: 72997 - DNA, 20 bp, Artificial Sequence
  Description of Artificial Sequence: Synthetic oligonucleotide
  Target: ATXN1; (-) strand; PAM type: NRG; PAM sequence: AGG
tcatagcaattgcaaggtaa

SEQ ID NO: 72998 - DNA, 20 bp, Artificial Sequence
  Description of Artificial Sequence: Synthetic oligonucleotide
  Target: ATXN1; (-) strand; PAM type: NRG; PAM sequence: AAG
ctcatagcaattgcaaggta

SEQ ID NO: 72999 - DNA, 20 bp, Artificial Sequence
  Description of Artificial Sequence: Synthetic oligonucleotide
  Target: ATXN1; (-) strand; PAM type: NRG; PAM sequence: AGG
ttattctcatagcaattgca

SEQ ID NO: 73000 - DNA, 20 bp, Artificial Sequence
  Description of Artificial Sequence: Synthetic oligonucleotide
  Target: ATXN1; (-) strand; PAM type: NRG; PAM sequence: AAG
tttattctcatagcaattgc

SEQ ID NO: 73001 - DNA, 20 bp, Artificial Sequence
  Description of Artificial Sequence: Synthetic oligonucleotide
  Target: ATXN1; (-) strand; PAM type: NRG; PAM sequence: TAG
ccattttgaatttattctca

SEQ ID NO: 73002 - DNA, 20 bp, Artificial Sequence
  Description of Artificial Sequence: Synthetic oligonucleotide
  Target: ATXN1; (-) strand; PAM type: NRG; PAM sequence: GGG
gggagtcacatgctgaactc

SEQ ID NO: 73003 - DNA, 20 bp, Artificial Sequence
  Description of Artificial Sequence: Synthetic oligonucleotide
  Target: ATXN1; (-) strand; PAM type: NRG; PAM sequence: CGG
tgggagtcacatgctgaact

SEQ ID NO: 73004 - DNA, 20 bp, Artificial Sequence
  Description of Artificial Sequence: Synthetic oligonucleotide
  Target: ATXN1; (-) strand; PAM type: NRG; PAM sequence: GAG
ttttttagcagcagaagtgg

SEQ ID NO: 73005 - DNA, 20 bp, Artificial Sequence
  Description of Artificial Sequence: Synthetic oligonucleotide
  Target: ATXN1; (-) strand; PAM type: NRG; PAM sequence: GGG
gtttttttagcagcagaagt

SEQ ID NO: 73006 - DNA, 20 bp, Artificial Sequence
  Description of Artificial Sequence: Synthetic oligonucleotide
  Target: ATXN1; (-) strand; PAM type: NRG; PAM sequence: TGG
tgtttttttagcagcagaag

SEQ ID NO: 73007 - DNA, 20 bp, Artificial Sequence
  Description of Artificial Sequence: Synthetic oligonucleotide
  Target: ATXN1; (-) strand; PAM type: NRG; PAM sequence: AAG
tcttgtttttttagcagcag

SEQ ID NO: 73008 - DNA, 20 bp, Artificial Sequence
  Description of Artificial Sequence: Synthetic oligonucleotide
  Target: ATXN1; (-) strand; PAM type: NRG; PAM sequence: CAG
ctgtcttgtttttttagcag

SEQ ID NO: 73009 - DNA, 20 bp, Artificial Sequence
  Description of Artificial Sequence: Synthetic oligonucleotide
  Target: ATXN1; (-) strand; PAM type: NRG; PAM sequence: CAG
tagctgtcttgtttttttag

SEQ ID NO: 73010 - DNA, 20 bp, Artificial Sequence
  Description of Artificial Sequence: Synthetic oligonucleotide
  Target: ATXN1; (-) strand; PAM type: NRG; PAM sequence: TAG
caatagctgtcttgtttttt

SEQ ID NO: 73011 - DNA, 20 bp, Artificial Sequence
  Description of Artificial Sequence: Synthetic oligonucleotide
  Target: ATXN1; (-) strand; PAM type: NRG; PAM sequence: TAG
gtagagtgcattcaatacaa

SEQ ID NO: 73012 - DNA, 20 bp, Artificial Sequence
  Description of Artificial Sequence: Synthetic oligonucleotide
  Target: ATXN1; (-) strand; PAM type: NRG; PAM sequence: GAG
ctcagagtgcctgatgagta

SEQ ID NO: 73013 - DNA, 20 bp, Artificial Sequence
  Description of Artificial Sequence: Synthetic oligonucleotide
  Target: ATXN1; (-) strand; PAM type: NRG; PAM sequence: TAG
ttctcagagtgcctgatgag

SEQ ID NO: 73014 - DNA, 20 bp, Artificial Sequence
  Description of Artificial Sequence: Synthetic oligonucleotide
  Target: ATXN1; (-) strand; PAM type: NRG; PAM sequence: GAG
tcattctcagagtgcctgat

SEQ ID NO: 73015 - DNA, 20 bp, Artificial Sequence
  Description of Artificial Sequence: Synthetic oligonucleotide
  Target: ATXN1; (-) strand; PAM type: NRG; PAM sequence: GAG
ccaggtcaccttcattctca

SEQ ID NO: 73016 - DNA, 20 bp, Artificial Sequence
  Description of Artificial Sequence: Synthetic oligonucleotide
  Target: ATXN1; (-) strand; PAM type: NRG; PAM sequence: CAG
agccaggtcaccttcattct

SEQ ID NO: 73017 - DNA, 20 bp, Artificial Sequence
  Description of Artificial Sequence: Synthetic oligonucleotide
  Target: ATXN1; (-) strand; PAM type: NRG; PAM sequence: AGG
cagacccatatataccagcc

SEQ ID NO: 73018 - DNA, 20 bp, Artificial Sequence
  Description of Artificial Sequence: Synthetic oligonucleotide
  Target: ATXN1; (-) strand; PAM type: NRG; PAM sequence: CAG
acagacccatatataccagc

SEQ ID NO: 73019 - DNA, 20 bp, Artificial Sequence
  Description of Artificial Sequence: Synthetic oligonucleotide
  Target: ATXN1; (-) strand; PAM type: NRG; PAM sequence: CAG
ttccacagacccatatatac

SEQ ID NO: 73020 - DNA, 20 bp, Artificial Sequence
  Description of Artificial Sequence: Synthetic oligonucleotide
  Target: ATXN1; (-) strand; PAM type: NRG; PAM sequence: CAG
aaaaatactttgtctttcca

SEQ ID NO: 73021 - DNA, 20 bp, Artificial Sequence
  Description of Artificial Sequence: Synthetic oligonucleotide
  Target: ATXN1; (-) strand; PAM type: NRG; PAM sequence: TGG
aaaattgtaatggtagtcaa

SEQ ID NO: 73022 - DNA, 20 bp, Artificial Sequence
  Description of Artificial Sequence: Synthetic oligonucleotide
  Target: ATXN1; (-) strand; PAM type: NRG; PAM sequence: TAG
atatttcaaaattgtaatgg

SEQ ID NO: 73023 - DNA, 20 bp, Artificial Sequence
  Description of Artificial Sequence: Synthetic oligonucleotide
  Target: ATXN1; (-) strand; PAM type: NRG; PAM sequence: TGG
aacatatttcaaaattgtaa

SEQ ID NO: 73024 - DNA, 20 bp, Artificial Sequence
  Description of Artificial Sequence: Synthetic oligonucleotide
  Target: ATXN1; (-) strand; PAM type: NRG; PAM sequence: GGG
acttcagtattttttttata

SEQ ID NO: 73025 - DNA, 20 bp, Artificial Sequence
  Description of Artificial Sequence: Synthetic oligonucleotide
  Target: ATXN1; (-) strand; PAM type: NRG; PAM sequence: AGG
gacttcagtattttttttat

SEQ ID NO: 73026 - DNA, 20 bp, Artificial Sequence
  Description of Artificial Sequence: Synthetic oligonucleotide
  Target: ATXN1; (-) strand; PAM type: NRG; PAM sequence: TAG
tgacttcagtatttttttta

SEQ ID NO: 73027 - DNA, 20 bp, Artificial Sequence
  Description of Artificial Sequence: Synthetic oligonucleotide
  Target: ATXN1; (-) strand; PAM type: NRG; PAM sequence: CAG
ttaaactaatgtattgactt

SEQ ID NO: 73028 - DNA, 20 bp, Artificial Sequence
  Description of Artificial Sequence: Synthetic oligonucleotide
  Target: ATXN1; (-) strand; PAM type: NRG; PAM sequence: AAG
atgttcacattggcagaata

SEQ ID NO: 73029 - DNA, 20 bp, Artificial Sequence
  Description of Artificial Sequence: Synthetic oligonucleotide
  Target: ATXN1; (-) strand; PAM type: NRG; PAM sequence: CAG
agcacatatgttcacattgg

SEQ ID NO: 73030 - DNA, 20 bp, Artificial Sequence
  Description of Artificial Sequence: Synthetic oligonucleotide
  Target: ATXN1; (-) strand; PAM type: NRG; PAM sequence: TGG
ggaagcacatatgttcacat

SEQ ID NO: 73031 - DNA, 20 bp, Artificial Sequence
  Description of Artificial Sequence: Synthetic oligonucleotide
  Target: ATXN1; (-) strand; PAM type: NRG; PAM sequence: AAG
cctttatgggcttgctgtgg

SEQ ID NO: 73032 - DNA, 20 bp, Artificial Sequence
  Description of Artificial Sequence: Synthetic oligonucleotide
  Target: ATXN1; (-) strand; PAM type: NRG; PAM sequence: TGG
ttccctttatgggcttgctg

SEQ ID NO: 73033 - DNA, 20 bp, Artificial Sequence
  Description of Artificial Sequence: Synthetic oligonucleotide
  Target: ATXN1; (-) strand; PAM type: NRG; PAM sequence: GGG
agcctctagattccctttat

SEQ ID NO: 73034 - DNA, 20 bp, Artificial Sequence
  Description of Artificial Sequence: Synthetic oligonucleotide
  Target: ATXN1; (-) strand; PAM type: NRG; PAM sequence: TGG
tagcctctagattcccttta

SEQ ID NO: 73035 - DNA, 20 bp, Artificial Sequence
  Description of Artificial Sequence: Synthetic oligonucleotide
  Target: ATXN1; (-) strand; PAM type: NRG; PAM sequence: TAG
atactccatgaagtagcctc

SEQ ID NO: 73036 - DNA, 20 bp, Artificial Sequence
  Description of Artificial Sequence: Synthetic oligonucleotide
  Target: ATXN1; (-) strand; PAM type: NRG; PAM sequence: TAG
tggcagaatactccatgaag

SEQ ID NO: 73037 - DNA, 20 bp, Artificial Sequence
  Description of Artificial Sequence: Synthetic oligonucleotide
  Target: ATXN1; (-) strand; PAM type: NRG; PAM sequence: AAG
aaatggcagaatactccatg

SEQ ID NO: 73038 - DNA, 20 bp, Artificial Sequence
  Description of Artificial Sequence: Synthetic oligonucleotide
  Target: ATXN1; (-) strand; PAM type: NRG; PAM sequence: CAG
agagcggacattggaaatgg

SEQ ID NO: 73039 - DNA, 20 bp, Artificial Sequence
  Description of Artificial Sequence: Synthetic oligonucleotide
  Target: ATXN1; (-) strand; PAM type: NRG; PAM sequence: TGG
tgtagagcggacattggaaa

SEQ ID NO: 73040 - DNA, 20 bp, Artificial Sequence
  Description of Artificial Sequence: Synthetic oligonucleotide
  Target: ATXN1; (-) strand; PAM type: NRG; PAM sequence: TGG
atcttttgtagagcggacat

SEQ ID NO: 73041 - DNA, 20 bp, Artificial Sequence
  Description of Artificial Sequence: Synthetic oligonucleotide
  Target: ATXN1; (-) strand; PAM type: NRG; PAM sequence: CGG
gaatgacatcttttgtagag

SEQ ID NO: 73042 - DNA, 20 bp, Artificial Sequence
  Description of Artificial Sequence: Synthetic oligonucleotide
  Target: ATXN1; (-) strand; PAM type: NRG; PAM sequence: GAG
aaagaatgacatcttttgta

SEQ ID NO: 73043 - DNA, 20 bp, Artificial Sequence
  Description of Artificial Sequence: Synthetic oligonucleotide
  Target: ATXN1; (-) strand; PAM type: NRG; PAM sequence: TAG
taaaagaatgacatcttttg

SEQ ID NO: 73044 - DNA, 20 bp, Artificial Sequence
  Description of Artificial Sequence: Synthetic oligonucleotide
  Target: ATXN1; (-) strand; PAM type: NRG; PAM sequence: AAG
taaaagaaaataatgtataa

SEQ ID NO: 73045 - DNA, 20 bp, Artificial Sequence
  Description of Artificial Sequence: Synthetic oligonucleotide
  Target: ATXN1; (-) strand; PAM type: NRG; PAM sequence: AAG
tctctagaaaaataaaataa

SEQ ID NO: 73046 - DNA, 20 bp, Artificial Sequence
  Description of Artificial Sequence: Synthetic oligonucleotide
  Target: ATXN1; (-) strand; PAM type: NRG; PAM sequence: TAG
gcaaagtgagaccctgtctc

SEQ ID NO: 73047 - DNA, 20 bp, Artificial Sequence
  Description of Artificial Sequence: Synthetic oligonucleotide
  Target: ATXN1; (-) strand; PAM type: NRG; PAM sequence: GAG
accagtctgggtggcaaagt

SEQ ID NO: 73048 - DNA, 20 bp, Artificial Sequence
  Description of Artificial Sequence: Synthetic oligonucleotide
  Target: ATXN1; (-) strand; PAM type: NRG; PAM sequence: AAG
gcacaccagtctgggtggca

SEQ ID NO: 73049 - DNA, 20 bp, Artificial Sequence
  Description of Artificial Sequence: Synthetic oligonucleotide
  Target: ATXN1; (-) strand; PAM type: NRG; PAM sequence: TGG
ccactgcacaccagtctggg

SEQ ID NO: 73050 - DNA, 20 bp, Artificial Sequence
  Description of Artificial Sequence: Synthetic oligonucleotide
  Target: ATXN1; (-) strand; PAM type: NRG; PAM sequence: GGG
gcaccactgcacaccagtct

SEQ ID NO: 73051 - DNA, 20 bp, Artificial Sequence
  Description of Artificial Sequence: Synthetic oligonucleotide
  Target: ATXN1; (-) strand; PAM type: NRG; PAM sequence: TGG
tgcaccactgcacaccagtc

SEQ ID NO: 73052 - DNA, 20 bp, Artificial Sequence
  Description of Artificial Sequence: Synthetic oligonucleotide
  Target: ATXN1; (-) strand; PAM type: NRG; PAM sequence: CAG
atgattgcaccactgcacac

SEQ ID NO: 73053 - DNA, 20 bp, Artificial Sequence
  Description of Artificial Sequence: Synthetic oligonucleotide
  Target: ATXN1; (-) strand; PAM type: NRG; PAM sequence: GAG
caggagttcaaggttacagt

SEQ ID NO: 73054 - DNA, 20 bp, Artificial Sequence
  Description of Artificial Sequence: Synthetic oligonucleotide
  Target: ATXN1; (-) strand; PAM type: NRG; PAM sequence: CAG
agcccaggagttcaaggtta

SEQ ID NO: 73055 - DNA, 20 bp, Artificial Sequence
  Description of Artificial Sequence: Synthetic oligonucleotide
  Target: ATXN1; (-) strand; PAM type: NRG; PAM sequence: AGG
tgcttgagcccaggagttca

SEQ ID NO: 73056 - DNA, 20 bp, Artificial Sequence
  Description of Artificial Sequence: Synthetic oligonucleotide
  Target: ATXN1; (-) strand; PAM type: NRG; PAM sequence: AAG
ttgcttgagcccaggagttc

SEQ ID NO: 73057 - DNA, 20 bp, Artificial Sequence
  Description of Artificial Sequence: Synthetic oligonucleotide
  Target: ATXN1; (-) strand; PAM type: NRG; PAM sequence: GAG
ggaggattgcttgagcccag

SEQ ID NO: 73058 - DNA, 20 bp, Artificial Sequence
  Description of Artificial Sequence: Synthetic oligonucleotide
  Target: ATXN1; (-) strand; PAM type: NRG; PAM sequence: AGG
tgggaggattgcttgagccc

SEQ ID NO: 73059 - DNA, 20 bp, Artificial Sequence
  Description of Artificial Sequence: Synthetic oligonucleotide
  Target: ATXN1; (-) strand; PAM type: NRG; PAM sequence: CAG
gtgggaggattgcttgagcc

SEQ ID NO: 73060 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggaggattgctt

SEQ ID NO: 73061 - DNA, 20 bp, Artificial Sequence
  Description of Artificial Sequence: Synthetic oligonucleotide
  Target: ATXN1; (-) strand; PAM type: NRG; PAM sequence: AGG
gctcaggaggctgaggtggg

SEQ ID NO: 73062 - DNA, 20 bp, Artificial Sequence
  Description of Artificial Sequence: Synthetic oligonucleotide
  Target: ATXN1; (-) strand; PAM type: NRG; PAM sequence: GAG
tgctcaggaggctgaggtgg

SEQ ID NO: 73063 - DNA, 20 bp, Artificial Sequence
  Description of Artificial Sequence: Synthetic oligonucleotide
  Target: ATXN1; (-) strand; PAM type: NRG; PAM sequence: GGG
gctgctcaggaggctgaggt

SEQ ID NO: 73064 - DNA, 20 bp, Artificial Sequence
  Description of Artificial Sequence: Synthetic oligonucleotide
  Target: ATXN1; (-) strand; PAM type: NRG; PAM sequence: TGG
agctgctcaggaggctgagg

SEQ ID NO: 73065 - DNA, 20 bp, Artificial Sequence
  Description of Artificial Sequence: Synthetic oligonucleotide
  Target: ATXN1; (-) strand; PAM type: NRG; PAM sequence: AGG
cctagctgctcaggaggctg

SEQ ID NO: 73066 - DNA, 20 bp, Artificial Sequence
  Description of Artificial Sequence: Synthetic oligonucleotide
  Target: ATXN1; (-) strand; PAM type: NRG; PAM sequence: GAG
tcctagctgctcaggaggct

SEQ ID NO: 73067 - DNA, 20 bp, Artificial Sequence
  Description of Artificial Sequence: Synthetic oligonucleotide
  Target: ATXN1; (-) strand; PAM type: NRG; PAM sequence: AGG
tgtagtcctagctgctcagg

SEQ ID NO: 73068 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcctagctgctcag

SEQ ID NO: 73069 - DNA, 20 bp, Artificial Sequence
  Description of Artificial Sequence: Synthetic oligonucleotide
  Target: ATXN1; (-) strand; PAM type: NRG; PAM sequence: AGG
gtctgtagtcctagctgctc

SEQ ID NO: 73070 - DNA, 20 bp, Artificial Sequence
  Description of Artificial Sequence: Synthetic oligonucleotide
  Target: ATXN1; (-) strand; PAM type: NRG; PAM sequence: CAG
agtctgtagtcctagctgct

SEQ ID NO: 73071 - DNA, 20 bp, Artificial Sequence
  Description of Artificial Sequence: Synthetic oligonucleotide
  Target: ATXN1; (-) strand; PAM type: NRG; PAM sequence: TAG
atgttgtgagtctgtagtcc

SEQ ID NO: 73072 - DNA, 20 bp, Artificial Sequence
  Description of Artificial Sequence: Synthetic oligonucleotide
  Target: ATXN1; (-) strand; PAM type: NRG; PAM sequence: TAG
agtgtaatgttgtgagtctg

SEQ ID NO: 73073 - DNA, 20 bp, Artificial Sequence
  Description of Artificial Sequence: Synthetic oligonucleotide
  Target: ATXN1; (-) strand; PAM type: NRG; PAM sequence: GAG
ttagctgagtgtaatgttgt

SEQ ID NO: 73074 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttaattagct

SEQ ID NO: 73075 - DNA, 20 bp, Artificial Sequence
  Description of Artificial Sequence: Synthetic oligonucleotide
  Target: ATXN1; (-) strand; PAM type: NRG; PAM sequence: TAG
ttaagttttttttttttaat

SEQ ID NO: 73076 - DNA, 20 bp, Artificial Sequence
  Description of Artificial Sequence: Synthetic oligonucleotide
  Target: ATXN1; (-) strand; PAM type: NRG; PAM sequence: AAG
gaacaagtctttgtctcttt

SEQ ID NO: 73077 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggtgacagaac

SEQ ID NO: 73078 - DNA, 20 bp, Artificial Sequence
  Description of Artificial Sequence: Synthetic oligonucleotide
  Target: ATXN1; (-) strand; PAM type: NRG; PAM sequence: CAG
ctacactccagcctgggtga

SEQ ID NO: 73079 - DNA, 20 bp, Artificial Sequence
  Description of Artificial Sequence: Synthetic oligonucleotide
  Target: ATXN1; (-) strand; PAM type: NRG; PAM sequence: GGG
gcaccactacactccagcct

SEQ ID NO: 73080 - DNA, 20 bp, Artificial Sequence
  Description of Artificial Sequence: Synthetic oligonucleotide
  Target: ATXN1; (-) strand; PAM type: NRG; PAM sequence: TGG
cgcaccactacactccagcc

SEQ ID NO: 73081 - DNA, 20 bp, Artificial Sequence
  Description of Artificial Sequence: Synthetic oligonucleotide
  Target: ATXN1; (-) strand; PAM type: NRG; PAM sequence: CAG
gtgatcgcaccactacactc

SEQ ID NO: 73082 - DNA, 20 bp, Artificial Sequence
  Description of Artificial Sequence: Synthetic oligonucleotide
  Target: ATXN1; (-) strand; PAM type: NRG; PAM sequence: GAG
taggagtttgaggctgcagt

SEQ ID NO: 73083 - DNA, 20 bp, Artificial Sequence
  Description of Artificial Sequence: Synthetic oligonucleotide
  Target: ATXN1; (-) strand; PAM type: NRG; PAM sequence: CAG
agtctaggagtttgaggctg

SEQ ID NO: 73084 - DNA, 20 bp, Artificial Sequence
  Description of Artificial Sequence: Synthetic oligonucleotide
  Target: ATXN1; (-) strand; PAM type: NRG; PAM sequence: AGG
cacttgagtctaggagtttg

SEQ ID NO: 73085 - DNA, 20 bp, Artificial Sequence
  Description of Artificial Sequence: Synthetic oligonucleotide
  Target: ATXN1; (-) strand; PAM type: NRG; PAM sequence: GAG
tcacttgagtctaggagttt

SEQ ID NO: 73086 - DNA, 20 bp, Artificial Sequence
  Description of Artificial Sequence: Synthetic oligonucleotide
  Target: ATXN1; (-) strand; PAM type: NRG; PAM sequence: GAG
ggaggatcacttgagtctag

SEQ ID NO: 73087 - DNA, 20 bp, Artificial Sequence
  Description of Artificial Sequence: Synthetic oligonucleotide
  Target: ATXN1; (-) strand; PAM type: NRG; PAM sequence: AGG
taggaggatcacttgagtct

SEQ ID NO: 73088 - DNA, 20 bp, Artificial Sequence
  Description of Artificial Sequence: Synthetic oligonucleotide
  Target: ATXN1; (-) strand; PAM type: NRG; PAM sequence: TAG
gtaggaggatcacttgagtc

SEQ ID NO: 73089 - DNA, 20 bp, Artificial Sequence
  Description of Artificial Sequence: Synthetic oligonucleotide
  Target: ATXN1; (-) strand; PAM type: NRG; PAM sequence: GAG
cttatgtaggaggatcactt

SEQ ID NO: 73090 - DNA, 20 bp, Artificial Sequence
  Description of Artificial Sequence: Synthetic oligonucleotide
  Target: ATXN1; (-) strand; PAM type: NRG; PAM sequence: AGG
acttgggaggcttatgtagg

SEQ ID NO: 73091 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggcttatgtag

SEQ ID NO: 73092 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggcttatgt

SEQ ID NO: 73093 - DNA, 20 bp, Artificial Sequence
  Description of Artificial Sequence: Synthetic oligonucleotide
  Target: ATXN1; (-) strand; PAM type: NRG; PAM sequence: TAG
agctacttgggaggcttatg

SEQ ID NO: 73094 - DNA, 20 bp, Artificial Sequence
  Description of Artificial Sequence: Synthetic oligonucleotide
  Target: ATXN1; (-) strand; PAM type: NRG; PAM sequence: AGG
tgtagtcctagctacttggg

SEQ ID NO: 73095 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcctagctacttgg

SEQ ID NO: 73096 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcctagctactt

SEQ ID NO: 73097 - DNA, 20 bp, Artificial Sequence
  Description of Artificial Sequence: Synthetic oligonucleotide
  Target: ATXN1; (-) strand; PAM type: NRG; PAM sequence: TGG
agcctgtagtcctagctact

SEQ ID NO: 73098 - DNA, 20 bp, Artificial Sequence
  Description of Artificial Sequence: Synthetic oligonucleotide
  Target: ATXN1; (-) strand; PAM type: NRG; PAM sequence: TAG
gtggcatgagcctgtagtcc

SEQ ID NO: 73099 - DNA, 20 bp, Artificial Sequence
  Description of Artificial Sequence: Synthetic oligonucleotide
  Target: ATXN1; (-) strand; PAM type: NRG; PAM sequence: TAG
agcatggtggcatgagcctg

SEQ ID NO: 73100 - DNA, 20 bp, Artificial Sequence
  Description of Artificial Sequence: Synthetic oligonucleotide
  Target: ATXN1; (-) strand; PAM type: NRG; PAM sequence: GAG
ttagctgagcatggtggcat

SEQ ID NO: 73101 - DNA, 20 bp, Artificial Sequence
  Description of Artificial Sequence: Synthetic oligonucleotide
  Target: ATXN1; (-) strand; PAM type: NRG; PAM sequence: TGG
taaaacttagctgagcatgg

SEQ ID NO: 73102 - DNA, 20 bp, Artificial Sequence
  Description of Artificial Sequence: Synthetic oligonucleotide
  Target: ATXN1; (-) strand; PAM type: NRG; PAM sequence: TGG
atttaaaacttagctgagca

SEQ ID NO: 73103 - DNA, 20 bp, Artificial Sequence
  Description of Artificial Sequence: Synthetic oligonucleotide
  Target: ATXN1; (-) strand; PAM type: NRG; PAM sequence: GAG
aaaaaatttaaaacttagct

SEQ ID NO: 73104 - DNA, 20 bp, Artificial Sequence
  Description of Artificial Sequence: Synthetic oligonucleotide
  Target: ATXN1; (-) strand; PAM type: NRG; PAM sequence: TAG
tacaaaaaaaatttaaaact

SEQ ID NO: 73105 - DNA, 20 bp, Artificial Sequence
  Description of Artificial Sequence: Synthetic oligonucleotide
  Target: ATXN1; (-) strand; PAM type: NRG; PAM sequence: GAG
accagcctggacagcgtagt

SEQ ID NO: 73106 - DNA, 20 bp, Artificial Sequence
  Description of Artificial Sequence: Synthetic oligonucleotide
  Target: ATXN1; (-) strand; PAM type: NRG; PAM sequence: TAG
tgagaccagcctggacagcg

SEQ ID NO: 73107 - DNA, 20 bp, Artificial Sequence
  Description of Artificial Sequence: Synthetic oligonucleotide
  Target: ATXN1; (-) strand; PAM type: NRG; PAM sequence: CAG
gagtttgagaccagcctgga

SEQ ID NO: 73108 - DNA, 20 bp, Artificial Sequence
  Description of Artificial Sequence: Synthetic oligonucleotide
  Target: ATXN1; (-) strand; PAM type: NRG; PAM sequence: TGG
ccacgagtttgagaccagcc

SEQ ID NO: 73109 - DNA, 20 bp, Artificial Sequence
  Description of Artificial Sequence: Synthetic oligonucleotide
  Target: ATXN1; (-) strand; PAM type: NRG; PAM sequence: CAG
tgaagccacgagtttgagac

SEQ ID NO: 73110 - DNA, 20 bp, Artificial Sequence
  Description of Artificial Sequence: Synthetic oligonucleotide
  Target: ATXN1; (-) strand; PAM type: NRG; PAM sequence: GAG
tcacttgaagccacgagttt

SEQ ID NO: 73111 - DNA, 20 bp, Artificial Sequence
  Description of Artificial Sequence: Synthetic oligonucleotide
  Target: ATXN1; (-) strand; PAM type: NRG; PAM sequence: GAG
gaaggatcacttgaagccac

SEQ ID NO: 73112 - DNA, 20 bp, Artificial Sequence
  Description of Artificial Sequence: Synthetic oligonucleotide
  Target: ATXN1; (-) strand; PAM type: NRG; PAM sequence: AAG
tgaggtggaaggatcacttg

SEQ ID NO: 73113 - DNA, 20 bp, Artificial Sequence
  Description of Artificial Sequence: Synthetic oligonucleotide
  Target: ATXN1; (-) strand; PAM type: NRG; PAM sequence: AGG
ctttggggggctgaggtgga

SEQ ID NO: 73114 - DNA, 20 bp, Artificial Sequence
  Description of Artificial Sequence: Synthetic oligonucleotide
  Target: ATXN1; (-) strand; PAM type: NRG; PAM sequence: AAG
actttggggggctgaggtgg

SEQ ID NO: 73115 - DNA, 20 bp, Artificial Sequence
  Description of Artificial Sequence: Synthetic oligonucleotide
  Target: ATXN1; (-) strand; PAM type: NRG; PAM sequence: TGG
agcactttggggggctgagg

SEQ ID NO: 73116 - DNA, 20 bp, Artificial Sequence
  Description of Artificial Sequence: Synthetic oligonucleotide
  Target: ATXN1; (-) strand; PAM type: NRG; PAM sequence: AGG
cccagcactttggggggctg

SEQ ID NO: 73117 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttggggggct

SEQ ID NO: 73118 - DNA, 20 bp, Artificial Sequence
  Description of Artificial Sequence: Synthetic oligonucleotide
  Target: ATXN1; (-) strand; PAM type: NRG; PAM sequence: GGG
tgcaatcccagcactttggg

SEQ ID NO: 73119 - DNA, 20 bp, Artificial Sequence
  Description of Artificial Sequence: Synthetic oligonucleotide
  Target: ATXN1; (-) strand; PAM type: NRG; PAM sequence: GGG
ctgcaatcccagcactttgg

SEQ ID NO: 73120 - DNA, 20 bp, Artificial Sequence
  Description of Artificial Sequence: Synthetic oligonucleotide
  Target: ATXN1; (-) strand; PAM type: NRG; PAM sequence: GGG
cctgcaatcccagcactttg

SEQ ID NO: 73121 - DNA, 20 bp, Artificial Sequence
  Description of Artificial Sequence: Synthetic oligonucleotide
  Target: ATXN1; (-) strand; PAM type: NRG; PAM sequence: GGG
ccctgcaatcccagcacttt

SEQ ID NO: 73122 - DNA, 20 bp, Artificial Sequence
  Description of Artificial Sequence: Synthetic oligonucleotide
  Target: ATXN1; (-) strand; PAM type: NRG; PAM sequence: TGG
cccctgcaatcccagcactt

SEQ ID NO: 73123 - DNA, 20 bp, Artificial Sequence
  Description of Artificial Sequence: Synthetic oligonucleotide
  Target: ATXN1; (-) strand; PAM type: NRG; PAM sequence: CAG
atggctcacccctgcaatcc

SEQ ID NO: 73124 - DNA, 20 bp, Artificial Sequence
  Description of Artificial Sequence: Synthetic oligonucleotide
  Target: ATXN1; (-) strand; PAM type: NRG; PAM sequence: TGG
tagaaagaggctgaacgtga

SEQ ID NO: 73125 - DNA, 20 bp, Artificial Sequence
  Description of Artificial Sequence: Synthetic oligonucleotide
  Target: ATXN1; (-) strand; PAM type: NRG; PAM sequence: AGG
tttttgtagaatttagaaag

SEQ ID NO: 73126 - DNA, 20 bp, Artificial Sequence
  Description of Artificial Sequence: Synthetic oligonucleotide
  Target: ATXN1; (-) strand; PAM type: NRG; PAM sequence: GAG
ttttttgtagaatttagaaa

SEQ ID NO: 73127 - DNA, 20 bp, Artificial Sequence
  Description of Artificial Sequence: Synthetic oligonucleotide
  Target: ATXN1; (-) strand; PAM type: NRG; PAM sequence: AAG
gtttttttgtagaatttaga

SEQ ID NO: 73128 - DNA, 20 bp, Artificial Sequence
  Description of Artificial Sequence: Synthetic oligonucleotide
  Target: ATXN1; (-) strand; PAM type: NRG; PAM sequence: TAG
gcatgtttttttgtagaatt

SEQ ID NO: 73129 - DNA, 20 bp, Artificial Sequence
  Description of Artificial Sequence: Synthetic oligonucleotide
  Target: ATXN1; (-) strand; PAM type: NRG; PAM sequence: TAG
tatgaatgcatgtttttttg

SEQ ID NO: 73130 - DNA, 20 bp, Artificial Sequence
  Description of Artificial Sequence: Synthetic oligonucleotide
  Target: ATXN1; (-) strand; PAM type: NRG; PAM sequence: TAG
tatctaaaacatgacttaca

SEQ ID NO: 73131 - DNA, 20 bp, Artificial Sequence
  Description of Artificial Sequence: Synthetic oligonucleotide
  Target: ATXN1; (-) strand; PAM type: NRG; PAM sequence: TGG
catggaataggaaccggcca

SEQ ID NO: 73132 - DNA, 20 bp, Artificial Sequence
  Description of Artificial Sequence: Synthetic oligonucleotide
  Target: ATXN1; (-) strand; PAM type: NRG; PAM sequence: CGG
actccccatggaataggaac

SEQ ID NO: 73133 - DNA, 20 bp, Artificial Sequence
  Description of Artificial Sequence: Synthetic oligonucleotide
  Target: ATXN1; (-) strand; PAM type: NRG; PAM sequence: AGG
ctgagaactccccatggaat

SEQ ID NO: 73134 - DNA, 20 bp, Artificial Sequence
  Description of Artificial Sequence: Synthetic oligonucleotide
  Target: ATXN1; (-) strand; PAM type: NRG; PAM sequence: TAG
gctgagaactccccatggaa

SEQ ID NO: 73135 - DNA, 20 bp, Artificial Sequence
  Description of Artificial Sequence: Synthetic oligonucleotide
  Target: ATXN1; (-) strand; PAM type: NRG; PAM sequence: TGG
atgatgctgagaactcccca

SEQ ID NO: 73136 - DNA, 20 bp, Artificial Sequence
  Description of Artificial Sequence: Synthetic oligonucleotide
  Target: ATXN1; (-) strand; PAM type: NRG; PAM sequence: GAG
tcaaatacctttatgatgct

SEQ ID NO: 73137 - DNA, 20 bp, Artificial Sequence
  Description of Artificial Sequence: Synthetic oligonucleotide
  Target: ATXN1; (-) strand; PAM type: NRG; PAM sequence: TAG
agcatcacctttacaacatg

SEQ ID NO: 73138 - DNA, 20 bp, Artificial Sequence
  Description of Artificial Sequence: Synthetic oligonucleotide
  Target: ATXN1; (-) strand; PAM type: NRG; PAM sequence: GAG
tagtctgagaattgagcatt

SEQ ID NO: 73139 - DNA, 20 bp, Artificial Sequence
  Description of Artificial Sequence: Synthetic oligonucleotide
  Target: ATXN1; (-) strand; PAM type: NRG; PAM sequence: GAG
ctggttctagtctgagaatt

SEQ ID NO: 73140 - DNA, 20 bp, Artificial Sequence
  Description of Artificial Sequence: Synthetic oligonucleotide
  Target: ATXN1; (-) strand; PAM type: NRG; PAM sequence: GAG
ggaagttctggttctagtct

SEQ ID NO: 73141 - DNA, 20 bp, Artificial Sequence
  Description of Artificial Sequence: Synthetic oligonucleotide
  Target: ATXN1; (-) strand; PAM type: NRG; PAM sequence: TAG
aattgtggaagttctggttc

SEQ ID NO: 73142 - DNA, 20 bp, Artificial Sequence
  Description of Artificial Sequence: Synthetic oligonucleotide
  Target: ATXN1; (-) strand; PAM type: NRG; PAM sequence: TGG
atatgaaattgtggaagttc

SEQ ID NO: 73143 - DNA, 20 bp, Artificial Sequence
  Description of Artificial Sequence: Synthetic oligonucleotide
  Target: ATXN1; (-) strand; PAM type: NRG; PAM sequence: AAG
ttaaaaatatgaaattgtgg

SEQ ID NO: 73144 - DNA, 20 bp, Artificial Sequence
  Description of Artificial Sequence: Synthetic oligonucleotide
  Target: ATXN1; (-) strand; PAM type: NRG; PAM sequence: TGG
ttcttaaaaatatgaaattg

SEQ ID NO: 73145 - DNA, 20 bp, Artificial Sequence
  Description of Artificial Sequence: Synthetic oligonucleotide
  Target: ATXN1; (-) strand; PAM type: NRG; PAM sequence: AAG
ttatagttaattgtaagtgg

SEQ ID NO: 73146 - DNA, 20 bp, Artificial Sequence
  Description of Artificial Sequence: Synthetic oligonucleotide
  Target: ATXN1; (-) strand; PAM type: NRG; PAM sequence: TGG
tttttatagttaattgtaag

SEQ ID NO: 73147 - DNA, 20 bp, Artificial Sequence
  Description of Artificial Sequence: Synthetic oligonucleotide
  Target: ATXN1; (-) strand; PAM type: NRG; PAM sequence: AAG
ccctttttatagttaattgt

SEQ ID NO: 73148 - DNA, 20 bp, Artificial Sequence
  Description of Artificial Sequence: Synthetic oligonucleotide
  Target: ATXN1; (-) strand; PAM type: NRG; PAM sequence: TAG
gagaaaattaacccttttta

SEQ ID NO: 73149 - DNA, 20 bp, Artificial Sequence
  Description of Artificial Sequence: Synthetic oligonucleotide
  Target: ATXN1; (-) strand; PAM type: NRG; PAM sequence: GAG
attgacaataggcaactgag

SEQ ID NO: 73150 - DNA, 20 bp, Artificial Sequence
  Description of Artificial Sequence: Synthetic oligonucleotide
  Target: ATXN1; (-) strand; PAM type: NRG; PAM sequence: AGG
ttattgacaataggcaactg

SEQ ID NO: 73151 - DNA, 20 bp, Artificial Sequence
  Description of Artificial Sequence: Synthetic oligonucleotide
  Target: ATXN1; (-) strand; PAM type: NRG; PAM sequence: GAG
tttattgacaataggcaact

SEQ ID NO: 73152 - DNA, 20 bp, Artificial Sequence
  Description of Artificial Sequence: Synthetic oligonucleotide
  Target: ATXN1; (-) strand; PAM type: NRG; PAM sequence: AGG
gtaaacattttattgacaat

SEQ ID NO: 73153 - DNA, 20 bp, Artificial Sequence
  Description of Artificial Sequence: Synthetic oligonucleotide
  Target: ATXN1; (-) strand; PAM type: NRG; PAM sequence: TAG
agtaaacattttattgacaa

SEQ ID NO: 73154 - DNA, 20 bp, Artificial Sequence
  Description of Artificial Sequence: Synthetic oligonucleotide
  Target: ATXN1; (-) strand; PAM type: NRG; PAM sequence: AAG
tatcagtcggtcattaggcc

SEQ ID NO: 73155 - DNA, 20 bp, Artificial Sequence
  Description of Artificial Sequence: Synthetic oligonucleotide
  Target: ATXN1; (-) strand; PAM type: NRG; PAM sequence: AGG
tttggtatcagtcggtcatt

SEQ ID NO: 73156 - DNA, 20 bp, Artificial Sequence
  Description of Artificial Sequence: Synthetic oligonucleotide
  Target: ATXN1; (-) strand; PAM type: NRG; PAM sequence: TAG
ttttggtatcagtcggtcat

SEQ ID NO: 73157 - DNA, 20 bp, Artificial Sequence
  Description of Artificial Sequence: Synthetic oligonucleotide
  Target: ATXN1; (-) strand; PAM type: NRG; PAM sequence: CGG
ataccttttttggtatcagt

SEQ ID NO: 73158 - DNA, 20 bp, Artificial Sequence
  Description of Artificial Sequence: Synthetic oligonucleotide
  Target: ATXN1; (-) strand; PAM type: NRG; PAM sequence: CAG
ccttataccttttttggtat

SEQ ID NO: 73159 - DNA, 20 bp, Artificial Sequence
  Description of Artificial Sequence: Synthetic oligonucleotide
  Target: ATXN1; (-) strand; PAM type: NRG; PAM sequence: TGG
ttgagtccttataccttttt

SEQ ID NO: 73160 - DNA, 20 bp, Artificial Sequence
  Description of Artificial Sequence: Synthetic oligonucleotide
  Target: ATXN1; (-) strand; PAM type: NRG; PAM sequence: GAG
atcattgtttcttaacagtt

SEQ ID NO: 73161 - DNA, 20 bp, Artificial Sequence
  Description of Artificial Sequence: Synthetic oligonucleotide
  Target: ATXN1; (-) strand; PAM type: NRG; PAM sequence: CAG
tatacatcattgtttcttaa

SEQ ID NO: 73162 - DNA, 20 bp, Artificial Sequence
  Description of Artificial Sequence: Synthetic oligonucleotide
  Target: ATXN1; (-) strand; PAM type: NRG; PAM sequence: CAG
gaagatctccgtccctttct

SEQ ID NO: 73163 - DNA, 20 bp, Artificial Sequence
  Description of Artificial Sequence: Synthetic oligonucleotide
  Target: ATXN1; (-) strand; PAM type: NRG; PAM sequence: AAG
ttatgttttgaaggtcttcg

SEQ ID NO: 73164 - DNA, 20 bp, Artificial Sequence
  Description of Artificial Sequence: Synthetic oligonucleotide
  Target: ATXN1; (-) strand; PAM type: NRG; PAM sequence: AGG
taatcagatttatgttttga

SEQ ID NO: 73165 - DNA, 20 bp, Artificial Sequence
  Description of Artificial Sequence: Synthetic oligonucleotide
  Target: ATXN1; (-) strand; PAM type: NRG; PAM sequence: AAG
gtaatcagatttatgttttg

SEQ ID NO: 73166 - DNA, 20 bp, Artificial Sequence
  Description of Artificial Sequence: Synthetic oligonucleotide
  Target: ATXN1; (-) strand; PAM type: NRG; PAM sequence: CAG
tgattatgggtggcagtaat

SEQ ID NO: 73167 - DNA, 20 bp, Artificial Sequence
  Description of Artificial Sequence: Synthetic oligonucleotide
  Target: ATXN1; (-) strand; PAM type: NRG; PAM sequence: CAG
acacatttgattatgggtgg

SEQ ID NO: 73168 - DNA, 20 bp, Artificial Sequence
  Description of Artificial Sequence: Synthetic oligonucleotide
  Target: ATXN1; (-) strand; PAM type: NRG; PAM sequence: TGG
catacacatttgattatggg

SEQ ID NO: 73169 - DNA, 20 bp, Artificial Sequence
  Description of Artificial Sequence: Synthetic oligonucleotide
  Target: ATXN1; (-) strand; PAM type: NRG; PAM sequence: GGG
agacatacacatttgattat

SEQ ID NO: 73170 - DNA, 20 bp, Artificial Sequence
  Description of Artificial Sequence: Synthetic oligonucleotide
  Target: ATXN1; (-) strand; PAM type: NRG; PAM sequence: TGG
tagacatacacatttgatta

SEQ ID NO: 73171 - DNA, 20 bp, Artificial Sequence
  Description of Artificial Sequence: Synthetic oligonucleotide
  Target: ATXN1; (-) strand; PAM type: NRG; PAM sequence: TAG
gtattcacctgtggaagact

SEQ ID NO: 73172 - DNA, 20 bp, Artificial Sequence
  Description of Artificial Sequence: Synthetic oligonucleotide
  Target: ATXN1; (-) strand; PAM type: NRG; PAM sequence: AAG
gtaggtgtattcacctgtgg

SEQ ID NO: 73173 - DNA, 20 bp, Artificial Sequence
  Description of Artificial Sequence: Synthetic oligonucleotide
  Target: ATXN1; (-) strand; PAM type: NRG; PAM sequence: TGG
accgtaggtgtattcacctg

SEQ ID NO: 73174 - DNA, 20 bp, Artificial Sequence
  Description of Artificial Sequence: Synthetic oligonucleotide
  Target: ATXN1; (-) strand; PAM type: NRG; PAM sequence: AGG
cggttcaggggcagaaccgt

SEQ ID NO: 73175 - DNA, 20 bp, Artificial Sequence
  Description of Artificial Sequence: Synthetic oligonucleotide
  Target: ATXN1; (-) strand; PAM type: NRG; PAM sequence: TAG
gcggttcaggggcagaaccg

SEQ ID NO: 73176 - DNA, 20 bp, Artificial Sequence
  Description of Artificial Sequence: Synthetic oligonucleotide
  Target: ATXN1; (-) strand; PAM type: NRG; PAM sequence: CAG
atggccttgcggttcagggg

SEQ ID NO: 73177 - DNA, 20 bp, Artificial Sequence
  Description of Artificial Sequence: Synthetic oligonucleotide
  Target: ATXN1; (-) strand; PAM type: NRG; PAM sequence: GGG
ggtatggccttgcggttcag

SEQ ID NO: 73178 - DNA, 20 bp, Artificial Sequence
  Description of Artificial Sequence: Synthetic oligonucleotide
  Target: ATXN1; (-) strand; PAM type: NRG; PAM sequence: GGG
aggtatggccttgcggttca

SEQ ID NO: 73179 - DNA, 20 bp, Artificial Sequence
  Description of Artificial Sequence: Synthetic oligonucleotide
  Target: ATXN1; (-) strand; PAM type: NRG; PAM sequence: AGG
gaggtatggccttgcggttc

SEQ ID NO: 73180 - DNA, 20 bp, Artificial Sequence
  Description of Artificial Sequence: Synthetic oligonucleotide
  Target: ATXN1; (-) strand; PAM type: NRG; PAM sequence: CAG
ggaggtatggccttgcggtt

SEQ ID NO: 73181 - DNA, 20 bp, Artificial Sequence
  Description of Artificial Sequence: Synthetic oligonucleotide
  Target: ATXN1; (-) strand; PAM type: NRG; PAM sequence: CGG
cttggggaggtatggccttg

SEQ ID NO: 73182 - DNA, 20 bp, Artificial Sequence
  Description of Artificial Sequence: Synthetic oligonucleotide
  Target: ATXN1; (-) strand; PAM type: NRG; PAM sequence: TGG
gagtcagtcttggggaggta

SEQ ID NO: 73183 - DNA, 20 bp, Artificial Sequence
  Description of Artificial Sequence: Synthetic oligonucleotide
  Target: ATXN1; (-) strand; PAM type: NRG; PAM sequence: AGG
tcacagagtcagtcttgggg

SEQ ID NO: 73184 - DNA, 20 bp, Artificial Sequence
  Description of Artificial Sequence: Synthetic oligonucleotide
  Target: ATXN1; (-) strand; PAM type: NRG; PAM sequence: GAG
ctcacagagtcagtcttggg

SEQ ID NO: 73185 - DNA, 20 bp, Artificial Sequence
  Description of Artificial Sequence: Synthetic oligonucleotide
  Target: ATXN1; (-) strand; PAM type: NRG; PAM sequence: GGG
ccctcacagagtcagtcttg

SEQ ID NO: 73186 - DNA, 20 bp, Artificial Sequence
  Description of Artificial Sequence: Synthetic oligonucleotide
  Target: ATXN1; (-) strand; PAM type: NRG; PAM sequence: GGG
gccctcacagagtcagtctt

SEQ ID NO: 73187 - DNA, 20 bp, Artificial Sequence
  Description of Artificial Sequence: Synthetic oligonucleotide
  Target: ATXN1; (-) strand; PAM type: NRG; PAM sequence: TGG
agccctcacagagtcagtct

SEQ ID NO: 73188 - DNA, 20 bp, Artificial Sequence
  Description of Artificial Sequence: Synthetic oligonucleotide
  Target: ATXN1; (-) strand; PAM type: NRG; PAM sequence: CAG
cctgttagccctcacagagt

SEQ ID NO: 73189 - DNA, 20 bp, Artificial Sequence
  Description of Artificial Sequence: Synthetic oligonucleotide
  Target: ATXN1; (-) strand; PAM type: NRG; PAM sequence: GAG
atagcctgttagccctcaca

SEQ ID NO: 73190 - DNA, 20 bp, Artificial Sequence
  Description of Artificial Sequence: Synthetic oligonucleotide
  Target: ATXN1; (-) strand; PAM type: NRG; PAM sequence: CAG
ttatagcctgttagccctca

SEQ ID NO: 73191 - DNA, 20 bp, Artificial Sequence
  Description of Artificial Sequence: Synthetic oligonucleotide
  Target: ATXN1; (-) strand; PAM type: NRG; PAM sequence: TAG
tgtcagcaattatagcctgt

SEQ ID NO: 73192 - DNA, 20 bp, Artificial Sequence
  Description of Artificial Sequence: Synthetic oligonucleotide
  Target: ATXN1; (-) strand; PAM type: NRG; PAM sequence: TAG
aacctccctgtcagcaatta

SEQ ID NO: 73193 - DNA, 20 bp, Artificial Sequence
  Description of Artificial Sequence: Synthetic oligonucleotide
  Target: ATXN1; (-) strand; PAM type: NRG; PAM sequence: CAG
caagctgaaaacctccctgt

SEQ ID NO: 73194 - DNA, 20 bp, Artificial Sequence
  Description of Artificial Sequence: Synthetic oligonucleotide
  Target: ATXN1; (-) strand; PAM type: NRG; PAM sequence: AAG
tatttttttatctctatgac

SEQ ID NO: 73195 - DNA, 20 bp, Artificial Sequence
  Description of Artificial Sequence: Synthetic oligonucleotide
  Target: ATXN1; (-) strand; PAM type: NRG; PAM sequence: AAG
cgaatttccacttattactc

SEQ ID NO: 73196 - DNA, 20 bp, Artificial Sequence
  Description of Artificial Sequence: Synthetic oligonucleotide
  Target: ATXN1; (-) strand; PAM type: NRG; PAM sequence: TAG
tgggtaggaaagggtttctg

SEQ ID NO: 73197 - DNA, 20 bp, Artificial Sequence
  Description of Artificial Sequence: Synthetic oligonucleotide
  Target: ATXN1; (-) strand; PAM type: NRG; PAM sequence: GGG
actctgtgttgggtaggaaa

SEQ ID NO: 73198 - DNA, 20 bp, Artificial Sequence
  Description of Artificial Sequence: Synthetic oligonucleotide
  Target: ATXN1; (-) strand; PAM type: NRG; PAM sequence: AGG
cactctgtgttgggtaggaa

SEQ ID NO: 73199 - DNA, 20 bp, Artificial Sequence
  Description of Artificial Sequence: Synthetic oligonucleotide
  Target: ATXN1; (-) strand; PAM type: NRG; PAM sequence: AAG
tcactctgtgttgggtagga

SEQ ID NO: 73200 - DNA, 20 bp, Artificial Sequence
  Description of Artificial Sequence: Synthetic oligonucleotide
  Target: ATXN1; (-) strand; PAM type: NRG; PAM sequence: AGG
tgtctcactctgtgttgggt

SEQ ID NO: 73201 - DNA, 20 bp, Artificial Sequence
  Description of Artificial Sequence: Synthetic oligonucleotide
  Target: ATXN1; (-) strand; PAM type: NRG; PAM sequence: TAG
gtgtctcactctgtgttggg

SEQ ID NO: 73202 - DNA, 20 bp, Artificial Sequence
  Description of Artificial Sequence: Synthetic oligonucleotide
  Target: ATXN1; (-) strand; PAM type: NRG; PAM sequence: GGG
cttgtgtctcactctgtgtt

SEQ ID NO: 73203 - DNA, 20 bp, Artificial Sequence
  Description of Artificial Sequence: Synthetic oligonucleotide
  Target: ATXN1; (-) strand; PAM type: NRG; PAM sequence: TGG
gcttgtgtctcactctgtgt

SEQ ID NO: 73204 - DNA, 20 bp, Artificial Sequence
  Description of Artificial Sequence: Synthetic oligonucleotide
  Target: ATXN1; (-) strand; PAM type: NRG; PAM sequence: GGG
tgttctttttgttttctctt

SEQ ID NO: 73205 - DNA, 20 bp, Artificial Sequence
  Description of Artificial Sequence: Synthetic oligonucleotide
  Target: ATXN1; (-) strand; PAM type: NRG; PAM sequence: TGG
gtgttctttttgttttctct

SEQ ID NO: 73206 - DNA, 20 bp, Artificial Sequence
  Description of Artificial Sequence: Synthetic oligonucleotide
  Target: ATXN1; (-) strand; PAM type: NRG; PAM sequence: TGG
ccctgaagtcatgctctggc

SEQ ID NO: 73207 - DNA, 20 bp, Artificial Sequence
  Description of Artificial Sequence: Synthetic oligonucleotide
  Target: ATXN1; (-) strand; PAM type: NRG; PAM sequence: TGG
cacaccctgaagtcatgctc

SEQ ID NO: 73208 - DNA, 20 bp, Artificial Sequence
  Description of Artificial Sequence: Synthetic oligonucleotide
  Target: ATXN1; (-) strand; PAM type: NRG; PAM sequence: AAG
cacctagtgagcacaccctg

SEQ ID NO: 73209 - DNA, 20 bp, Artificial Sequence
  Description of Artificial Sequence: Synthetic oligonucleotide
  Target: ATXN1; (-) strand; PAM type: NRG; PAM sequence: GAG
cgtagataatatcacctagt

SEQ ID NO: 73210 - DNA, 20 bp, Artificial Sequence
  Description of Artificial Sequence: Synthetic oligonucleotide
  Target: ATXN1; (-) strand; PAM type: NRG; PAM sequence: TAG
tcaacgtagataatatcacc

SEQ ID NO: 73211 - DNA, 20 bp, Artificial Sequence
  Description of Artificial Sequence: Synthetic oligonucleotide
  Target: ATXN1; (-) strand; PAM type: NRG; PAM sequence: TAG
ggtaccatgtcttttcaacg

SEQ ID NO: 73212 - DNA, 20 bp, Artificial Sequence
  Description of Artificial Sequence: Synthetic oligonucleotide
  Target: ATXN1; (-) strand; PAM type: NRG; PAM sequence: AGG
acctcaaactcttgatcttc

SEQ ID NO: 73213 - DNA, 20 bp, Artificial Sequence
  Description of Artificial Sequence: Synthetic oligonucleotide
  Target: ATXN1; (-) strand; PAM type: NRG; PAM sequence: CAG
aacctcaaactcttgatctt

SEQ ID NO: 73214 - DNA, 20 bp, Artificial Sequence
  Description of Artificial Sequence: Synthetic oligonucleotide
  Target: ATXN1; (-) strand; PAM type: NRG; PAM sequence: AAG
tatagaagaaaaaacagaaa

SEQ ID NO: 73215 - DNA, 20 bp, Artificial Sequence
  Description of Artificial Sequence: Synthetic oligonucleotide
  Target: ATXN1; (-) strand; PAM type: NRG; PAM sequence: CAG
gaactttatagaagaaaaaa

SEQ ID NO: 73216 - DNA, 20 bp, Artificial Sequence
  Description of Artificial Sequence: Synthetic oligonucleotide
  Target: ATXN1; (-) strand; PAM type: NRG; PAM sequence: AAG
aagtatactgaactttatag

SEQ ID NO: 73217 - DNA, 20 bp, Artificial Sequence
  Description of Artificial Sequence: Synthetic oligonucleotide
  Target: ATXN1; (-) strand; PAM type: NRG; PAM sequence: TAG
taaaagtatactgaacttta

SEQ ID NO: 73218 - DNA, 20 bp, Artificial Sequence
  Description of Artificial Sequence: Synthetic oligonucleotide
  Target: ATXN1; (-) strand; PAM type: NRG; PAM sequence: AAG
tgaaagttaaaatgccataa

SEQ ID NO: 73219 - DNA, 20 bp, Artificial Sequence
  Description of Artificial Sequence: Synthetic oligonucleotide
  Target: ATXN1; (-) strand; PAM type: NRG; PAM sequence: AAG
tcccaaggtaccaaaactga

SEQ ID NO: 73220 - DNA, 20 bp, Artificial Sequence
  Description of Artificial Sequence: Synthetic oligonucleotide
  Target: ATXN1; (-) strand; PAM type: NRG; PAM sequence: AGG
tagaggatgctgtgttccca

SEQ ID NO: 73221 - DNA, 20 bp, Artificial Sequence
  Description of Artificial Sequence: Synthetic oligonucleotide
  Target: ATXN1; (-) strand; PAM type: NRG; PAM sequence: AAG
atagaggatgctgtgttccc

SEQ ID NO: 73222 - DNA, 20 bp, Artificial Sequence
  Description of Artificial Sequence: Synthetic oligonucleotide
  Target: ATXN1; (-) strand; PAM type: NRG; PAM sequence: AGG
acttaactctgccaagatag

SEQ ID NO: 73223 - DNA, 20 bp, Artificial Sequence
  Description of Artificial Sequence: Synthetic oligonucleotide
  Target: ATXN1; (-) strand; PAM type: NRG; PAM sequence: GAG
cacttaactctgccaagata

SEQ ID NO: 73224 - DNA, 20 bp, Artificial Sequence
  Description of Artificial Sequence: Synthetic oligonucleotide
  Target: ATXN1; (-) strand; PAM type: NRG; PAM sequence: TAG
cccacttaactctgccaaga

SEQ ID NO: 73225 - DNA, 20 bp, Artificial Sequence
  Description of Artificial Sequence: Synthetic oligonucleotide
  Target: ATXN1; (-) strand; PAM type: NRG; PAM sequence: AAG
atgccccacttaactctgcc

SEQ ID NO: 73226 - DNA, 20 bp, Artificial Sequence
  Description of Artificial Sequence: Synthetic oligonucleotide
  Target: ATXN1; (-) strand; PAM type: NRG; PAM sequence: AGG
tcaccattctacttaggaaa

SEQ ID NO: 73227 - DNA, 20 bp, Artificial Sequence
  Description of Artificial Sequence: Synthetic oligonucleotide
  Target: ATXN1; (-) strand; PAM type: NRG; PAM sequence: AAG
atcaccattctacttaggaa

SEQ ID NO: 73228 - DNA, 20 bp, Artificial Sequence
  Description of Artificial Sequence: Synthetic oligonucleotide
  Target: ATXN1; (-) strand; PAM type: NRG; PAM sequence: AGG
gttaaatcaccattctactt

SEQ ID NO: 73229 - DNA, 20 bp, Artificial Sequence
  Description of Artificial Sequence: Synthetic oligonucleotide
  Target: ATXN1; (-) strand; PAM type: NRG; PAM sequence: TAG
tgttaaatcaccattctact

SEQ ID NO: 73230 - DNA, 20 bp, Artificial Sequence
  Description of Artificial Sequence: Synthetic oligonucleotide
  Target: ATXN1; (-) strand; PAM type: NRG; PAM sequence: TGG
aaaaatgtcaggtctactgt

SEQ ID NO: 73231 - DNA, 20 bp, Artificial Sequence
  Description of Artificial Sequence: Synthetic oligonucleotide
  Target: ATXN1; (-) strand; PAM type: NRG; PAM sequence: AGG
gtcctcttgataaaaatgtc

SEQ ID NO: 73232 - DNA, 20 bp, Artificial Sequence
  Description of Artificial Sequence: Synthetic oligonucleotide
  Target: ATXN1; (-) strand; PAM type: NRG; PAM sequence: CAG
tgtcctcttgataaaaatgt

SEQ ID NO: 73233 - DNA, 20 bp, Artificial Sequence
  Description of Artificial Sequence: Synthetic oligonucleotide
  Target: ATXN1; (-) strand; PAM type: NRG; PAM sequence: AAG
gtagccatgaacagtgttag

SEQ ID NO: 73234 - DNA, 20 bp, Artificial Sequence
  Description of Artificial Sequence: Synthetic oligonucleotide
  Target: ATXN1; (-) strand; PAM type: NRG; PAM sequence: TAG
gcagtagccatgaacagtgt

SEQ ID NO: 73235 - DNA, 20 bp, Artificial Sequence
  Description of Artificial Sequence: Synthetic oligonucleotide
  Target: ATXN1; (-) strand; PAM type: NRG; PAM sequence: CAG
ttcctagcagtagccatgaa

SEQ ID NO: 73236 - DNA, 20 bp, Artificial Sequence
  Description of Artificial Sequence: Synthetic oligonucleotide
  Target: ATXN1; (-) strand; PAM type: NRG; PAM sequence: TAG
ccctactctgttcctagcag

SEQ ID NO: 73237 - DNA, 20 bp, Artificial Sequence
  Description of Artificial Sequence: Synthetic oligonucleotide
  Target: ATXN1; (-) strand; PAM type: NRG; PAM sequence: CAG
ttgccctactctgttcctag

SEQ ID NO: 73238 - DNA, 20 bp, Artificial Sequence
  Description of Artificial Sequence: Synthetic oligonucleotide
  Target: ATXN1; (-) strand; PAM type: NRG; PAM sequence: TAG
agattgccctactctgttcc

SEQ ID NO: 73239 - DNA, 20 bp, Artificial Sequence
  Description of Artificial Sequence: Synthetic oligonucleotide
  Target: ATXN1; (-) strand; PAM type: NRG; PAM sequence: AAG
ctccacataaaaagaaggga

SEQ ID NO: 73240 - DNA, 20 bp, Artificial Sequence
  Description of Artificial Sequence: Synthetic oligonucleotide
  Target: ATXN1; (-) strand; PAM type: NRG; PAM sequence: GGG
tgccctccacataaaaagaa

SEQ ID NO: 73241 - DNA, 20 bp, Artificial Sequence
  Description of Artificial Sequence: Synthetic oligonucleotide
  Target: ATXN1; (-) strand; PAM type: NRG; PAM sequence: AGG
ctgccctccacataaaaaga

SEQ ID NO: 73242 - DNA, 20 bp, Artificial Sequence
  Description of Artificial Sequence: Synthetic oligonucleotide
  Target: ATXN1; (-) strand; PAM type: NRG; PAM sequence: AAG
cctgccctccacataaaaag

SEQ ID NO: 73243 - DNA, 20 bp, Artificial Sequence
  Description of Artificial Sequence: Synthetic oligonucleotide
  Target: ATXN1; (-) strand; PAM type: NRG; PAM sequence: AAG
gtccctgccctccacataaa

SEQ ID NO: 73244 - DNA, 20 bp, Artificial Sequence
  Description of Artificial Sequence: Synthetic oligonucleotide
  Target: ATXN1; (-) strand; PAM type: NRG; PAM sequence: GAG
gccaggtcagcctacttaag

SEQ ID NO: 73245 - DNA, 20 bp, Artificial Sequence
  Description of Artificial Sequence: Synthetic oligonucleotide
  Target: ATXN1; (-) strand; PAM type: NRG; PAM sequence: AGG
tggccaggtcagcctactta

SEQ ID NO: 73246 - DNA, 20 bp, Artificial Sequence
  Description of Artificial Sequence: Synthetic oligonucleotide
  Target: ATXN1; (-) strand; PAM type: NRG; PAM sequence: AAG
atggccaggtcagcctactt

SEQ ID NO: 73247 - DNA, 20 bp, Artificial Sequence
  Description of Artificial Sequence: Synthetic oligonucleotide
  Target: ATXN1; (-) strand; PAM type: NRG; PAM sequence: CAG
gactgaatgaatggccaggt

SEQ ID NO: 73248 - DNA, 20 bp, Artificial Sequence
  Description of Artificial Sequence: Synthetic oligonucleotide
  Target: ATXN1; (-) strand; PAM type: NRG; PAM sequence: AGG
gctagactgaatgaatggcc

SEQ ID NO: 73249 - DNA, 20 bp, Artificial Sequence
  Description of Artificial Sequence: Synthetic oligonucleotide
  Target: ATXN1; (-) strand; PAM type: NRG; PAM sequence: CAG
ggctagactgaatgaatggc

SEQ ID NO: 73250 - DNA, 20 bp, Artificial Sequence
  Description of Artificial Sequence: Synthetic oligonucleotide
  Target: ATXN1; (-) strand; PAM type: NRG; PAM sequence: TGG
cttaggctagactgaatgaa

SEQ ID NO: 73251 - DNA, 20 bp, Artificial Sequence
  Description of Artificial Sequence: Synthetic oligonucleotide
  Target: ATXN1; (-) strand; PAM type: NRG; PAM sequence: TAG
agaaagcctgtggcttaggc

SEQ ID NO: 73252 - DNA, 20 bp, Artificial Sequence
  Description of Artificial Sequence: Synthetic oligonucleotide
  Target: ATXN1; (-) strand; PAM type: NRG; PAM sequence: AGG
ggccagaaagcctgtggctt

SEQ ID NO: 73253 - DNA, 20 bp, Artificial Sequence
  Description of Artificial Sequence: Synthetic oligonucleotide
  Target: ATXN1; (-) strand; PAM type: NRG; PAM sequence: TAG
gggccagaaagcctgtggct

SEQ ID NO: 73254 - DNA, 20 bp, Artificial Sequence
  Description of Artificial Sequence: Synthetic oligonucleotide
  Target: ATXN1; (-) strand; PAM type: NRG; PAM sequence: TGG
aatgtgggccagaaagcctg

SEQ ID NO: 73255 - DNA, 20 bp, Artificial Sequence
  Description of Artificial Sequence: Synthetic oligonucleotide
  Target: ATXN1; (-) strand; PAM type: NRG; PAM sequence: AAG
acgctggaatgtgggccaga

SEQ ID NO: 73256 - DNA, 20 bp, Artificial Sequence
  Description of Artificial Sequence: Synthetic oligonucleotide
  Target: ATXN1; (-) strand; PAM type: NRG; PAM sequence: CAG
gcttacgctggaatgtgggc

SEQ ID NO: 73257 - DNA, 20 bp, Artificial Sequence
  Description of Artificial Sequence: Synthetic oligonucleotide
  Target: ATXN1; (-) strand; PAM type: NRG; PAM sequence: GGG
atctgcttacgctggaatgt

SEQ ID NO: 73258 - DNA, 20 bp, Artificial Sequence
  Description of Artificial Sequence: Synthetic oligonucleotide
  Target: ATXN1; (-) strand; PAM type: NRG; PAM sequence: TGG
catctgcttacgctggaatg

SEQ ID NO: 73259 - DNA, 20 bp, Artificial Sequence
  Description of Artificial Sequence: Synthetic oligonucleotide
  Target: ATXN1; (-) strand; PAM type: NRG; PAM sequence: TGG
aacacagcatctgcttacgc

SEQ ID NO: 73260 - DNA, 20 bp, Artificial Sequence
  Description of Artificial Sequence: Synthetic oligonucleotide
  Target: ATXN1; (-) strand; PAM type: NRG; PAM sequence: CAG
gattaaaaagaatgtcaaca

SEQ ID NO: 73261 - DNA, 20 bp, Artificial Sequence
  Description of Artificial Sequence: Synthetic oligonucleotide
  Target: ATXN1; (-) strand; PAM type: NRG; PAM sequence: AAG
ggtgaggaaggaggattaaa

SEQ ID NO: 73262 - DNA, 20 bp, Artificial Sequence
  Description of Artificial Sequence: Synthetic oligonucleotide
  Target: ATXN1; (-) strand; PAM type: NRG; PAM sequence: AGG
tgtattctaggtgaggaagg

SEQ ID NO: 73263 - DNA, 20 bp, Artificial Sequence
  Description of Artificial Sequence: Synthetic oligonucleotide
  Target: ATXN1; (-) strand; PAM type: NRG; PAM sequence: GAG
atgtattctaggtgaggaag

SEQ ID NO: 73264 - DNA, 20 bp, Artificial Sequence
  Description of Artificial Sequence: Synthetic oligonucleotide
  Target: ATXN1; (-) strand; PAM type: NRG; PAM sequence: AGG
taatgtattctaggtgagga

SEQ ID NO: 73265 - DNA, 20 bp, Artificial Sequence
  Description of Artificial Sequence: Synthetic oligonucleotide
  Target: ATXN1; (-) strand; PAM type: NRG; PAM sequence: AAG
ataatgtattctaggtgagg

SEQ ID NO: 73266 - DNA, 20 bp, Artificial Sequence
  Description of Artificial Sequence: Synthetic oligonucleotide
  Target: ATXN1; (-) strand; PAM type: NRG; PAM sequence: AGG
ggaataatgtattctaggtg

SEQ ID NO: 73267 - DNA, 20 bp, Artificial Sequence
  Description of Artificial Sequence: Synthetic oligonucleotide
  Target: ATXN1; (-) strand; PAM type: NRG; PAM sequence: GAG
aggaataatgtattctaggt

SEQ ID NO: 73268 - DNA, 20 bp, Artificial Sequence
  Description of Artificial Sequence: Synthetic oligonucleotide
  Target: ATXN1; (-) strand; PAM type: NRG; PAM sequence: AGG
atcgaggaataatgtattct

SEQ ID NO: 73269 - DNA, 20 bp, Artificial Sequence
  Description of Artificial Sequence: Synthetic oligonucleotide
  Target: ATXN1; (-) strand; PAM type: NRG; PAM sequence: TAG
catcgaggaataatgtattc

SEQ ID NO: 73270 - DNA, 20 bp, Artificial Sequence
  Description of Artificial Sequence: Synthetic oligonucleotide
  Target: ATXN1; (-) strand; PAM type: NRG; PAM sequence: AGG
atatttgcatgcctacatcg

SEQ ID NO: 73271 - DNA, 20 bp, Artificial Sequence
  Description of Artificial Sequence: Synthetic oligonucleotide
  Target: ATXN1; (-) strand; PAM type: NRG; PAM sequence: GAG
gatatttgcatgcctacatc

SEQ ID NO: 73272 - DNA, 20 bp, Artificial Sequence
  Description of Artificial Sequence: Synthetic oligonucleotide
  Target: ATXN1; (-) strand; PAM type: NRG; PAM sequence: CAG
aactgaaataatccattcag

SEQ ID NO: 73273 - DNA, 20 bp, Artificial Sequence
  Description of Artificial Sequence: Synthetic oligonucleotide
  Target: ATXN1; (-) strand; PAM type: NRG; PAM sequence: CAG
cataactgaaataatccatt

SEQ ID NO: 73274 - DNA, 20 bp, Artificial Sequence
  Description of Artificial Sequence: Synthetic oligonucleotide
  Target: ATXN1; (-) strand; PAM type: NRG; PAM sequence: TGG
atttactggacaggtactat

SEQ ID NO: 73275 - DNA, 20 bp, Artificial Sequence
  Description of Artificial Sequence: Synthetic oligonucleotide
  Target: ATXN1; (-) strand; PAM type: NRG; PAM sequence: AGG
ctgggtcatatttactggac

SEQ ID NO: 73276 - DNA, 20 bp, Artificial Sequence
  Description of Artificial Sequence: Synthetic oligonucleotide
  Target: ATXN1; (-) strand; PAM type: NRG; PAM sequence: CAG
tctgggtcatatttactgga

SEQ ID NO: 73277 - DNA, 20 bp, Artificial Sequence
  Description of Artificial Sequence: Synthetic oligonucleotide
  Target: ATXN1; (-) strand; PAM type: NRG; PAM sequence: TGG
gatttctgggtcatatttac

SEQ ID NO: 73278 - DNA, 20 bp, Artificial Sequence
  Description of Artificial Sequence: Synthetic oligonucleotide
  Target: ATXN1; (-) strand; PAM type: NRG; PAM sequence: GGG
aggagtcaaagatgatttct

SEQ ID NO: 73279 - DNA, 20 bp, Artificial Sequence
  Description of Artificial Sequence: Synthetic oligonucleotide
  Target: ATXN1; (-) strand; PAM type: NRG; PAM sequence: TGG
aaggagtcaaagatgatttc

SEQ ID NO: 73280 - DNA, 20 bp, Artificial Sequence
  Description of Artificial Sequence: Synthetic oligonucleotide
  Target: ATXN1; (-) strand; PAM type: NRG; PAM sequence: AAG
gaatggagaggaaggagtca

SEQ ID NO: 73281 - DNA, 20 bp, Artificial Sequence
  Description of Artificial Sequence: Synthetic oligonucleotide
  Target: ATXN1; (-) strand; PAM type: NRG; PAM sequence: GAG
tttggagaatggagaggaag

SEQ ID NO: 73282 - DNA, 20 bp, Artificial Sequence
  Description of Artificial Sequence: Synthetic oligonucleotide
  Target: ATXN1; (-) strand; PAM type: NRG; PAM sequence: AGG
gatttggagaatggagagga

SEQ ID NO: 73283 - DNA, 20 bp, Artificial Sequence
  Description of Artificial Sequence: Synthetic oligonucleotide
  Target: ATXN1; (-) strand; PAM type: NRG; PAM sequence: AAG
ggatttggagaatggagagg

SEQ ID NO: 73284 - DNA, 20 bp, Artificial Sequence
  Description of Artificial Sequence: Synthetic oligonucleotide
  Target: ATXN1; (-) strand; PAM type: NRG; PAM sequence: AGG
gttggatttggagaatggag

SEQ ID NO: 73285 - DNA, 20 bp, Artificial Sequence
  Description of Artificial Sequence: Synthetic oligonucleotide
  Target: ATXN1; (-) strand; PAM type: NRG; PAM sequence: GAG
tgttggatttggagaatgga

SEQ ID NO: 73286 - DNA, 20 bp, Artificial Sequence
  Description of Artificial Sequence: Synthetic oligonucleotide
  Target: ATXN1; (-) strand; PAM type: NRG; PAM sequence: GAG
attgttggatttggagaatg

SEQ ID NO: 73287 - DNA, 20 bp, Artificial Sequence
  Description of Artificial Sequence: Synthetic oligonucleotide
  Target: ATXN1; (-) strand; PAM type: NRG; PAM sequence: TGG
taattgttggatttggagaa

SEQ ID NO: 73288 - DNA, 20 bp, Artificial Sequence
  Description of Artificial Sequence: Synthetic oligonucleotide
  Target: ATXN1; (-) strand; PAM type: NRG; PAM sequence: GAG
cttagtaattgttggatttg

SEQ ID NO: 73289 - DNA, 20 bp, Artificial Sequence
  Description of Artificial Sequence: Synthetic oligonucleotide
  Target: ATXN1; (-) strand; PAM type: NRG; PAM sequence: TGG
aacttagtaattgttggatt

SEQ ID NO: 73290 - DNA, 20 bp, Artificial Sequence
  Description of Artificial Sequence: Synthetic oligonucleotide
  Target: ATXN1; (-) strand; PAM type: NRG; PAM sequence: TGG
taatataacttagtaattgt

SEQ ID NO: 73291 - DNA, 20 bp, Artificial Sequence
  Description of Artificial Sequence: Synthetic oligonucleotide
  Target: ATXN1; (-) strand; PAM type: NRG; PAM sequence: TAG
agggataaaataatataact

SEQ ID NO: 73292 - DNA, 20 bp, Artificial Sequence
  Description of Artificial Sequence: Synthetic oligonucleotide
  Target: ATXN1; (-) strand; PAM type: NRG; PAM sequence: GGG
catattcaaaggtatttgaa

SEQ ID NO: 73293 - DNA, 20 bp, Artificial Sequence
  Description of Artificial Sequence: Synthetic oligonucleotide
  Target: ATXN1; (-) strand; PAM type: NRG; PAM sequence: AGG
acatattcaaaggtatttga

SEQ ID NO: 73294 - DNA, 20 bp, Artificial Sequence
  Description of Artificial Sequence: Synthetic oligonucleotide
  Target: ATXN1; (-) strand; PAM type: NRG; PAM sequence: AAG
aacatattcaaaggtatttg

SEQ ID NO: 73295 - DNA, 20 bp, Artificial Sequence
  Description of Artificial Sequence: Synthetic oligonucleotide
  Target: ATXN1; (-) strand; PAM type: NRG; PAM sequence: AGG
aaagggggcaacatattcaa

SEQ ID NO: 73296 - DNA, 20 bp, Artificial Sequence
  Description of Artificial Sequence: Synthetic oligonucleotide
  Target: ATXN1; (-) strand; PAM type: NRG; PAM sequence: AAG
aaaagggggcaacatattca

SEQ ID NO: 73297 - DNA, 20 bp, Artificial Sequence
  Description of Artificial Sequence: Synthetic oligonucleotide
  Target: ATXN1; (-) strand; PAM type: NRG; PAM sequence: GGG
gatggcaggaaaggaaaagg

SEQ ID NO: 73298 - DNA, 20 bp, Artificial Sequence
  Description of Artificial Sequence: Synthetic oligonucleotide
  Target: ATXN1; (-) strand; PAM type: NRG; PAM sequence: GGG
ggatggcaggaaaggaaaag

SEQ ID NO: 73299 - DNA, 20 bp, Artificial Sequence
  Description of Artificial Sequence: Synthetic oligonucleotide
  Target: ATXN1; (-) strand; PAM type: NRG; PAM sequence: GGG
aggatggcaggaaaggaaaa

SEQ ID NO: 73300 - DNA, 20 bp, Artificial Sequence
  Description of Artificial Sequence: Synthetic oligonucleotide
  Target: ATXN1; (-) strand; PAM type: NRG; PAM sequence: AGG
gaggatggcaggaaaggaaa

SEQ ID NO: 73301 - DNA, 20 bp, Artificial Sequence
  Description of Artificial Sequence: Synthetic oligonucleotide
  Target: ATXN1; (-) strand; PAM type: NRG; PAM sequence: AAG
ggaggatggcaggaaaggaa

SEQ ID NO: 73302 - DNA, 20 bp, Artificial Sequence
  Description of Artificial Sequence: Synthetic oligonucleotide
  Target: ATXN1; (-) strand; PAM type: NRG; PAM sequence: AGG
tgttgggaggatggcaggaa

SEQ ID NO: 73303 - DNA, 20 bp, Artificial Sequence
  Description of Artificial Sequence: Synthetic oligonucleotide
  Target: ATXN1; (-) strand; PAM type: NRG; PAM sequence: AAG
gtgttgggaggatggcagga

SEQ ID NO: 73304 - DNA, 20 bp, Artificial Sequence
  Description of Artificial Sequence: Synthetic oligonucleotide
  Target: ATXN1; (-) strand; PAM type: NRG; PAM sequence: AGG
gagggtgttgggaggatggc

SEQ ID NO: 73305 - DNA, 20 bp, Artificial Sequence
  Description of Artificial Sequence: Synthetic oligonucleotide
  Target: ATXN1; (-) strand; PAM type: NRG; PAM sequence: CAG
tgagggtgttgggaggatgg

SEQ ID NO: 73306 - DNA, 20 bp, Artificial Sequence
  Description of Artificial Sequence: Synthetic oligonucleotide
  Target: ATXN1; (-) strand; PAM type: NRG; PAM sequence: TGG
gtttgagggtgttgggagga

SEQ ID NO: 73307 - DNA, 20 bp, Artificial Sequence
  Description of Artificial Sequence: Synthetic oligonucleotide
  Target: ATXN1; (-) strand; PAM type: NRG; PAM sequence: AGG
attcgtttgagggtgttggg

SEQ ID NO: 73308 - DNA, 20 bp, Artificial Sequence
  Description of Artificial Sequence: Synthetic oligonucleotide
  Target: ATXN1; (-) strand; PAM type: NRG; PAM sequence: GAG
tattcgtttgagggtgttgg

SEQ ID NO: 73309 - DNA, 20 bp, Artificial Sequence
  Description of Artificial Sequence: Synthetic oligonucleotide
  Target: ATXN1; (-) strand; PAM type: NRG; PAM sequence: GGG
cctattcgtttgagggtgtt

SEQ ID NO: 73310 - DNA, 20 bp, Artificial Sequence
  Description of Artificial Sequence: Synthetic oligonucleotide
  Target: ATXN1; (-) strand; PAM type: NRG; PAM sequence: TGG
gcctattcgtttgagggtgt

SEQ ID NO: 73311 - DNA, 20 bp, Artificial Sequence
  Description of Artificial Sequence: Synthetic oligonucleotide
  Target: ATXN1; (-) strand; PAM type: NRG; PAM sequence: GGG
atgggagcctattcgtttga

SEQ ID NO: 73312 - DNA, 20 bp, Artificial Sequence
  Description of Artificial Sequence: Synthetic oligonucleotide
  Target: ATXN1; (-) strand; PAM type: NRG; PAM sequence: AGG
aatgggagcctattcgtttg

SEQ ID NO: 73313 - DNA, 20 bp, Artificial Sequence
  Description of Artificial Sequence: Synthetic oligonucleotide
  Target: ATXN1; (-) strand; PAM type: NRG; PAM sequence: GAG
taatgggagcctattcgttt

SEQ ID NO: 73314 - DNA, 20 bp, Artificial Sequence
  Description of Artificial Sequence: Synthetic oligonucleotide
  Target: ATXN1; (-) strand; PAM type: NRG; PAM sequence: GAG
gaattaaagataggtaatgg

SEQ ID NO: 73315 - DNA, 20 bp, Artificial Sequence
  Description of Artificial Sequence: Synthetic oligonucleotide
  Target: ATXN1; (-) strand; PAM type: NRG; PAM sequence: GGG
aggaattaaagataggtaat

SEQ ID NO: 73316 - DNA, 20 bp, Artificial Sequence
  Description of Artificial Sequence: Synthetic oligonucleotide
  Target: ATXN1; (-) strand; PAM type: NRG; PAM sequence: TGG
caggaattaaagataggtaa

SEQ ID NO: 73317 - DNA, 20 bp, Artificial Sequence
  Description of Artificial Sequence: Synthetic oligonucleotide
  Target: ATXN1; (-) strand; PAM type: NRG; PAM sequence: AGG
gcgagtcaggaattaaagat

SEQ ID NO: 73318 - DNA, 20 bp, Artificial Sequence
  Description of Artificial Sequence: Synthetic oligonucleotide
  Target: ATXN1; (-) strand; PAM type: NRG; PAM sequence: TAG
ggcgagtcaggaattaaaga

SEQ ID NO: 73319 - DNA, 20 bp, Artificial Sequence
  Description of Artificial Sequence: Synthetic oligonucleotide
  Target: ATXN1; (-) strand; PAM type: NRG; PAM sequence: AAG
gacaggcgagtcaggaatta

SEQ ID NO: 73320 - DNA, 20 bp, Artificial Sequence
  Description of Artificial Sequence: Synthetic oligonucleotide
  Target: ATXN1; (-) strand; PAM type: NRG; PAM sequence: AGG
aaacaggggacaggcgagtc

SEQ ID NO: 73321 - DNA, 20 bp, Artificial Sequence
  Description of Artificial Sequence: Synthetic oligonucleotide
  Target: ATXN1; (-) strand; PAM type: NRG; PAM sequence: CAG
gaaacaggggacaggcgagt

SEQ ID NO: 73322 - DNA, 20 bp, Artificial Sequence
  Description of Artificial Sequence: Synthetic oligonucleotide
  Target: ATXN1; (-) strand; PAM type: NRG; PAM sequence: GAG
gggagaaacaggggacaggc

SEQ ID NO: 73323 - DNA, 20 bp, Artificial Sequence
  Description of Artificial Sequence: Synthetic oligonucleotide
  Target: ATXN1; (-) strand; PAM type: NRG; PAM sequence: AGG
agttgggagaaacaggggac

SEQ ID NO: 73324 - DNA, 20 bp, Artificial Sequence
  Description of Artificial Sequence: Synthetic oligonucleotide
  Target: ATXN1; (-) strand; PAM type: NRG; PAM sequence: CAG
gagttgggagaaacagggga

SEQ ID NO: 73325 - DNA, 20 bp, Artificial Sequence
  Description of Artificial Sequence: Synthetic oligonucleotide
  Target: ATXN1; (-) strand; PAM type: NRG; PAM sequence: GGG
gccagagttgggagaaacag

SEQ ID NO: 73326 - DNA, 20 bp, Artificial Sequence
  Description of Artificial Sequence: Synthetic oligonucleotide
  Target: ATXN1; (-) strand; PAM type: NRG; PAM sequence: GGG
ggccagagttgggagaaaca

SEQ ID NO: 73327 - DNA, 20 bp, Artificial Sequence
  Description of Artificial Sequence: Synthetic oligonucleotide
  Target: ATXN1; (-) strand; PAM type: NRG; PAM sequence: AGG
tggccagagttgggagaaac

SEQ ID NO: 73328 - DNA, 20 bp, Artificial Sequence
  Description of Artificial Sequence: Synthetic oligonucleotide
  Target: ATXN1; (-) strand; PAM type: NRG; PAM sequence: CAG
gtggccagagttgggagaaa

SEQ ID NO: 73329 - DNA, 20 bp, Artificial Sequence
  Description of Artificial Sequence: Synthetic oligonucleotide
  Target: ATXN1; (-) strand; PAM type: NRG; PAM sequence: GAG
tgtagggtggccagagttgg

SEQ ID NO: 73330 - DNA, 20 bp, Artificial Sequence
  Description of Artificial Sequence: Synthetic oligonucleotide
  Target: ATXN1; (-) strand; PAM type: NRG; PAM sequence: GGG
tatgtagggtggccagagtt

SEQ ID NO: 73331 - DNA, 20 bp, Artificial Sequence
  Description of Artificial Sequence: Synthetic oligonucleotide
  Target: ATXN1; (-) strand; PAM type: NRG; PAM sequence: TGG
gtatgtagggtggccagagt

SEQ ID NO: 73332 - DNA, 20 bp, Artificial Sequence
  Description of Artificial Sequence: Synthetic oligonucleotide
  Target: ATXN1; (-) strand; PAM type: NRG; PAM sequence: GAG
caatgtatgtagggtggcca

SEQ ID NO: 73333 - DNA, 20 bp, Artificial Sequence
  Description of Artificial Sequence: Synthetic oligonucleotide
  Target: ATXN1; (-) strand; PAM type: NRG; PAM sequence: CAG
gacaatgtatgtagggtggc

SEQ ID NO: 73334 - DNA, 20 bp, Artificial Sequence
  Description of Artificial Sequence: Synthetic oligonucleotide
  Target: ATXN1; (-) strand; PAM type: NRG; PAM sequence: TGG
cggtgacaatgtatgtaggg

SEQ ID NO: 73335 - DNA, 20 bp, Artificial Sequence
  Description of Artificial Sequence: Synthetic oligonucleotide
  Target: ATXN1; (-) strand; PAM type: NRG; PAM sequence: GGG
aaccggtgacaatgtatgta

SEQ ID NO: 73336 - DNA, 20 bp, Artificial Sequence
  Description of Artificial Sequence: Synthetic oligonucleotide
  Target: ATXN1; (-) strand; PAM type: NRG; PAM sequence: AGG
aaaccggtgacaatgtatgt

SEQ ID NO: 73337 - DNA, 20 bp, Artificial Sequence
  Description of Artificial Sequence: Synthetic oligonucleotide
  Target: ATXN1; (-) strand; PAM type: NRG; PAM sequence: TAG
gaaaccggtgacaatgtatg

SEQ ID NO: 73338 - DNA, 20 bp, Artificial Sequence
  Description of Artificial Sequence: Synthetic oligonucleotide
  Target: ATXN1; (-) strand; PAM type: NRG; PAM sequence: CGG
tgtgtgtatatatctgaaac

SEQ ID NO: 73339 - DNA, 20 bp, Artificial Sequence
  Description of Artificial Sequence: Synthetic oligonucleotide
  Target: ATXN1; (-) strand; PAM type: NRG; PAM sequence: GAG
gtttatggaaggggctcagt

SEQ ID NO: 73340 - DNA, 20 bp, Artificial Sequence
  Description of Artificial Sequence: Synthetic oligonucleotide
  Target: ATXN1; (-) strand; PAM type: NRG; PAM sequence: CAG
tcttgtttatggaaggggct

SEQ ID NO: 73341 - DNA, 20 bp, Artificial Sequence
  Description of Artificial Sequence: Synthetic oligonucleotide
  Target: ATXN1; (-) strand; PAM type: NRG; PAM sequence: GGG
ccagttcttgtttatggaag

SEQ ID NO: 73342 - DNA, 20 bp, Artificial Sequence
  Description of Artificial Sequence: Synthetic oligonucleotide
  Target: ATXN1; (-) strand; PAM type: NRG; PAM sequence: GGG
cccagttcttgtttatggaa

SEQ ID NO: 73343 - DNA, 20 bp, Artificial Sequence
  Description of Artificial Sequence: Synthetic oligonucleotide
  Target: ATXN1; (-) strand; PAM type: NRG; PAM sequence: AGG
tcccagttcttgtttatgga

SEQ ID NO: 73344 - DNA, 20 bp, Artificial Sequence
  Description of Artificial Sequence: Synthetic oligonucleotide
  Target: ATXN1; (-) strand; PAM type: NRG; PAM sequence: AAG
ttcccagttcttgtttatgg

SEQ ID NO: 73345 - DNA, 20 bp, Artificial Sequence
  Description of Artificial Sequence: Synthetic oligonucleotide
  Target: ATXN1; (-) strand; PAM type: NRG; PAM sequence: TGG
gagttcccagttcttgttta

SEQ ID NO: 73346 - DNA, 20 bp, Artificial Sequence
  Description of Artificial Sequence: Synthetic oligonucleotide
  Target: ATXN1; (-) strand; PAM type: NRG; PAM sequence: CAG
aggaggtgacacagagttcc

SEQ ID NO: 73347 - DNA, 20 bp, Artificial Sequence
  Description of Artificial Sequence: Synthetic oligonucleotide
  Target: ATXN1; (-) strand; PAM type: NRG; PAM sequence: GAG
ttaatgcaggaggtgacaca

SEQ ID NO: 73348 - DNA, 20 bp, Artificial Sequence
  Description of Artificial Sequence: Synthetic oligonucleotide
  Target: ATXN1; (-) strand; PAM type: NRG; PAM sequence: CAG
agttaatgcaggaggtgaca

SEQ ID NO: 73349 - DNA, 20 bp, Artificial Sequence
  Description of Artificial Sequence: Synthetic oligonucleotide
  Target: ATXN1; (-) strand; PAM type: NRG; PAM sequence: AGG
gaatgtgaagttaatgcagg

SEQ ID NO: 73350 - DNA, 20 bp, Artificial Sequence
  Description of Artificial Sequence: Synthetic oligonucleotide
  Target: ATXN1; (-) strand; PAM type: NRG; PAM sequence: GAG
ggaatgtgaagttaatgcag

SEQ ID NO: 73351 - DNA, 20 bp, Artificial Sequence
  Description of Artificial Sequence: Synthetic oligonucleotide
  Target: ATXN1; (-) strand; PAM type: NRG; PAM sequence: AGG
gaggaatgtgaagttaatgc

SEQ ID NO: 73352 - DNA, 20 bp, Artificial Sequence
  Description of Artificial Sequence: Synthetic oligonucleotide
  Target: ATXN1; (-) strand; PAM type: NRG; PAM sequence: CAG
ggaggaatgtgaagttaatg

SEQ ID NO: 73353 - DNA, 20 bp, Artificial Sequence
  Description of Artificial Sequence: Synthetic oligonucleotide
  Target: ATXN1; (-) strand; PAM type: NRG; PAM sequence: AAG
agacctggcggaggaatgtg

SEQ ID NO: 73354 - DNA, 20 bp, Artificial Sequence
  Description of Artificial Sequence: Synthetic oligonucleotide
  Target: ATXN1; (-) strand; PAM type: NRG; PAM sequence: AGG
ggatcactaagacctggcgg

SEQ ID NO: 73355 - DNA, 20 bp, Artificial Sequence
  Description of Artificial Sequence: Synthetic oligonucleotide
  Target: ATXN1; (-) strand; PAM type: NRG; PAM sequence: GAG
aggatcactaagacctggcg

SEQ ID NO: 73356 - DNA, 20 bp, Artificial Sequence
  Description of Artificial Sequence: Synthetic oligonucleotide
  Target: ATXN1; (-) strand; PAM type: NRG; PAM sequence: CGG
aaaggatcactaagacctgg

SEQ ID NO: 73357 - DNA, 20 bp, Artificial Sequence
  Description of Artificial Sequence: Synthetic oligonucleotide
  Target: ATXN1; (-) strand; PAM type: NRG; PAM sequence: TGG
gctaaaggatcactaagacc

SEQ ID NO: 73358 - DNA, 20 bp, Artificial Sequence
  Description of Artificial Sequence: Synthetic oligonucleotide
  Target: ATXN1; (-) strand; PAM type: NRG; PAM sequence: AAG
aacagagctaaaggatcact

SEQ ID NO: 73359 - DNA, 20 bp, Artificial Sequence
  Description of Artificial Sequence: Synthetic oligonucleotide
  Target: ATXN1; (-) strand; PAM type: NRG; PAM sequence: AGG
tgtggggataacagagctaa

SEQ ID NO: 73360 - DNA, 20 bp, Artificial Sequence
  Description of Artificial Sequence: Synthetic oligonucleotide
  Target: ATXN1; (-) strand; PAM type: NRG; PAM sequence: AAG
ctgtggggataacagagcta

SEQ ID NO: 73361 - DNA, 20 bp, Artificial Sequence
  Description of Artificial Sequence: Synthetic oligonucleotide
  Target: ATXN1; (-) strand; PAM type: NRG; PAM sequence: GAG
tgacagctgtggggataaca

SEQ ID NO: 73362 - DNA, 20 bp, Artificial Sequence
  Description of Artificial Sequence: Synthetic oligonucleotide
  Target: ATXN1; (-) strand; PAM type: NRG; PAM sequence: CAG
tttgacagctgtggggataa

SEQ ID NO: 73363 - DNA, 20 bp, Artificial Sequence
  Description of Artificial Sequence: Synthetic oligonucleotide
  Target: ATXN1; (-) strand; PAM type: NRG; PAM sequence: GGG
aagagaatttgacagctgtg

SEQ ID NO: 73364 - DNA, 20 bp, Artificial Sequence
  Description of Artificial Sequence: Synthetic oligonucleotide
  Target: ATXN1; (-) strand; PAM type: NRG; PAM sequence: GGG
aaagagaatttgacagctgt

SEQ ID NO: 73365 - DNA, 20 bp, Artificial Sequence
  Description of Artificial Sequence: Synthetic oligonucleotide
  Target: ATXN1; (-) strand; PAM type: NRG; PAM sequence: TGG
gaaagagaatttgacagctg

SEQ ID NO: 73366 - DNA, 20 bp, Artificial Sequence
  Description of Artificial Sequence: Synthetic oligonucleotide
  Target: ATXN1; (-) strand; PAM type: NRG; PAM sequence: CAG
tggtatgaaagagaatttga

SEQ ID NO: 73367 - DNA, 20 bp, Artificial Sequence
  Description of Artificial Sequence: Synthetic oligonucleotide
  Target: ATXN1; (-) strand; PAM type: NRG; PAM sequence: GAG
tgctggagattggtatgaaa

SEQ ID NO: 73368 - DNA, 20 bp, Artificial Sequence
  Description of Artificial Sequence: Synthetic oligonucleotide
  Target: ATXN1; (-) strand; PAM type: NRG; PAM sequence: AAG
attgctggagattggtatga

SEQ ID NO: 73369 - DNA, 20 bp, Artificial Sequence
  Description of Artificial Sequence: Synthetic oligonucleotide
  Target: ATXN1; (-) strand; PAM type: NRG; PAM sequence: TGG
atatgtgcattgctggagat

SEQ ID NO: 73370 - DNA, 20 bp, Artificial Sequence
  Description of Artificial Sequence: Synthetic oligonucleotide
  Target: ATXN1; (-) strand; PAM type: NRG; PAM sequence: GAG
gagttatatgtgcattgctg

SEQ ID NO: 73371 - DNA, 20 bp, Artificial Sequence
  Description of Artificial Sequence: Synthetic oligonucleotide
  Target: ATXN1; (-) strand; PAM type: NRG; PAM sequence: TGG
cggagttatatgtgcattgc

SEQ ID NO: 73372 - DNA, 20 bp, Artificial Sequence
  Description of Artificial Sequence: Synthetic oligonucleotide
  Target: ATXN1; (-) strand; PAM type: NRG; PAM sequence: GAG
atatgttggaggggccagcg

SEQ ID NO: 73373 - DNA, 20 bp, Artificial Sequence
  Description of Artificial Sequence: Synthetic oligonucleotide
  Target: ATXN1; (-) strand; PAM type: NRG; PAM sequence: CGG
ggatatgttggaggggccag

SEQ ID NO: 73374 - DNA, 20 bp, Artificial Sequence
  Description of Artificial Sequence: Synthetic oligonucleotide
  Target: ATXN1; (-) strand; PAM type: NRG; PAM sequence: CAG
atgggatatgttggaggggc

SEQ ID NO: 73375 - DNA, 20 bp, Artificial Sequence
  Description of Artificial Sequence: Synthetic oligonucleotide
  Target: ATXN1; (-) strand; PAM type: NRG; PAM sequence: GGG
ctgcatgggatatgttggag

SEQ ID NO: 73376 - DNA, 20 bp, Artificial Sequence
  Description of Artificial Sequence: Synthetic oligonucleotide
  Target: ATXN1; (-) strand; PAM type: NRG; PAM sequence: GGG
cctgcatgggatatgttgga

SEQ ID NO: 73377 - DNA, 20 bp, Artificial Sequence
  Description of Artificial Sequence: Synthetic oligonucleotide
  Target: ATXN1; (-) strand; PAM type: NRG; PAM sequence: AGG
gcctgcatgggatatgttgg

SEQ ID NO: 73378 - DNA, 20 bp, Artificial Sequence
  Description of Artificial Sequence: Synthetic oligonucleotide
  Target: ATXN1; (-) strand; PAM type: NRG; PAM sequence: GAG
ggcctgcatgggatatgttg

SEQ ID NO: 73379 - DNA, 20 bp, Artificial Sequence
  Description of Artificial Sequence: Synthetic oligonucleotide
  Target: ATXN1; (-) strand; PAM type: NRG; PAM sequence: TGG
atggcctgcatgggatatgt

SEQ ID NO: 73380 - DNA, 20 bp, Artificial Sequence
  Description of Artificial Sequence: Synthetic oligonucleotide
  Target: ATXN1; (-) strand; PAM type: NRG; PAM sequence: GGG
gggacacagatggcctgcat

SEQ ID NO: 73381 - DNA, 20 bp, Artificial Sequence
  Description of Artificial Sequence: Synthetic oligonucleotide
  Target: ATXN1; (-) strand; PAM type: NRG; PAM sequence: TGG
agggacacagatggcctgca

SEQ ID NO: 73382 - DNA, 20 bp, Artificial Sequence
  Description of Artificial Sequence: Synthetic oligonucleotide
  Target: ATXN1; (-) strand; PAM type: NRG; PAM sequence: TGG
gcatgaggaagggacacaga

SEQ ID NO: 73383 - DNA, 20 bp, Artificial Sequence
  Description of Artificial Sequence: Synthetic oligonucleotide
  Target: ATXN1; (-) strand; PAM type: NRG; PAM sequence: CAG
aaaagcatgaggaagggaca

SEQ ID NO: 73384 - DNA, 20 bp, Artificial Sequence
  Description of Artificial Sequence: Synthetic oligonucleotide
  Target: ATXN1; (-) strand; PAM type: NRG; PAM sequence: GGG
agggacaaaagcatgaggaa

SEQ ID NO: 73385 - DNA, 20 bp, Artificial Sequence
  Description of Artificial Sequence: Synthetic oligonucleotide
  Target: ATXN1; (-) strand; PAM type: NRG; PAM sequence: AGG
cagggacaaaagcatgagga

SEQ ID NO: 73386 - DNA, 20 bp, Artificial Sequence
  Description of Artificial Sequence: Synthetic oligonucleotide
  Target: ATXN1; (-) strand; PAM type: NRG; PAM sequence: AAG
gcagggacaaaagcatgagg

SEQ ID NO: 73387 - DNA, 20 bp, Artificial Sequence
  Description of Artificial Sequence: Synthetic oligonucleotide
  Target: ATXN1; (-) strand; PAM type: NRG; PAM sequence: AGG
gcagcagggacaaaagcatg

SEQ ID NO: 73388 - DNA, 20 bp, Artificial Sequence
  Description of Artificial Sequence: Synthetic oligonucleotide
  Target: ATXN1; (-) strand; PAM type: NRG; PAM sequence: GAG
ggcagcagggacaaaagcat

SEQ ID NO: 73389 - DNA, 20 bp, Artificial Sequence
  Description of Artificial Sequence: Synthetic oligonucleotide
  Target: ATXN1; (-) strand; PAM type: NRG; PAM sequence: AAG
cacagtggcagcagggacaa

SEQ ID NO: 73390 - DNA, 20 bp, Artificial Sequence
  Description of Artificial Sequence: Synthetic oligonucleotide
  Target: ATXN1; (-) strand; PAM type: NRG; PAM sequence: GGG
ttgtaggcacagtggcagca

SEQ ID NO: 73391 - DNA, 20 bp, Artificial Sequence
  Description of Artificial Sequence: Synthetic oligonucleotide
  Target: ATXN1; (-) strand; PAM type: NRG; PAM sequence: AGG
attgtaggcacagtggcagc

SEQ ID NO: 73392 - DNA, 20 bp, Artificial Sequence
  Description of Artificial Sequence: Synthetic oligonucleotide
  Target: ATXN1; (-) strand; PAM type: NRG; PAM sequence: CAG
cattgtaggcacagtggcag

SEQ ID NO: 73393 - DNA, 20 bp, Artificial Sequence
  Description of Artificial Sequence: Synthetic oligonucleotide
  Target: ATXN1; (-) strand; PAM type: NRG; PAM sequence: CAG
ggtcattgtaggcacagtgg

SEQ ID NO: 73394 - DNA, 20 bp, Artificial Sequence
  Description of Artificial Sequence: Synthetic oligonucleotide
  Target: ATXN1; (-) strand; PAM type: NRG; PAM sequence: TGG
aggggtcattgtaggcacag

SEQ ID NO: 73395 - DNA, 20 bp, Artificial Sequence
  Description of Artificial Sequence: Synthetic oligonucleotide
  Target: ATXN1; (-) strand; PAM type: NRG; PAM sequence: CAG
ctgaggggtcattgtaggca

SEQ ID NO: 73396 - DNA, 20 bp, Artificial Sequence
  Description of Artificial Sequence: Synthetic oligonucleotide
  Target: ATXN1; (-) strand; PAM type: NRG; PAM sequence: AGG
ggaaactgaggggtcattgt

SEQ ID NO: 73397 - DNA, 20 bp, Artificial Sequence
  Description of Artificial Sequence: Synthetic oligonucleotide
  Target: ATXN1; (-) strand; PAM type: NRG; PAM sequence: TAG
aggaaactgaggggtcattg

SEQ ID NO: 73398 - DNA, 20 bp, Artificial Sequence
  Description of Artificial Sequence: Synthetic oligonucleotide
  Target: ATXN1; (-) strand; PAM type: NRG; PAM sequence: GGG
gatgggtggaggaaactgag

SEQ ID NO: 73399 - DNA, 20 bp, Artificial Sequence
  Description of Artificial Sequence: Synthetic oligonucleotide
  Target: ATXN1; (-) strand; PAM type: NRG; PAM sequence: GGG
tgatgggtggaggaaactga

SEQ ID NO: 73400 - DNA, 20 bp, Artificial Sequence
  Description of Artificial Sequence: Synthetic oligonucleotide
  Target: ATXN1; (-) strand; PAM type: NRG; PAM sequence: AGG
atgatgggtggaggaaactg

SEQ ID NO: 73401 - DNA, 20 bp, Artificial Sequence
  Description of Artificial Sequence: Synthetic oligonucleotide
  Target: ATXN1; (-) strand; PAM type: NRG; PAM sequence: GAG
gatgatgggtggaggaaact

SEQ ID NO: 73402 - DNA, 20 bp, Artificial Sequence
  Description of Artificial Sequence: Synthetic oligonucleotide
  Target: ATXN1; (-) strand; PAM type: NRG; PAM sequence: AGG
tgtgtagtgatgatgggtgg

SEQ ID NO: 73403 - DNA, 20 bp, Artificial Sequence
  Description of Artificial Sequence: Synthetic oligonucleotide
  Target: ATXN1; (-) strand; PAM type: NRG; PAM sequence: GAG
atgtgtagtgatgatgggtg

SEQ ID NO: 73404 - DNA, 20 bp, Artificial Sequence
  Description of Artificial Sequence: Synthetic oligonucleotide
  Target: ATXN1; (-) strand; PAM type: NRG; PAM sequence: TGG
ggatgtgtagtgatgatggg

SEQ ID NO: 73405 - DNA, 20 bp, Artificial Sequence
  Description of Artificial Sequence: Synthetic oligonucleotide
  Target: ATXN1; (-) strand; PAM type: NRG; PAM sequence: GGG
acaggatgtgtagtgatgat

SEQ ID NO: 73406 - DNA, 20 bp, Artificial Sequence
  Description of Artificial Sequence: Synthetic oligonucleotide
  Target: ATXN1; (-) strand; PAM type: NRG; PAM sequence: TGG
aacaggatgtgtagtgatga

SEQ ID NO: 73407 - DNA, 20 bp, Artificial Sequence
  Description of Artificial Sequence: Synthetic oligonucleotide
  Target: ATXN1; (-) strand; PAM type: NRG; PAM sequence: TAG
agggaccttaacaggatgtg

SEQ ID NO: 73408 - DNA, 20 bp, Artificial Sequence
  Description of Artificial Sequence: Synthetic oligonucleotide
  Target: ATXN1; (-) strand; PAM type: NRG; PAM sequence: AGG
agcctgacagggaccttaac

SEQ ID NO: 73409 - DNA, 20 bp, Artificial Sequence
  Description of Artificial Sequence: Synthetic oligonucleotide
  Target: ATXN1; (-) strand; PAM type: NRG; PAM sequence: CAG
aagcctgacagggaccttaa

SEQ ID NO: 73410 - DNA, 20 bp, Artificial Sequence
  Description of Artificial Sequence: Synthetic oligonucleotide
  Target: ATXN1; (-) strand; PAM type: NRG; PAM sequence: GGG
atgagaagcaaagcctgaca

SEQ ID NO: 73411 - DNA, 20 bp, Artificial Sequence
  Description of Artificial Sequence: Synthetic oligonucleotide
  Target: ATXN1; (-) strand; PAM type: NRG; PAM sequence: AGG
tatgagaagcaaagcctgac

SEQ ID NO: 73412 - DNA, 20 bp, Artificial Sequence
  Description of Artificial Sequence: Synthetic oligonucleotide
  Target: ATXN1; (-) strand; PAM type: NRG; PAM sequence: CAG
ctatgagaagcaaagcctga

SEQ ID NO: 73413 - DNA, 20 bp, Artificial Sequence
  Description of Artificial Sequence: Synthetic oligonucleotide
  Target: ATXN1; (-) strand; PAM type: NRG; PAM sequence: AAG
agagcttcctatgagaagca

SEQ ID NO: 73414 - DNA, 20 bp, Artificial Sequence
  Description of Artificial Sequence: Synthetic oligonucleotide
  Target: ATXN1; (-) strand; PAM type: NRG; PAM sequence: AAG
caggaagagcttcctatgag

SEQ ID NO: 73415 - DNA, 20 bp, Artificial Sequence
  Description of Artificial Sequence: Synthetic oligonucleotide
  Target: ATXN1; (-) strand; PAM type: NRG; PAM sequence: GAG
cttcaggaagagcttcctat

SEQ ID NO: 73416 - DNA, 20 bp, Artificial Sequence
  Description of Artificial Sequence: Synthetic oligonucleotide
  Target: ATXN1; (-) strand; PAM type: NRG; PAM sequence: GAG
gggattggagtcttcaggaa

SEQ ID NO: 73417 - DNA, 20 bp, Artificial Sequence
  Description of Artificial Sequence: Synthetic oligonucleotide
  Target: ATXN1; (-) strand; PAM type: NRG; PAM sequence: AAG
tggggattggagtcttcagg

SEQ ID NO: 73418 - DNA, 20 bp, Artificial Sequence
  Description of Artificial Sequence: Synthetic oligonucleotide
  Target: ATXN1; (-) strand; PAM type: NRG; PAM sequence: AGG
ggctggggattggagtcttc

SEQ ID NO: 73419 - DNA, 20 bp, Artificial Sequence
  Description of Artificial Sequence: Synthetic oligonucleotide
  Target: ATXN1; (-) strand; PAM type: NRG; PAM sequence: CAG
tggctggggattggagtctt

SEQ ID NO: 73420 - DNA, 20 bp, Artificial Sequence
  Description of Artificial Sequence: Synthetic oligonucleotide
  Target: ATXN1; (-) strand; PAM type: NRG; PAM sequence: GAG
tgagaaatggctggggattg

SEQ ID NO: 73421 - DNA, 20 bp, Artificial Sequence
  Description of Artificial Sequence: Synthetic oligonucleotide
  Target: ATXN1; (-) strand; PAM type: NRG; PAM sequence: TGG
aatgagaaatggctggggat

SEQ ID NO: 73422 - DNA, 20 bp, Artificial Sequence
  Description of Artificial Sequence: Synthetic oligonucleotide
  Target: ATXN1; (-) strand; PAM type: NRG; PAM sequence: GGG
agaggaatgagaaatggctg

SEQ ID NO: 73423 - DNA, 20 bp, Artificial Sequence
  Description of Artificial Sequence: Synthetic oligonucleotide
  Target: ATXN1; (-) strand; PAM type: NRG; PAM sequence: GGG
aagaggaatgagaaatggct

SEQ ID NO: 73424 - DNA, 20 bp, Artificial Sequence
  Description of Artificial Sequence: Synthetic oligonucleotide
  Target: ATXN1; (-) strand; PAM type: NRG; PAM sequence: TGG
gaagaggaatgagaaatggc

SEQ ID NO: 73425 - DNA, 20 bp, Artificial Sequence
  Description of Artificial Sequence: Synthetic oligonucleotide
  Target: ATXN1; (-) strand; PAM type: NRG; PAM sequence: TGG
ttcagaagaggaatgagaaa

SEQ ID NO: 73426 - DNA, 20 bp, Artificial Sequence
  Description of Artificial Sequence: Synthetic oligonucleotide
  Target: ATXN1; (-) strand; PAM type: NRG; PAM sequence: GAG
gtcaggttcagaagaggaat

SEQ ID NO: 73427 - DNA, 20 bp, Artificial Sequence
  Description of Artificial Sequence: Synthetic oligonucleotide
  Target: ATXN1; (-) strand; PAM type: NRG; PAM sequence: AGG
gccagtgtcaggttcagaag

SEQ ID NO: 73428 - DNA, 20 bp, Artificial Sequence
  Description of Artificial Sequence: Synthetic oligonucleotide
  Target: ATXN1; (-) strand; PAM type: NRG; PAM sequence: GAG
tgccagtgtcaggttcagaa

SEQ ID NO: 73429 - DNA, 20 bp, Artificial Sequence
  Description of Artificial Sequence: Synthetic oligonucleotide
  Target: ATXN1; (-) strand; PAM type: NRG; PAM sequence: AAG
ggtgccagtgtcaggttcag

SEQ ID NO: 73430 - DNA, 20 bp, Artificial Sequence
  Description of Artificial Sequence: Synthetic oligonucleotide
  Target: ATXN1; (-) strand; PAM type: NRG; PAM sequence: CAG
tggggtgccagtgtcaggtt

SEQ ID NO: 73431 - DNA, 20 bp, Artificial Sequence
  Description of Artificial Sequence: Synthetic oligonucleotide
  Target: ATXN1; (-) strand; PAM type: NRG; PAM sequence: AGG
tgtaatggggtgccagtgtc

SEQ ID NO: 73432 - DNA, 20 bp, Artificial Sequence
  Description of Artificial Sequence: Synthetic oligonucleotide
  Target: ATXN1; (-) strand; PAM type: NRG; PAM sequence: CAG
ttgtaatggggtgccagtgt

SEQ ID NO: 73433 - DNA, 20 bp, Artificial Sequence
  Description of Artificial Sequence: Synthetic oligonucleotide
  Target: ATXN1; (-) strand; PAM type: NRG; PAM sequence: CAG
gagaatttgtaatggggtgc

SEQ ID NO: 73434 - DNA, 20 bp, Artificial Sequence
  Description of Artificial Sequence: Synthetic oligonucleotide
  Target: ATXN1; (-) strand; PAM type: NRG; PAM sequence: GGG
acaactgagaatttgtaatg

SEQ ID NO: 73435 - DNA, 20 bp, Artificial Sequence
  Description of Artificial Sequence: Synthetic oligonucleotide
  Target: ATXN1; (-) strand; PAM type: NRG; PAM sequence: GGG
gacaactgagaatttgtaat

SEQ ID NO: 73436 - DNA, 20 bp, Artificial Sequence
  Description of Artificial Sequence: Synthetic oligonucleotide
  Target: ATXN1; (-) strand; PAM type: NRG; PAM sequence: TGG
agacaactgagaatttgtaa

SEQ ID NO: 73437 - DNA, 20 bp, Artificial Sequence
  Description of Artificial Sequence: Synthetic oligonucleotide
  Target: ATXN1; (-) strand; PAM type: NRG; PAM sequence: GAG
atccatgacaacagacaact

SEQ ID NO: 73438 - DNA, 20 bp, Artificial Sequence
  Description of Artificial Sequence: Synthetic oligonucleotide
  Target: ATXN1; (-) strand; PAM type: NRG; PAM sequence: CAG
tatagagcaatccatgacaa

SEQ ID NO: 73439 - DNA, 20 bp, Artificial Sequence
  Description of Artificial Sequence: Synthetic oligonucleotide
  Target: ATXN1; (-) strand; PAM type: NRG; PAM sequence: GAG
atccacaggaagcaattata

SEQ ID NO: 73440 - DNA, 20 bp, Artificial Sequence
  Description of Artificial Sequence: Synthetic oligonucleotide
  Target: ATXN1; (-) strand; PAM type: NRG; PAM sequence: TAG
caatccacaggaagcaatta

SEQ ID NO: 73441 - DNA, 20 bp, Artificial Sequence
  Description of Artificial Sequence: Synthetic oligonucleotide
  Target: ATXN1; (-) strand; PAM type: NRG; PAM sequence: AAG
gcacaataccaatccacagg

SEQ ID NO: 73442 - DNA, 20 bp, Artificial Sequence
  Description of Artificial Sequence: Synthetic oligonucleotide
  Target: ATXN1; (-) strand; PAM type: NRG; PAM sequence: AGG
agggcacaataccaatccac

SEQ ID NO: 73443 - DNA, 20 bp, Artificial Sequence
  Description of Artificial Sequence: Synthetic oligonucleotide
  Target: ATXN1; (-) strand; PAM type: NRG; PAM sequence: CAG
cagggcacaataccaatcca

SEQ ID NO: 73444 - DNA, 20 bp, Artificial Sequence
  Description of Artificial Sequence: Synthetic oligonucleotide
  Target: ATXN1; (-) strand; PAM type: NRG; PAM sequence: GGG
aaaacaaaaaatctagttca

SEQ ID NO: 73445 - DNA, 20 bp, Artificial Sequence
  Description of Artificial Sequence: Synthetic oligonucleotide
  Target: ATXN1; (-) strand; PAM type: NRG; PAM sequence: AGG
caaaacaaaaaatctagttc

SEQ ID NO: 73446 - DNA, 20 bp, Artificial Sequence
  Description of Artificial Sequence: Synthetic oligonucleotide
  Target: ATXN1; (-) strand; PAM type: NRG; PAM sequence: CAG
acaaaacaaaaaatctagtt

SEQ ID NO: 73447 - DNA, 20 bp, Artificial Sequence
  Description of Artificial Sequence: Synthetic oligonucleotide
  Target: ATXN1; (-) strand; PAM type: NRG; PAM sequence: TAG
acaaaacaaaacaaaaaatc

SEQ ID NO: 73448 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtgacagagt

SEQ ID NO: 73449 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggtgaca

SEQ ID NO: 73450 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggtga

SEQ ID NO: 73451 - DNA, 20 bp, Artificial Sequence
  Description of Artificial Sequence: Synthetic oligonucleotide
  Target: ATXN1; (-) strand; PAM type: NRG; PAM sequence: GGG
cggccactgcactccagcct

SEQ ID NO: 73452 - DNA, 20 bp, Artificial Sequence
  Description of Artificial Sequence: Synthetic oligonucleotide
  Target: ATXN1; (-) strand; PAM type: NRG; PAM sequence: TGG
ccggccactgcactccagcc

SEQ ID NO: 73453 - DNA, 20 bp, Artificial Sequence
  Description of Artificial Sequence: Synthetic oligonucleotide
  Target: ATXN1; (-) strand; PAM type: NRG; PAM sequence: CAG
gagatccggccactgcactc

SEQ ID NO: 73454 - DNA, 20 bp, Artificial Sequence
  Description of Artificial Sequence: Synthetic oligonucleotide
  Target: ATXN1; (-) strand; PAM type: NRG; PAM sequence: CGG
ggttgcagtgagctgagatc

SEQ ID NO: 73455 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagct

SEQ ID NO: 73456 - DNA, 20 bp, Artificial Sequence
  Description of Artificial Sequence: Synthetic oligonucleotide
  Target: ATXN1; (-) strand; PAM type: NRG; PAM sequence: GAG
tggaaggcagaggttgcagt

SEQ ID NO: 73457 - DNA, 20 bp, Artificial Sequence
  Description of Artificial Sequence: Synthetic oligonucleotide
  Target: ATXN1; (-) strand; PAM type: NRG; PAM sequence: CAG
aacctggaaggcagaggttg

SEQ ID NO: 73458 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctggaaggcag

SEQ ID NO: 73459 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaacctggaaggca

SEQ ID NO: 73460 - DNA, 20 bp, Artificial Sequence
  Description of Artificial Sequence: Synthetic oligonucleotide
  Target: ATXN1; (-) strand; PAM type: NRG; PAM sequence: CAG
aattgcttgaacctggaagg

SEQ ID NO: 73461 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacctgga

SEQ ID NO: 73462 - DNA, 20 bp, Artificial Sequence
  Description of Artificial Sequence: Synthetic oligonucleotide
  Target: ATXN1; (-) strand; PAM type: NRG; PAM sequence: AAG
agagaattgcttgaacctgg

SEQ ID NO: 73463 - DNA, 20 bp, Artificial Sequence
  Description of Artificial Sequence: Synthetic oligonucleotide
  Target: ATXN1; (-) strand; PAM type: NRG; PAM sequence: TGG
gcaagagaattgcttgaacc

SEQ ID NO: 73464 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcaa

SEQ ID NO: 73465 - DNA, 20 bp, Artificial Sequence
  Description of Artificial Sequence: Synthetic oligonucleotide
  Target: ATXN1; (-) strand; PAM type: NRG; PAM sequence: AAG
gctacttgggaggctgaggc

SEQ ID NO: 73466 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 73467 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 73468 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 73469 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 73470 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagctactt

SEQ ID NO: 73471 - DNA, 20 bp, Artificial Sequence
  Description of Artificial Sequence: Synthetic oligonucleotide
  Target: ATXN1; (-) strand; PAM type: NRG; PAM sequence: TGG
tacctgtaatcccagctact

SEQ ID NO: 73472 - DNA, 20 bp, Artificial Sequence
  Description of Artificial Sequence: Synthetic oligonucleotide
  Target: ATXN1; (-) strand; PAM type: NRG; PAM sequence: CAG
gtggtgtgtacctgtaatcc

SEQ ID NO: 73473 - DNA, 20 bp, Artificial Sequence
  Description of Artificial Sequence: Synthetic oligonucleotide
  Target: ATXN1; (-) strand; PAM type: NRG; PAM sequence: TGG
caaaaattagctaggcatgg

SEQ ID NO: 73474 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagctaggca

SEQ ID NO: 73475 - DNA, 20 bp, Artificial Sequence
  Description of Artificial Sequence: Synthetic oligonucleotide
  Target: ATXN1; (-) strand; PAM type: NRG; PAM sequence: AGG
aaataatacaaaaattagct

SEQ ID NO: 73476 - DNA, 20 bp, Artificial Sequence
  Description of Artificial Sequence: Synthetic oligonucleotide
  Target: ATXN1; (-) strand; PAM type: NRG; PAM sequence: TAG
taaataatacaaaaattagc

SEQ ID NO: 73477 - DNA, 20 bp, Artificial Sequence
  Description of Artificial Sequence: Synthetic oligonucleotide
  Target: ATXN1; (-) strand; PAM type: NRG; PAM sequence: TAG
taaataaataatacaaaaat

SEQ ID NO: 73478 - DNA, 20 bp, Artificial Sequence
  Description of Artificial Sequence: Synthetic oligonucleotide
  Target: ATXN1; (-) strand; PAM type: NRG; PAM sequence: GAG
gccagcctgggcgacagagc

SEQ ID NO: 73479 - DNA, 20 bp, Artificial Sequence
  Description of Artificial Sequence: Synthetic oligonucleotide
  Target: ATXN1; (-) strand; PAM type: NRG; PAM sequence: GAG
gcatgccagcctgggcgaca

SEQ ID NO: 73480 - DNA, 20 bp, Artificial Sequence
  Description of Artificial Sequence: Synthetic oligonucleotide
  Target: ATXN1; (-) strand; PAM type: NRG; PAM sequence: CAG
ctgcatgccagcctgggcga

SEQ ID NO: 73481 - DNA, 20 bp, Artificial Sequence
  Description of Artificial Sequence: Synthetic oligonucleotide
  Target: ATXN1; (-) strand; PAM type: NRG; PAM sequence: GGG
gcgccactgcatgccagcct

SEQ ID NO: 73482 - DNA, 20 bp, Artificial Sequence
  Description of Artificial Sequence: Synthetic oligonucleotide
  Target: ATXN1; (-) strand; PAM type: NRG; PAM sequence: TGG
cgcgccactgcatgccagcc

SEQ ID NO: 73483 - DNA, 20 bp, Artificial Sequence
  Description of Artificial Sequence: Synthetic oligonucleotide
  Target: ATXN1; (-) strand; PAM type: NRG; PAM sequence: CAG
gagatcgcgccactgcatgc

SEQ ID NO: 73484 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagcc

SEQ ID NO: 73485 - DNA, 20 bp, Artificial Sequence
  Description of Artificial Sequence: Synthetic oligonucleotide
  Target: ATXN1; (-) strand; PAM type: NRG; PAM sequence: GAG
ccggaggcagaggttgcagt

SEQ ID NO: 73486 - DNA, 20 bp, Artificial Sequence
  Description of Artificial Sequence: Synthetic oligonucleotide
  Target: ATXN1; (-) strand; PAM type: NRG; PAM sequence: CAG
aaccccggaggcagaggttg

SEQ ID NO: 73487 - DNA, 20 bp, Artificial Sequence
  Description of Artificial Sequence: Synthetic oligonucleotide
  Target: ATXN1; (-) strand; PAM type: NRG; PAM sequence: AGG
cacttgaaccccggaggcag

SEQ ID NO: 73488 - DNA, 20 bp, Artificial Sequence
  Description of Artificial Sequence: Synthetic oligonucleotide
  Target: ATXN1; (-) strand; PAM type: NRG; PAM sequence: GAG
gcacttgaaccccggaggca

SEQ ID NO: 73489 - DNA, 20 bp, Artificial Sequence
  Description of Artificial Sequence: Synthetic oligonucleotide
  Target: ATXN1; (-) strand; PAM type: NRG; PAM sequence: CAG
aagcacttgaaccccggagg

SEQ ID NO: 73490 - DNA, 20 bp, Artificial Sequence
  Description of Artificial Sequence: Synthetic oligonucleotide
  Target: ATXN1; (-) strand; PAM type: NRG; PAM sequence: AGG
gagaagcacttgaaccccgg

SEQ ID NO: 73491 - DNA, 20 bp, Artificial Sequence
  Description of Artificial Sequence: Synthetic oligonucleotide
  Target: ATXN1; (-) strand; PAM type: NRG; PAM sequence: GAG
ggagaagcacttgaaccccg

SEQ ID NO: 73492 - DNA, 20 bp, Artificial Sequence
  Description of Artificial Sequence: Synthetic oligonucleotide
  Target: ATXN1; (-) strand; PAM type: NRG; PAM sequence: CGG
caggagaagcacttgaaccc

SEQ ID NO: 73493 - DNA, 20 bp, Artificial Sequence
  Description of Artificial Sequence: Synthetic oligonucleotide
  Target: ATXN1; (-) strand; PAM type: NRG; PAM sequence: AAG
tcaagaggctgaggcaggag

SEQ ID NO: 73494 - DNA, 20 bp, Artificial Sequence
  Description of Artificial Sequence: Synthetic oligonucleotide
  Target: ATXN1; (-) strand; PAM type: NRG; PAM sequence: GAG
tactcaagaggctgaggcag

SEQ ID NO: 73495 - DNA, 20 bp, Artificial Sequence
  Description of Artificial Sequence: Synthetic oligonucleotide
  Target: ATXN1; (-) strand; PAM type: NRG; PAM sequence: AGG
gctactcaagaggctgaggc

SEQ ID NO: 73496 - DNA, 20 bp, Artificial Sequence
  Description of Artificial Sequence: Synthetic oligonucleotide
  Target: ATXN1; (-) strand; PAM type: NRG; PAM sequence: CAG
agctactcaagaggctgagg

SEQ ID NO: 73497 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaagaggctg

SEQ ID NO: 73498 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaagaggct

SEQ ID NO: 73499 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctactcaag

SEQ ID NO: 73500 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctactcaa

SEQ ID NO: 73501 - DNA, 20 bp, Artificial Sequence
  Description of Artificial Sequence: Synthetic oligonucleotide
  Target: ATXN1; (-) strand; PAM type: NRG; PAM sequence: AAG
gcctgtaatcccagctactc

SEQ ID NO: 73502 - DNA, 20 bp, Artificial Sequence
  Description of Artificial Sequence: Synthetic oligonucleotide
  Target: ATXN1; (-) strand; PAM type: NRG; PAM sequence: CAG
gtggcgcatgcctgtaatcc

SEQ ID NO: 73503 - DNA, 20 bp, Artificial Sequence
  Description of Artificial Sequence: Synthetic oligonucleotide
  Target: ATXN1; (-) strand; PAM type: NRG; PAM sequence: TGG
ataaaattagctgggcatgg

SEQ ID NO: 73504 - DNA, 20 bp, Artificial Sequence
  Description of Artificial Sequence: Synthetic oligonucleotide
  Target: ATXN1; (-) strand; PAM type: NRG; PAM sequence: TGG
caaataaaattagctgggca

SEQ ID NO: 73505 - DNA, 20 bp, Artificial Sequence
  Description of Artificial Sequence: Synthetic oligonucleotide
  Target: ATXN1; (-) strand; PAM type: NRG; PAM sequence: GGG
aaatacaaataaaattagct

SEQ ID NO: 73506 - DNA, 20 bp, Artificial Sequence
  Description of Artificial Sequence: Synthetic oligonucleotide
  Target: ATXN1; (-) strand; PAM type: NRG; PAM sequence: TGG
aaaatacaaataaaattagc

SEQ ID NO: 73507 - DNA, 20 bp, Artificial Sequence
  Description of Artificial Sequence: Synthetic oligonucleotide
  Target: ATXN1; (-) strand; PAM type: NRG; PAM sequence: TAG
actaaaaatacaaataaaat

SEQ ID NO: 73508 - DNA, 20 bp, Artificial Sequence
  Description of Artificial Sequence: Synthetic oligonucleotide
  Target: ATXN1; (-) strand; PAM type: NRG; PAM sequence: GAG
agaccaccctgagcaacatg

SEQ ID NO: 73509 - DNA, 20 bp, Artificial Sequence
  Description of Artificial Sequence: Synthetic oligonucleotide
  Target: ATXN1; (-) strand; PAM type: NRG; PAM sequence: TGG
cgagaccaccctgagcaaca

SEQ ID NO: 73510 - DNA, 20 bp, Artificial Sequence
  Description of Artificial Sequence: Synthetic oligonucleotide
  Target: ATXN1; (-) strand; PAM type: NRG; PAM sequence: GAG
cgggagttcgagaccaccct

SEQ ID NO: 73511 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcgggagttc

SEQ ID NO: 73512 - DNA, 20 bp, Artificial Sequence
  Description of Artificial Sequence: Synthetic oligonucleotide
  Target: ATXN1; (-) strand; PAM type: NRG; PAM sequence: GAG
ggcggatcacctgaggtcgg

SEQ ID NO: 73513 - DNA, 20 bp, Artificial Sequence
  Description of Artificial Sequence: Synthetic oligonucleotide
  Target: ATXN1; (-) strand; PAM type: NRG; PAM sequence: GGG
cgggcggatcacctgaggtc

SEQ ID NO: 73514 - DNA, 20 bp, Artificial Sequence
  Description of Artificial Sequence: Synthetic oligonucleotide
  Target: ATXN1; (-) strand; PAM type: NRG; PAM sequence: CGG
gcgggcggatcacctgaggt

SEQ ID NO: 73515 - DNA, 20 bp, Artificial Sequence
  Description of Artificial Sequence: Synthetic oligonucleotide
  Target: ATXN1; (-) strand; PAM type: NRG; PAM sequence: AGG
cgaggcgggcggatcacctg

SEQ ID NO: 73516 - DNA, 20 bp, Artificial Sequence
  Description of Artificial Sequence: Synthetic oligonucleotide
  Target: ATXN1; (-) strand; PAM type: NRG; PAM sequence: GAG
ccgaggcgggcggatcacct

SEQ ID NO: 73517 - DNA, 20 bp, Artificial Sequence
  Description of Artificial Sequence: Synthetic oligonucleotide
  Target: ATXN1; (-) strand; PAM type: NRG; PAM sequence: CGG
ctttgggaggccgaggcggg

SEQ ID NO: 73518 - DNA, 20 bp, Artificial Sequence
  Description of Artificial Sequence: Synthetic oligonucleotide
  Target: ATXN1; (-) strand; PAM type: NRG; PAM sequence: GGG
acactttgggaggccgaggc

SEQ ID NO: 73519 - DNA, 20 bp, Artificial Sequence
  Description of Artificial Sequence: Synthetic oligonucleotide
  Target: ATXN1; (-) strand; PAM type: NRG; PAM sequence: CGG
aacactttgggaggccgagg

SEQ ID NO: 73520 - DNA, 20 bp, Artificial Sequence
  Description of Artificial Sequence: Synthetic oligonucleotide
  Target: ATXN1; (-) strand; PAM type: NRG; PAM sequence: AGG
cccaacactttgggaggccg

SEQ ID NO: 73521 - DNA, 20 bp, Artificial Sequence
  Description of Artificial Sequence: Synthetic oligonucleotide
  Target: ATXN1; (-) strand; PAM type: NRG; PAM sequence: GAG
tcccaacactttgggaggcc

SEQ ID NO: 73522 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccaacactttggg

SEQ ID NO: 73523 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccaacactttgg

SEQ ID NO: 73524 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccaacacttt

SEQ ID NO: 73525 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccaacactt

SEQ ID NO: 73526 - DNA, 20 bp, Artificial Sequence
  Description of Artificial Sequence: Synthetic oligonucleotide
  Target: ATXN1; (-) strand; PAM type: NRG; PAM sequence: TGG
aaaaattaggccgggtgcgg

SEQ ID NO: 73527 - DNA, 20 bp, Artificial Sequence
  Description of Artificial Sequence: Synthetic oligonucleotide
  Target: ATXN1; (-) strand; PAM type: NRG; PAM sequence: CGG
tacaaaaattaggccgggtg

SEQ ID NO: 73528 - DNA, 20 bp, Artificial Sequence
  Description of Artificial Sequence: Synthetic oligonucleotide
  Target: ATXN1; (-) strand; PAM type: NRG; PAM sequence: GGG
gaaaatacaaaaattaggcc

SEQ ID NO: 73529 - DNA, 20 bp, Artificial Sequence
  Description of Artificial Sequence: Synthetic oligonucleotide
  Target: ATXN1; (-) strand; PAM type: NRG; PAM sequence: CGG
tgaaaatacaaaaattaggc

SEQ ID NO: 73530 - DNA, 20 bp, Artificial Sequence
  Description of Artificial Sequence: Synthetic oligonucleotide
  Target: ATXN1; (-) strand; PAM type: NRG; PAM sequence: AGG
ctactgaaaatacaaaaatt

SEQ ID NO: 73531 - DNA, 20 bp, Artificial Sequence
  Description of Artificial Sequence: Synthetic oligonucleotide
  Target: ATXN1; (-) strand; PAM type: NRG; PAM sequence: TAG
tctactgaaaatacaaaaat

SEQ ID NO: 73532 - DNA, 20 bp, Artificial Sequence
  Description of Artificial Sequence: Synthetic oligonucleotide
  Target: ATXN1; (-) strand; PAM type: NRG; PAM sequence: TGG
cgagaccagactggccaaca

SEQ ID NO: 73533 - DNA, 20 bp, Artificial Sequence
  Description of Artificial Sequence: Synthetic oligonucleotide
  Target: ATXN1; (-) strand; PAM type: NRG; PAM sequence: TGG
tcaggagatcgagaccagac

SEQ ID NO: 73534 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagatcgagac

SEQ ID NO: 73535 - DNA, 20 bp, Artificial Sequence
  Description of Artificial Sequence: Synthetic oligonucleotide
  Target: ATXN1; (-) strand; PAM type: NRG; PAM sequence: GAG
tcacttgaggtcaggagatc

SEQ ID NO: 73536 - DNA, 20 bp, Artificial Sequence
  Description of Artificial Sequence: Synthetic oligonucleotide
  Target: ATXN1; (-) strand; PAM type: NRG; PAM sequence: GAG
ggcagatcacttgaggtcag

SEQ ID NO: 73537 - DNA, 20 bp, Artificial Sequence
  Description of Artificial Sequence: Synthetic oligonucleotide
  Target: ATXN1; (-) strand; PAM type: NRG; PAM sequence: AGG
tgggcagatcacttgaggtc

SEQ ID NO: 73538 - DNA, 20 bp, Artificial Sequence
  Description of Artificial Sequence: Synthetic oligonucleotide
  Target: ATXN1; (-) strand; PAM type: NRG; PAM sequence: CAG
gtgggcagatcacttgaggt

SEQ ID NO: 73539 - DNA, 20 bp, Artificial Sequence
  Description of Artificial Sequence: Synthetic oligonucleotide
  Target: ATXN1; (-) strand; PAM type: NRG; PAM sequence: AGG
cgaggtgggcagatcacttg

SEQ ID NO: 73540 - DNA, 20 bp, Artificial Sequence
  Description of Artificial Sequence: Synthetic oligonucleotide
  Target: ATXN1; (-) strand; PAM type: NRG; PAM sequence: GAG
ccgaggtgggcagatcactt

SEQ ID NO: 73541 - DNA, 20 bp, Artificial Sequence
  Description of Artificial Sequence: Synthetic oligonucleotide
  Target: ATXN1; (-) strand; PAM type: NRG; PAM sequence: CAG
cttaggtaggccgaggtggg

SEQ ID NO: 73542 - DNA, 20 bp, Artificial Sequence
  Description of Artificial Sequence: Synthetic oligonucleotide
  Target: ATXN1; (-) strand; PAM type: NRG; PAM sequence: GGG
acacttaggtaggccgaggt

SEQ ID NO: 73543 - DNA, 20 bp, Artificial Sequence
  Description of Artificial Sequence: Synthetic oligonucleotide
  Target: ATXN1; (-) strand; PAM type: NRG; PAM sequence: TGG
gacacttaggtaggccgagg

SEQ ID NO: 73544 - DNA, 20 bp, Artificial Sequence
  Description of Artificial Sequence: Synthetic oligonucleotide
  Target: ATXN1; (-) strand; PAM type: NRG; PAM sequence: AGG
gttgacacttaggtaggccg

SEQ ID NO: 73545 - DNA, 20 bp, Artificial Sequence
  Description of Artificial Sequence: Synthetic oligonucleotide
  Target: ATXN1; (-) strand; PAM type: NRG; PAM sequence: GAG
agttgacacttaggtaggcc

SEQ ID NO: 73546 - DNA, 20 bp, Artificial Sequence
  Description of Artificial Sequence: Synthetic oligonucleotide
  Target: ATXN1; (-) strand; PAM type: NRG; PAM sequence: AGG
aacctagttgacacttaggt

SEQ ID NO: 73547 - DNA, 20 bp, Artificial Sequence
  Description of Artificial Sequence: Synthetic oligonucleotide
  Target: ATXN1; (-) strand; PAM type: NRG; PAM sequence: TAG
aaacctagttgacacttagg

SEQ ID NO: 73548 - DNA, 20 bp, Artificial Sequence
  Description of Artificial Sequence: Synthetic oligonucleotide
  Target: ATXN1; (-) strand; PAM type: NRG; PAM sequence: AGG
aaaaaacctagttgacactt

SEQ ID NO: 73549 - DNA, 20 bp, Artificial Sequence
  Description of Artificial Sequence: Synthetic oligonucleotide
  Target: ATXN1; (-) strand; PAM type: NRG; PAM sequence: TAG
aaaaaaacctagttgacact

SEQ ID NO: 73550 - DNA, 20 bp, Artificial Sequence
  Description of Artificial Sequence: Synthetic oligonucleotide
  Target: ATXN1; (-) strand; PAM type: NRG; PAM sequence: TAG
aaattatcttcaaaaaaacc

SEQ ID NO: 73551 - DNA, 20 bp, Artificial Sequence
  Description of Artificial Sequence: Synthetic oligonucleotide
  Target: ATXN1; (-) strand; PAM type: NRG; PAM sequence: GAG
actgggtggaaggtacaagg

SEQ ID NO: 73552 - DNA, 20 bp, Artificial Sequence
  Description of Artificial Sequence: Synthetic oligonucleotide
  Target: ATXN1; (-) strand; PAM type: NRG; PAM sequence: GGG
aaactgggtggaaggtacaa

SEQ ID NO: 73553 - DNA, 20 bp, Artificial Sequence
  Description of Artificial Sequence: Synthetic oligonucleotide
  Target: ATXN1; (-) strand; PAM type: NRG; PAM sequence: AGG
gaaactgggtggaaggtaca

SEQ ID NO: 73554 - DNA, 20 bp, Artificial Sequence
  Description of Artificial Sequence: Synthetic oligonucleotide
  Target: ATXN1; (-) strand; PAM type: NRG; PAM sequence: AAG
ggaaactgggtggaaggtac

SEQ ID NO: 73555 - DNA, 20 bp, Artificial Sequence
  Description of Artificial Sequence: Synthetic oligonucleotide
  Target: ATXN1; (-) strand; PAM type: NRG; PAM sequence: AGG
atagggggaaactgggtgga

SEQ ID NO: 73556 - DNA, 20 bp, Artificial Sequence
  Description of Artificial Sequence: Synthetic oligonucleotide
  Target: ATXN1; (-) strand; PAM type: NRG; PAM sequence: AAG
tatagggggaaactgggtgg

SEQ ID NO: 73557 - DNA, 20 bp, Artificial Sequence
  Description of Artificial Sequence: Synthetic oligonucleotide
  Target: ATXN1; (-) strand; PAM type: NRG; PAM sequence: TGG
taatatagggggaaactggg

SEQ ID NO: 73558 - DNA, 20 bp, Artificial Sequence
  Description of Artificial Sequence: Synthetic oligonucleotide
  Target: ATXN1; (-) strand; PAM type: NRG; PAM sequence: GGG
tgttaatatagggggaaact

SEQ ID NO: 73559 - DNA, 20 bp, Artificial Sequence
  Description of Artificial Sequence: Synthetic oligonucleotide
  Target: ATXN1; (-) strand; PAM type: NRG; PAM sequence: TGG
ctgttaatatagggggaaac

SEQ ID NO: 73560 - DNA, 20 bp, Artificial Sequence
  Description of Artificial Sequence: Synthetic oligonucleotide
  Target: ATXN1; (-) strand; PAM type: NRG; PAM sequence: GGG
ttgtaagctgttaatatagg

SEQ ID NO: 73561 - DNA, 20 bp, Artificial Sequence
  Description of Artificial Sequence: Synthetic oligonucleotide
  Target: ATXN1; (-) strand; PAM type: NRG; PAM sequence: GGG
tttgtaagctgttaatatag

SEQ ID NO: 73562 - DNA, 20 bp, Artificial Sequence
  Description of Artificial Sequence: Synthetic oligonucleotide
  Target: ATXN1; (-) strand; PAM type: NRG; PAM sequence: GGG
ctttgtaagctgttaatata

SEQ ID NO: 73563 - DNA, 20 bp, Artificial Sequence
  Description of Artificial Sequence: Synthetic oligonucleotide
  Target: ATXN1; (-) strand; PAM type: NRG; PAM sequence: AGG
gctttgtaagctgttaatat

SEQ ID NO: 73564 - DNA, 20 bp, Artificial Sequence
  Description of Artificial Sequence: Synthetic oligonucleotide
  Target: ATXN1; (-) strand; PAM type: NRG; PAM sequence: TAG
ggctttgtaagctgttaata

SEQ ID NO: 73565 - DNA, 20 bp, Artificial Sequence
  Description of Artificial Sequence: Synthetic oligonucleotide
  Target: ATXN1; (-) strand; PAM type: NRG; PAM sequence: AAG
tcgtggttctatggctttgt

SEQ ID NO: 73566 - DNA, 20 bp, Artificial Sequence
  Description of Artificial Sequence: Synthetic oligonucleotide
  Target: ATXN1; (-) strand; PAM type: NRG; PAM sequence: TGG
tagttttgatcgtggttcta

SEQ ID NO: 73567 - DNA, 20 bp, Artificial Sequence
  Description of Artificial Sequence: Synthetic oligonucleotide
  Target: ATXN1; (-) strand; PAM type: NRG; PAM sequence: TGG
taactttctagttttgatcg

SEQ ID NO: 73568 - DNA, 20 bp, Artificial Sequence
  Description of Artificial Sequence: Synthetic oligonucleotide
  Target: ATXN1; (-) strand; PAM type: NRG; PAM sequence: TAG
cgtgacccaggttaactttc

SEQ ID NO: 73569 - DNA, 20 bp, Artificial Sequence
  Description of Artificial Sequence: Synthetic oligonucleotide
  Target: ATXN1; (-) strand; PAM type: NRG; PAM sequence: AGG
ttgttgagtagtcgtgaccc

SEQ ID NO: 73570 - DNA, 20 bp, Artificial Sequence
  Description of Artificial Sequence: Synthetic oligonucleotide
  Target: ATXN1; (-) strand; PAM type: NRG; PAM sequence: CAG
tttgttgagtagtcgtgacc

SEQ ID NO: 73571 - DNA, 20 bp, Artificial Sequence
  Description of Artificial Sequence: Synthetic oligonucleotide
  Target: ATXN1; (-) strand; PAM type: NRG; PAM sequence: TAG
acaccctacggtttgttgag

SEQ ID NO: 73572 - DNA, 20 bp, Artificial Sequence
  Description of Artificial Sequence: Synthetic oligonucleotide
  Target: ATXN1; (-) strand; PAM type: NRG; PAM sequence: GAG
aatacaccctacggtttgtt

SEQ ID NO: 73573 - DNA, 20 bp, Artificial Sequence
  Description of Artificial Sequence: Synthetic oligonucleotide
  Target: ATXN1; (-) strand; PAM type: NRG; PAM sequence: CGG
tgaaatcctaatacacccta

SEQ ID NO: 73574 - DNA, 20 bp, Artificial Sequence
  Description of Artificial Sequence: Synthetic oligonucleotide
  Target: ATXN1; (-) strand; PAM type: NRG; PAM sequence: TGG
agcctgtttggtgcaaaaac

SEQ ID NO: 73575 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaaaaaagcctgtt

SEQ ID NO: 73576 - DNA, 20 bp, Artificial Sequence
  Description of Artificial Sequence: Synthetic oligonucleotide
  Target: ATXN1; (-) strand; PAM type: NRG; PAM sequence: AAG
aaacaggaaaaaaaaaaaaa

SEQ ID NO: 73577 - DNA, 20 bp, Artificial Sequence
  Description of Artificial Sequence: Synthetic oligonucleotide
  Target: ATXN1; (-) strand; PAM type: NRG; PAM sequence: AGG
tctaagtatgatcctgaaac

SEQ ID NO: 73578 - DNA, 20 bp, Artificial Sequence
  Description of Artificial Sequence: Synthetic oligonucleotide
  Target: ATXN1; (-) strand; PAM type: NRG; PAM sequence: CAG
ttctaagtatgatcctgaaa

SEQ ID NO: 73579 - DNA, 20 bp, Artificial Sequence
  Description of Artificial Sequence: Synthetic oligonucleotide
  Target: ATXN1; (-) strand; PAM type: NRG; PAM sequence: AAG
atatgaccacataaaattct

SEQ ID NO: 73580 - DNA, 20 bp, Artificial Sequence
  Description of Artificial Sequence: Synthetic oligonucleotide
  Target: ATXN1; (-) strand; PAM type: NRG; PAM sequence: AAG
gtcacagattagcagaaact

SEQ ID NO: 73581 - DNA, 20 bp, Artificial Sequence
  Description of Artificial Sequence: Synthetic oligonucleotide
  Target: ATXN1; (-) strand; PAM type: NRG; PAM sequence: CAG
caggaactgtcacagattag

SEQ ID NO: 73582 - DNA, 20 bp, Artificial Sequence
  Description of Artificial Sequence: Synthetic oligonucleotide
  Target: ATXN1; (-) strand; PAM type: NRG; PAM sequence: TAG
attcaggaactgtcacagat

SEQ ID NO: 73583 - DNA, 20 bp, Artificial Sequence
  Description of Artificial Sequence: Synthetic oligonucleotide
  Target: ATXN1; (-) strand; PAM type: NRG; PAM sequence: CAG
gaaggattcaggaactgtca

SEQ ID NO: 73584 - DNA, 20 bp, Artificial Sequence
  Description of Artificial Sequence: Synthetic oligonucleotide
  Target: ATXN1; (-) strand; PAM type: NRG; PAM sequence: AGG
ttaaggataaggaaggattc

SEQ ID NO: 73585 - DNA, 20 bp, Artificial Sequence
  Description of Artificial Sequence: Synthetic oligonucleotide
  Target: ATXN1; (-) strand; PAM type: NRG; PAM sequence: CAG
tttaaggataaggaaggatt

SEQ ID NO: 73586 - DNA, 20 bp, Artificial Sequence
  Description of Artificial Sequence: Synthetic oligonucleotide
  Target: ATXN1; (-) strand; PAM type: NRG; PAM sequence: AGG
aaggtctttaaggataagga

SEQ ID NO: 73587 - DNA, 20 bp, Artificial Sequence
  Description of Artificial Sequence: Synthetic oligonucleotide
  Target: ATXN1; (-) strand; PAM type: NRG; PAM sequence: AAG
caaggtctttaaggataagg

SEQ ID NO: 73588 - DNA, 20 bp, Artificial Sequence
  Description of Artificial Sequence: Synthetic oligonucleotide
  Target: ATXN1; (-) strand; PAM type: NRG; PAM sequence: AGG
tgtcaaggtctttaaggata

SEQ ID NO: 73589 - DNA, 20 bp, Artificial Sequence
  Description of Artificial Sequence: Synthetic oligonucleotide
  Target: ATXN1; (-) strand; PAM type: NRG; PAM sequence: AAG
ttgtcaaggtctttaaggat

SEQ ID NO: 73590 - DNA, 20 bp, Artificial Sequence
  Description of Artificial Sequence: Synthetic oligonucleotide
  Target: ATXN1; (-) strand; PAM type: NRG; PAM sequence: AGG
taaaattgtcaaggtcttta

SEQ ID NO: 73591 - DNA, 20 bp, Artificial Sequence
  Description of Artificial Sequence: Synthetic oligonucleotide
  Target: ATXN1; (-) strand; PAM type: NRG; PAM sequence: AAG
ttaaaattgtcaaggtcttt

SEQ ID NO: 73592 - DNA, 20 bp, Artificial Sequence
  Description of Artificial Sequence: Synthetic oligonucleotide
  Target: ATXN1; (-) strand; PAM type: NRG; PAM sequence: AGG
ccctccccttaaaattgtca

SEQ ID NO: 73593 - DNA, 20 bp, Artificial Sequence
  Description of Artificial Sequence: Synthetic oligonucleotide
  Target: ATXN1; (-) strand; PAM type: NRG; PAM sequence: AAG
cccctccccttaaaattgtc

SEQ ID NO: 73594 - DNA, 20 bp, Artificial Sequence
  Description of Artificial Sequence: Synthetic oligonucleotide
  Target: ATXN1; (-) strand; PAM type: NRG; PAM sequence: AGG
aaatagcaaactcaaatgga

SEQ ID NO: 73595 - DNA, 20 bp, Artificial Sequence
  Description of Artificial Sequence: Synthetic oligonucleotide
  Target: ATXN1; (-) strand; PAM type: NRG; PAM sequence: AAG
aaaatagcaaactcaaatgg

SEQ ID NO: 73596 - DNA, 20 bp, Artificial Sequence
  Description of Artificial Sequence: Synthetic oligonucleotide
  Target: ATXN1; (-) strand; PAM type: NRG; PAM sequence: TGG
aaaaaaatagcaaactcaaa

SEQ ID NO: 73597 - DNA, 20 bp, Artificial Sequence
  Description of Artificial Sequence: Synthetic oligonucleotide
  Target: ATXN1; (-) strand; PAM type: NRG; PAM sequence: TAG
cactctaatcaagaaaaaaa

SEQ ID NO: 73598 - DNA, 20 bp, Artificial Sequence
  Description of Artificial Sequence: Synthetic oligonucleotide
  Target: ATXN1; (-) strand; PAM type: NRG; PAM sequence: AAG
ggcataatctcactctaatc

SEQ ID NO: 73599 - DNA, 20 bp, Artificial Sequence
  Description of Artificial Sequence: Synthetic oligonucleotide
  Target: ATXN1; (-) strand; PAM type: NRG; PAM sequence: AGG
ctctgatatcctccctgaaa

SEQ ID NO: 73600 - DNA, 20 bp, Artificial Sequence
  Description of Artificial Sequence: Synthetic oligonucleotide
  Target: ATXN1; (-) strand; PAM type: NRG; PAM sequence: AAG
tctctgatatcctccctgaa

SEQ ID NO: 73601 - DNA, 20 bp, Artificial Sequence
  Description of Artificial Sequence: Synthetic oligonucleotide
  Target: ATXN1; (-) strand; PAM type: NRG; PAM sequence: GGG
atcgtgtgtcccactgagaa

SEQ ID NO: 73602 - DNA, 20 bp, Artificial Sequence
  Description of Artificial Sequence: Synthetic oligonucleotide
  Target: ATXN1; (-) strand; PAM type: NRG; PAM sequence: AGG
catcgtgtgtcccactgaga

SEQ ID NO: 73603 - DNA, 20 bp, Artificial Sequence
  Description of Artificial Sequence: Synthetic oligonucleotide
  Target: ATXN1; (-) strand; PAM type: NRG; PAM sequence: AAG
acatcgtgtgtcccactgag

SEQ ID NO: 73604 - DNA, 20 bp, Artificial Sequence
  Description of Artificial Sequence: Synthetic oligonucleotide
  Target: ATXN1; (-) strand; PAM type: NRG; PAM sequence: GAG
ttgacatcgtgtgtcccact

SEQ ID NO: 73605 - DNA, 20 bp, Artificial Sequence
  Description of Artificial Sequence: Synthetic oligonucleotide
  Target: ATXN1; (-) strand; PAM type: NRG; PAM sequence: CAG
gtgatcaaggttaatgtcac

SEQ ID NO: 73606 - DNA, 20 bp, Artificial Sequence
  Description of Artificial Sequence: Synthetic oligonucleotide
  Target: ATXN1; (-) strand; PAM type: NRG; PAM sequence: AGG
tcaccttaactgagtgatca

SEQ ID NO: 73607 - DNA, 20 bp, Artificial Sequence
  Description of Artificial Sequence: Synthetic oligonucleotide
  Target: ATXN1; (-) strand; PAM type: NRG; PAM sequence: AAG
atcaccttaactgagtgatc

SEQ ID NO: 73608 - DNA, 20 bp, Artificial Sequence
  Description of Artificial Sequence: Synthetic oligonucleotide
  Target: ATXN1; (-) strand; PAM type: NRG; PAM sequence: GAG
tggcagacatcaccttaact

SEQ ID NO: 73609 - DNA, 20 bp, Artificial Sequence
  Description of Artificial Sequence: Synthetic oligonucleotide
  Target: ATXN1; (-) strand; PAM type: NRG; PAM sequence: CAG
tttacggtgaagaatcctgg

SEQ ID NO: 73610 - DNA, 20 bp, Artificial Sequence
  Description of Artificial Sequence: Synthetic oligonucleotide
  Target: ATXN1; (-) strand; PAM type: NRG; PAM sequence: TGG
aagtttacggtgaagaatcc

SEQ ID NO: 73611 - DNA, 20 bp, Artificial Sequence
  Description of Artificial Sequence: Synthetic oligonucleotide
  Target: ATXN1; (-) strand; PAM type: NRG; PAM sequence: AAG
aaaaataaaagtttacggtg

SEQ ID NO: 73612 - DNA, 20 bp, Artificial Sequence
  Description of Artificial Sequence: Synthetic oligonucleotide
  Target: ATXN1; (-) strand; PAM type: NRG; PAM sequence: CGG
aggagaaaaataaaagttta

SEQ ID NO: 73613 - DNA, 20 bp, Artificial Sequence
  Description of Artificial Sequence: Synthetic oligonucleotide
  Target: ATXN1; (-) strand; PAM type: NRG; PAM sequence: AAG
aattacaaggagaaaaataa

SEQ ID NO: 73614 - DNA, 20 bp, Artificial Sequence
  Description of Artificial Sequence: Synthetic oligonucleotide
  Target: ATXN1; (-) strand; PAM type: NRG; PAM sequence: GAG
aaacatttagtaattacaag

SEQ ID NO: 73615 - DNA, 20 bp, Artificial Sequence
  Description of Artificial Sequence: Synthetic oligonucleotide
  Target: ATXN1; (-) strand; PAM type: NRG; PAM sequence: AGG
ccaaacatttagtaattaca

SEQ ID NO: 73616 - DNA, 20 bp, Artificial Sequence
  Description of Artificial Sequence: Synthetic oligonucleotide
  Target: ATXN1; (-) strand; PAM type: NRG; PAM sequence: AAG
cccaaacatttagtaattac

SEQ ID NO: 73617 - DNA, 20 bp, Artificial Sequence
  Description of Artificial Sequence: Synthetic oligonucleotide
  Target: ATXN1; (-) strand; PAM type: NRG; PAM sequence: TAG
atatccctaccccaaacatt

SEQ ID NO: 73618 - DNA, 20 bp, Artificial Sequence
  Description of Artificial Sequence: Synthetic oligonucleotide
  Target: ATXN1; (-) strand; PAM type: NRG; PAM sequence: TAG
atgcagaaacaggaaattcg

SEQ ID NO: 73619 - DNA, 20 bp, Artificial Sequence
  Description of Artificial Sequence: Synthetic oligonucleotide
  Target: ATXN1; (-) strand; PAM type: NRG; PAM sequence: AGG
gcaaaagtatatgcagaaac

SEQ ID NO: 73620 - DNA, 20 bp, Artificial Sequence
  Description of Artificial Sequence: Synthetic oligonucleotide
  Target: ATXN1; (-) strand; PAM type: NRG; PAM sequence: CAG
ggcaaaagtatatgcagaaa

SEQ ID NO: 73621 - DNA, 20 bp, Artificial Sequence
  Description of Artificial Sequence: Synthetic oligonucleotide
  Target: ATXN1; (-) strand; PAM type: NRG; PAM sequence: CAG
tgagcgggcaaaagtatatg

SEQ ID NO: 73622 - DNA, 20 bp, Artificial Sequence
  Description of Artificial Sequence: Synthetic oligonucleotide
  Target: ATXN1; (-) strand; PAM type: NRG; PAM sequence: AAG
ggattagaatgagcgggcaa

SEQ ID NO: 73623 - DNA, 20 bp, Artificial Sequence
  Description of Artificial Sequence: Synthetic oligonucleotide
  Target: ATXN1; (-) strand; PAM type: NRG; PAM sequence: GGG
ttagatggattagaatgagc

SEQ ID NO: 73624 - DNA, 20 bp, Artificial Sequence
  Description of Artificial Sequence: Synthetic oligonucleotide
  Target: ATXN1; (-) strand; PAM type: NRG; PAM sequence: CGG
attagatggattagaatgag

SEQ ID NO: 73625 - DNA, 20 bp, Artificial Sequence
  Description of Artificial Sequence: Synthetic oligonucleotide
  Target: ATXN1; (-) strand; PAM type: NRG; PAM sequence: GAG
tggattagatggattagaat

SEQ ID NO: 73626 - DNA, 20 bp, Artificial Sequence
  Description of Artificial Sequence: Synthetic oligonucleotide
  Target: ATXN1; (-) strand; PAM type: NRG; PAM sequence: TAG
cagatgtggattagatggat

SEQ ID NO: 73627 - DNA, 20 bp, Artificial Sequence
  Description of Artificial Sequence: Synthetic oligonucleotide
  Target: ATXN1; (-) strand; PAM type: NRG; PAM sequence: TGG
atgggcagatgtggattaga

SEQ ID NO: 73628 - DNA, 20 bp, Artificial Sequence
  Description of Artificial Sequence: Synthetic oligonucleotide
  Target: ATXN1; (-) strand; PAM type: NRG; PAM sequence: TAG
ttagatgggcagatgtggat

SEQ ID NO: 73629 - DNA, 20 bp, Artificial Sequence
  Description of Artificial Sequence: Synthetic oligonucleotide
  Target: ATXN1; (-) strand; PAM type: NRG; PAM sequence: TGG
atgcattagatgggcagatg

SEQ ID NO: 73630 - DNA, 20 bp, Artificial Sequence
  Description of Artificial Sequence: Synthetic oligonucleotide
  Target: ATXN1; (-) strand; PAM type: NRG; PAM sequence: CAG
cgatggatgcattagatggg

SEQ ID NO: 73631 - DNA, 20 bp, Artificial Sequence
  Description of Artificial Sequence: Synthetic oligonucleotide
  Target: ATXN1; (-) strand; PAM type: NRG; PAM sequence: GGG
caccgatggatgcattagat

SEQ ID NO: 73632 - DNA, 20 bp, Artificial Sequence
  Description of Artificial Sequence: Synthetic oligonucleotide
  Target: ATXN1; (-) strand; PAM type: NRG; PAM sequence: TGG
ccaccgatggatgcattaga

SEQ ID NO: 73633 - DNA, 20 bp, Artificial Sequence
  Description of Artificial Sequence: Synthetic oligonucleotide
  Target: ATXN1; (-) strand; PAM type: NRG; PAM sequence: TAG
agtcccaccgatggatgcat

SEQ ID NO: 73634 - DNA, 20 bp, Artificial Sequence
  Description of Artificial Sequence: Synthetic oligonucleotide
  Target: ATXN1; (-) strand; PAM type: NRG; PAM sequence: TGG
ccacgagaaagtcccaccga

SEQ ID NO: 73635 - DNA, 20 bp, Artificial Sequence
  Description of Artificial Sequence: Synthetic oligonucleotide
  Target: ATXN1; (-) strand; PAM type: NRG; PAM sequence: AAG
tagtaagaattgccacgaga

SEQ ID NO: 73636 - DNA, 20 bp, Artificial Sequence
  Description of Artificial Sequence: Synthetic oligonucleotide
  Target: ATXN1; (-) strand; PAM type: NRG; PAM sequence: GAG
ctcatagtaagaattgccac

SEQ ID NO: 73637 - DNA, 20 bp, Artificial Sequence
  Description of Artificial Sequence: Synthetic oligonucleotide
  Target: ATXN1; (-) strand; PAM type: NRG; PAM sequence: AAG
acatcattagaactcatagt

SEQ ID NO: 73638 - DNA, 20 bp, Artificial Sequence
  Description of Artificial Sequence: Synthetic oligonucleotide
  Target: ATXN1; (-) strand; PAM type: NRG; PAM sequence: TAG
gaaaacatcattagaactca

SEQ ID NO: 73639 - DNA, 20 bp, Artificial Sequence
  Description of Artificial Sequence: Synthetic oligonucleotide
  Target: ATXN1; (-) strand; PAM type: NRG; PAM sequence: TAG
aagcagtatgaaaacatcat

SEQ ID NO: 73640 - DNA, 20 bp, Artificial Sequence
  Description of Artificial Sequence: Synthetic oligonucleotide
  Target: ATXN1; (-) strand; PAM type: NRG; PAM sequence: CAG
taaacaaacgaggaaggaag

SEQ ID NO: 73641 - DNA, 20 bp, Artificial Sequence
  Description of Artificial Sequence: Synthetic oligonucleotide
  Target: ATXN1; (-) strand; PAM type: NRG; PAM sequence: AAG
taataaacaaacgaggaagg

SEQ ID NO: 73642 - DNA, 20 bp, Artificial Sequence
  Description of Artificial Sequence: Synthetic oligonucleotide
  Target: ATXN1; (-) strand; PAM type: NRG; PAM sequence: AGG
agttaataaacaaacgagga

SEQ ID NO: 73643 - DNA, 20 bp, Artificial Sequence
  Description of Artificial Sequence: Synthetic oligonucleotide
  Target: ATXN1; (-) strand; PAM type: NRG; PAM sequence: AAG
cagttaataaacaaacgagg

SEQ ID NO: 73644 - DNA, 20 bp, Artificial Sequence
  Description of Artificial Sequence: Synthetic oligonucleotide
  Target: ATXN1; (-) strand; PAM type: NRG; PAM sequence: AGG
tttcagttaataaacaaacg

SEQ ID NO: 73645 - DNA, 20 bp, Artificial Sequence
  Description of Artificial Sequence: Synthetic oligonucleotide
  Target: ATXN1; (-) strand; PAM type: NRG; PAM sequence: GAG
atttcagttaataaacaaac

SEQ ID NO: 73646 - DNA, 20 bp, Artificial Sequence
  Description of Artificial Sequence: Synthetic oligonucleotide
  Target: ATXN1; (-) strand; PAM type: NRG; PAM sequence: CAG
tcttccctgcagcagaattt

SEQ ID NO: 73647 - DNA, 20 bp, Artificial Sequence
  Description of Artificial Sequence: Synthetic oligonucleotide
  Target: ATXN1; (-) strand; PAM type: NRG; PAM sequence: CAG
ggaatgactcttccctgcag

SEQ ID NO: 73648 - DNA, 20 bp, Artificial Sequence
  Description of Artificial Sequence: Synthetic oligonucleotide
  Target: ATXN1; (-) strand; PAM type: NRG; PAM sequence: CAG
aaaggaatgactcttccctg

SEQ ID NO: 73649 - DNA, 20 bp, Artificial Sequence
  Description of Artificial Sequence: Synthetic oligonucleotide
  Target: ATXN1; (-) strand; PAM type: NRG; PAM sequence: AGG
gaataaataaataagggaaa

SEQ ID NO: 73650 - DNA, 20 bp, Artificial Sequence
  Description of Artificial Sequence: Synthetic oligonucleotide
  Target: ATXN1; (-) strand; PAM type: NRG; PAM sequence: AAG
tgaataaataaataagggaa

SEQ ID NO: 73651 - DNA, 20 bp, Artificial Sequence
  Description of Artificial Sequence: Synthetic oligonucleotide
  Target: ATXN1; (-) strand; PAM type: NRG; PAM sequence: GGG
tccaatgaataaataaataa

SEQ ID NO: 73652 - DNA, 20 bp, Artificial Sequence
  Description of Artificial Sequence: Synthetic oligonucleotide
  Target: ATXN1; (-) strand; PAM type: NRG; PAM sequence: AGG
gtccaatgaataaataaata

SEQ ID NO: 73653 - DNA, 20 bp, Artificial Sequence
  Description of Artificial Sequence: Synthetic oligonucleotide
  Target: ATXN1; (-) strand; PAM type: NRG; PAM sequence: AAG
agtccaatgaataaataaat

SEQ ID NO: 73654 - DNA, 20 bp, Artificial Sequence
  Description of Artificial Sequence: Synthetic oligonucleotide
  Target: ATXN1; (-) strand; PAM type: NRG; PAM sequence: GAG
caaagaataaaatatccaac

SEQ ID NO: 73655 - DNA, 20 bp, Artificial Sequence
  Description of Artificial Sequence: Synthetic oligonucleotide
  Target: ATXN1; (-) strand; PAM type: NRG; PAM sequence: AAG
aaatgctggattataaccca

SEQ ID NO: 73656 - DNA, 20 bp, Artificial Sequence
  Description of Artificial Sequence: Synthetic oligonucleotide
  Target: ATXN1; (-) strand; PAM type: NRG; PAM sequence: TGG
ctgggtaaggaaataaatgc

SEQ ID NO: 73657 - DNA, 20 bp, Artificial Sequence
  Description of Artificial Sequence: Synthetic oligonucleotide
  Target: ATXN1; (-) strand; PAM type: NRG; PAM sequence: AGG
cagcttagaataactgggta

SEQ ID NO: 73658 - DNA, 20 bp, Artificial Sequence
  Description of Artificial Sequence: Synthetic oligonucleotide
  Target: ATXN1; (-) strand; PAM type: NRG; PAM sequence: AAG
acagcttagaataactgggt

SEQ ID NO: 73659 - DNA, 20 bp, Artificial Sequence
  Description of Artificial Sequence: Synthetic oligonucleotide
  Target: ATXN1; (-) strand; PAM type: NRG; PAM sequence: GGG
agctacagcttagaataact

SEQ ID NO: 73660 - DNA, 20 bp, Artificial Sequence
  Description of Artificial Sequence: Synthetic oligonucleotide
  Target: ATXN1; (-) strand; PAM type: NRG; PAM sequence: TGG
tagctacagcttagaataac

SEQ ID NO: 73661 - DNA, 20 bp, Artificial Sequence
  Description of Artificial Sequence: Synthetic oligonucleotide
  Target: ATXN1; (-) strand; PAM type: NRG; PAM sequence: TAG
tagaatatctagctacagct

SEQ ID NO: 73662 - DNA, 20 bp, Artificial Sequence
  Description of Artificial Sequence: Synthetic oligonucleotide
  Target: ATXN1; (-) strand; PAM type: NRG; PAM sequence: CAG
aatggtagaatatctagcta

SEQ ID NO: 73663 - DNA, 20 bp, Artificial Sequence
  Description of Artificial Sequence: Synthetic oligonucleotide
  Target: ATXN1; (-) strand; PAM type: NRG; PAM sequence: TAG
ctctgaaatggtagaatatc

SEQ ID NO: 73664 - DNA, 20 bp, Artificial Sequence
  Description of Artificial Sequence: Synthetic oligonucleotide
  Target: ATXN1; (-) strand; PAM type: NRG; PAM sequence: TAG
ctgtgtctgctctgaaatgg

SEQ ID NO: 73665 - DNA, 20 bp, Artificial Sequence
  Description of Artificial Sequence: Synthetic oligonucleotide
  Target: ATXN1; (-) strand; PAM type: NRG; PAM sequence: TGG
tggctgtgtctgctctgaaa

SEQ ID NO: 73666 - DNA, 20 bp, Artificial Sequence
  Description of Artificial Sequence: Synthetic oligonucleotide
  Target: ATXN1; (-) strand; PAM type: NRG; PAM sequence: TGG
ctgtaacacaggacacaatg

SEQ ID NO: 73667 - DNA, 20 bp, Artificial Sequence
  Description of Artificial Sequence: Synthetic oligonucleotide
  Target: ATXN1; (-) strand; PAM type: NRG; PAM sequence: AGG
tgagggacaacctgtaacac

SEQ ID NO: 73668 - DNA, 20 bp, Artificial Sequence
  Description of Artificial Sequence: Synthetic oligonucleotide
  Target: ATXN1; (-) strand; PAM type: NRG; PAM sequence: CAG
atgagggacaacctgtaaca

SEQ ID NO: 73669 - DNA, 20 bp, Artificial Sequence
  Description of Artificial Sequence: Synthetic oligonucleotide
  Target: ATXN1; (-) strand; PAM type: NRG; PAM sequence: GGG
gttcttgtcttaagacatga

SEQ ID NO: 73670 - DNA, 20 bp, Artificial Sequence
  Description of Artificial Sequence: Synthetic oligonucleotide
  Target: ATXN1; (-) strand; PAM type: NRG; PAM sequence: AGG
tgttcttgtcttaagacatg

SEQ ID NO: 73671 - DNA, 20 bp, Artificial Sequence
  Description of Artificial Sequence: Synthetic oligonucleotide
  Target: ATXN1; (-) strand; PAM type: NRG; PAM sequence: GAG
ctgttcttgtcttaagacat

SEQ ID NO: 73672 - DNA, 20 bp, Artificial Sequence
  Description of Artificial Sequence: Synthetic oligonucleotide
  Target: ATXN1; (-) strand; PAM type: NRG; PAM sequence: AAG
tgtgtgcctgttcttgtctt

SEQ ID NO: 73673 - DNA, 20 bp, Artificial Sequence
  Description of Artificial Sequence: Synthetic oligonucleotide
  Target: ATXN1; (-) strand; PAM type: NRG; PAM sequence: GAG
tgtcaaatgaatgaacagat

SEQ ID NO: 73674 - DNA, 20 bp, Artificial Sequence
  Description of Artificial Sequence: Synthetic oligonucleotide
  Target: ATXN1; (-) strand; PAM type: NRG; PAM sequence: CAG
taacctgtcaaatgaatgaa

SEQ ID NO: 73675 - DNA, 20 bp, Artificial Sequence
  Description of Artificial Sequence: Synthetic oligonucleotide
  Target: ATXN1; (-) strand; PAM type: NRG; PAM sequence: AAG
acacctaacacaaggccctc

SEQ ID NO: 73676 - DNA, 20 bp, Artificial Sequence
  Description of Artificial Sequence: Synthetic oligonucleotide
  Target: ATXN1; (-) strand; PAM type: NRG; PAM sequence: AGG
taactctaacacctaacaca

SEQ ID NO: 73677 - DNA, 20 bp, Artificial Sequence
  Description of Artificial Sequence: Synthetic oligonucleotide
  Target: ATXN1; (-) strand; PAM type: NRG; PAM sequence: AAG
gtaactctaacacctaacac

SEQ ID NO: 73678 - DNA, 20 bp, Artificial Sequence
  Description of Artificial Sequence: Synthetic oligonucleotide
  Target: ATXN1; (-) strand; PAM type: NRG; PAM sequence: AGG
gctgtaaaccactcggacag

SEQ ID NO: 73679 - DNA, 20 bp, Artificial Sequence
  Description of Artificial Sequence: Synthetic oligonucleotide
  Target: ATXN1; (-) strand; PAM type: NRG; PAM sequence: GAG
ggctgtaaaccactcggaca

SEQ ID NO: 73680 - DNA, 20 bp, Artificial Sequence
  Description of Artificial Sequence: Synthetic oligonucleotide
  Target: ATXN1; (-) strand; PAM type: NRG; PAM sequence: CAG
taggctgtaaaccactcgga

SEQ ID NO: 73681 - DNA, 20 bp, Artificial Sequence
  Description of Artificial Sequence: Synthetic oligonucleotide
  Target: ATXN1; (-) strand; PAM type: NRG; PAM sequence: CGG
taactaggctgtaaaccact

SEQ ID NO: 73682 - DNA, 20 bp, Artificial Sequence
  Description of Artificial Sequence: Synthetic oligonucleotide
  Target: ATXN1; (-) strand; PAM type: NRG; PAM sequence: AGG
cctgtaggtctcttctaact

SEQ ID NO: 73683 - DNA, 20 bp, Artificial Sequence
  Description of Artificial Sequence: Synthetic oligonucleotide
  Target: ATXN1; (-) strand; PAM type: NRG; PAM sequence: TAG
gcctgtaggtctcttctaac

SEQ ID NO: 73684 - DNA, 20 bp, Artificial Sequence
  Description of Artificial Sequence: Synthetic oligonucleotide
  Target: ATXN1; (-) strand; PAM type: NRG; PAM sequence: AGG
ggacttgcaaatgtgcctgt

SEQ ID NO: 73685 - DNA, 20 bp, Artificial Sequence
  Description of Artificial Sequence: Synthetic oligonucleotide
  Target: ATXN1; (-) strand; PAM type: NRG; PAM sequence: TAG
aggacttgcaaatgtgcctg

SEQ ID NO: 73686 - DNA, 20 bp, Artificial Sequence
  Description of Artificial Sequence: Synthetic oligonucleotide
  Target: ATXN1; (-) strand; PAM type: NRG; PAM sequence: AGG
cttgcctaatacttttaata

SEQ ID NO: 73687 - DNA, 20 bp, Artificial Sequence
  Description of Artificial Sequence: Synthetic oligonucleotide
  Target: ATXN1; (-) strand; PAM type: NRG; PAM sequence: AAG
acttgcctaatacttttaat

SEQ ID NO: 73688 - DNA, 20 bp, Artificial Sequence
  Description of Artificial Sequence: Synthetic oligonucleotide
  Target: ATXN1; (-) strand; PAM type: NRG; PAM sequence: GGG
agttgactatgttttcttct

SEQ ID NO: 73689 - DNA, 20 bp, Artificial Sequence
  Description of Artificial Sequence: Synthetic oligonucleotide
  Target: ATXN1; (-) strand; PAM type: NRG; PAM sequence: TGG
gagttgactatgttttcttc

SEQ ID NO: 73690 - DNA, 20 bp, Artificial Sequence
  Description of Artificial Sequence: Synthetic oligonucleotide
  Target: ATXN1; (-) strand; PAM type: NRG; PAM sequence: GAG
cacccctttttctccaggta

SEQ ID NO: 73691 - DNA, 20 bp, Artificial Sequence
  Description of Artificial Sequence: Synthetic oligonucleotide
  Target: ATXN1; (-) strand; PAM type: NRG; PAM sequence: TAG
cacacccctttttctccagg

SEQ ID NO: 73692 - DNA, 20 bp, Artificial Sequence
  Description of Artificial Sequence: Synthetic oligonucleotide
  Target: ATXN1; (-) strand; PAM type: NRG; PAM sequence: AGG
tgccacacccctttttctcc

SEQ ID NO: 73693 - DNA, 20 bp, Artificial Sequence
  Description of Artificial Sequence: Synthetic oligonucleotide
  Target: ATXN1; (-) strand; PAM type: NRG; PAM sequence: CAG
ttgccacacccctttttctc

SEQ ID NO: 73694 - DNA, 20 bp, Artificial Sequence
  Description of Artificial Sequence: Synthetic oligonucleotide
  Target: ATXN1; (-) strand; PAM type: NRG; PAM sequence: AAG
gatgctgcttggtcttaagg

SEQ ID NO: 73695 - DNA, 20 bp, Artificial Sequence
  Description of Artificial Sequence: Synthetic oligonucleotide
  Target: ATXN1; (-) strand; PAM type: NRG; PAM sequence: AGG
caggatgctgcttggtctta

SEQ ID NO: 73696 - DNA, 20 bp, Artificial Sequence
  Description of Artificial Sequence: Synthetic oligonucleotide
  Target: ATXN1; (-) strand; PAM type: NRG; PAM sequence: AAG
gcaggatgctgcttggtctt

SEQ ID NO: 73697 - DNA, 20 bp, Artificial Sequence
  Description of Artificial Sequence: Synthetic oligonucleotide
  Target: ATXN1; (-) strand; PAM type: NRG; PAM sequence: TGG
aagggaagcaggatgctgct

SEQ ID NO: 73698 - DNA, 20 bp, Artificial Sequence
  Description of Artificial Sequence: Synthetic oligonucleotide
  Target: ATXN1; (-) strand; PAM type: NRG; PAM sequence: AGG
cagtacaatagaagggaagc

SEQ ID NO: 73699 - DNA, 20 bp, Artificial Sequence
  Description of Artificial Sequence: Synthetic oligonucleotide
  Target: ATXN1; (-) strand; PAM type: NRG; PAM sequence: CAG
gcagtacaatagaagggaag

SEQ ID NO: 73700 - DNA, 20 bp, Artificial Sequence
  Description of Artificial Sequence: Synthetic oligonucleotide
  Target: ATXN1; (-) strand; PAM type: NRG; PAM sequence: AAG
caagcagtacaatagaaggg

SEQ ID NO: 73701 - DNA, 20 bp, Artificial Sequence
  Description of Artificial Sequence: Synthetic oligonucleotide
  Target: ATXN1; (-) strand; PAM type: NRG; PAM sequence: GGG
gagcaagcagtacaatagaa

SEQ ID NO: 73702 - DNA, 20 bp, Artificial Sequence
  Description of Artificial Sequence: Synthetic oligonucleotide
  Target: ATXN1; (-) strand; PAM type: NRG; PAM sequence: AGG
agagcaagcagtacaataga

SEQ ID NO: 73703 - DNA, 20 bp, Artificial Sequence
  Description of Artificial Sequence: Synthetic oligonucleotide
  Target: ATXN1; (-) strand; PAM type: NRG; PAM sequence: AAG
tagagcaagcagtacaatag

SEQ ID NO: 73704 - DNA, 20 bp, Artificial Sequence
  Description of Artificial Sequence: Synthetic oligonucleotide
  Target: ATXN1; (-) strand; PAM type: NRG; PAM sequence: TAG
ttatagagcaagcagtacaa

SEQ ID NO: 73705 - DNA, 20 bp, Artificial Sequence
  Description of Artificial Sequence: Synthetic oligonucleotide
  Target: ATXN1; (-) strand; PAM type: NRG; PAM sequence: CAG
attgatttttatagagcaag

SEQ ID NO: 73706 - DNA, 20 bp, Artificial Sequence
  Description of Artificial Sequence: Synthetic oligonucleotide
  Target: ATXN1; (-) strand; PAM type: NRG; PAM sequence: AAG
cccattgatttttatagagc

SEQ ID NO: 73707 - DNA, 20 bp, Artificial Sequence
  Description of Artificial Sequence: Synthetic oligonucleotide
  Target: ATXN1; (-) strand; PAM type: NRG; PAM sequence: GAG
tatgcccattgatttttata

SEQ ID NO: 73708 - DNA, 20 bp, Artificial Sequence
  Description of Artificial Sequence: Synthetic oligonucleotide
  Target: ATXN1; (-) strand; PAM type: NRG; PAM sequence: TAG
tatatgcccattgattttta

SEQ ID NO: 73709 - DNA, 20 bp, Artificial Sequence
  Description of Artificial Sequence: Synthetic oligonucleotide
  Target: ATXN1; (-) strand; PAM type: NRG; PAM sequence: TAG
tgtgtgatggcgtgtgtctc

SEQ ID NO: 73710 - DNA, 20 bp, Artificial Sequence
  Description of Artificial Sequence: Synthetic oligonucleotide
  Target: ATXN1; (-) strand; PAM type: NRG; PAM sequence: TGG
agtacctgctaactgtgtga

SEQ ID NO: 73711 - DNA, 20 bp, Artificial Sequence
  Description of Artificial Sequence: Synthetic oligonucleotide
  Target: ATXN1; (-) strand; PAM type: NRG; PAM sequence: GAG
ttagaagattcaggggcttg

SEQ ID NO: 73712 - DNA, 20 bp, Artificial Sequence
  Description of Artificial Sequence: Synthetic oligonucleotide
  Target: ATXN1; (-) strand; PAM type: NRG; PAM sequence: TGG
gtttagaagattcaggggct

SEQ ID NO: 73713 - DNA, 20 bp, Artificial Sequence
  Description of Artificial Sequence: Synthetic oligonucleotide
  Target: ATXN1; (-) strand; PAM type: NRG; PAM sequence: GGG
aattagtttagaagattcag

SEQ ID NO: 73714 - DNA, 20 bp, Artificial Sequence
  Description of Artificial Sequence: Synthetic oligonucleotide
  Target: ATXN1; (-) strand; PAM type: NRG; PAM sequence: GGG
gaattagtttagaagattca

SEQ ID NO: 73715 - DNA, 20 bp, Artificial Sequence
  Description of Artificial Sequence: Synthetic oligonucleotide
  Target: ATXN1; (-) strand; PAM type: NRG; PAM sequence: AGG
ggaattagtttagaagattc

SEQ ID NO: 73716 - DNA, 20 bp, Artificial Sequence
  Description of Artificial Sequence: Synthetic oligonucleotide
  Target: ATXN1; (-) strand; PAM type: NRG; PAM sequence: CAG
gggaattagtttagaagatt

SEQ ID NO: 73717 - DNA, 20 bp, Artificial Sequence
  Description of Artificial Sequence: Synthetic oligonucleotide
  Target: ATXN1; (-) strand; PAM type: NRG; PAM sequence: AAG
gatgtggggaattagtttag

SEQ ID NO: 73718 - DNA, 20 bp, Artificial Sequence
  Description of Artificial Sequence: Synthetic oligonucleotide
  Target: ATXN1; (-) strand; PAM type: NRG; PAM sequence: TAG
tttgatgtggggaattagtt

SEQ ID NO: 73719 - DNA, 20 bp, Artificial Sequence
  Description of Artificial Sequence: Synthetic oligonucleotide
  Target: ATXN1; (-) strand; PAM type: NRG; PAM sequence: TAG
tgaggtttgatgtggggaat

SEQ ID NO: 73720 - DNA, 20 bp, Artificial Sequence
  Description of Artificial Sequence: Synthetic oligonucleotide
  Target: ATXN1; (-) strand; PAM type: NRG; PAM sequence: GGG
tgcccttgaggtttgatgtg

SEQ ID NO: 73721 - DNA, 20 bp, Artificial Sequence
  Description of Artificial Sequence: Synthetic oligonucleotide
  Target: ATXN1; (-) strand; PAM type: NRG; PAM sequence: GGG
gtgcccttgaggtttgatgt

SEQ ID NO: 73722 - DNA, 20 bp, Artificial Sequence
  Description of Artificial Sequence: Synthetic oligonucleotide
  Target: ATXN1; (-) strand; PAM type: NRG; PAM sequence: TGG
tgtgcccttgaggtttgatg

SEQ ID NO: 73723 - DNA, 20 bp, Artificial Sequence
  Description of Artificial Sequence: Synthetic oligonucleotide
  Target: ATXN1; (-) strand; PAM type: NRG; PAM sequence: AGG
tcctaaatagtgtgcccttg

SEQ ID NO: 73724 - DNA, 20 bp, Artificial Sequence
  Description of Artificial Sequence: Synthetic oligonucleotide
  Target: ATXN1; (-) strand; PAM type: NRG; PAM sequence: GAG
ttcctaaatagtgtgccctt

SEQ ID NO: 73725 - DNA, 20 bp, Artificial Sequence
  Description of Artificial Sequence: Synthetic oligonucleotide
  Target: ATXN1; (-) strand; PAM type: NRG; PAM sequence: TAG
ttgcattaaatcttcctaaa

SEQ ID NO: 73726 - DNA, 20 bp, Artificial Sequence
  Description of Artificial Sequence: Synthetic oligonucleotide
  Target: ATXN1; (-) strand; PAM type: NRG; PAM sequence: GAG
agtcactatataaagagtct

SEQ ID NO: 73727 - DNA, 20 bp, Artificial Sequence
  Description of Artificial Sequence: Synthetic oligonucleotide
  Target: ATXN1; (-) strand; PAM type: NRG; PAM sequence: GAG
gcacatagtcactatataaa

SEQ ID NO: 73728 - DNA, 20 bp, Artificial Sequence
  Description of Artificial Sequence: Synthetic oligonucleotide
  Target: ATXN1; (-) strand; PAM type: NRG; PAM sequence: AAG
aagcacatagtcactatata

SEQ ID NO: 73729 - DNA, 20 bp, Artificial Sequence
  Description of Artificial Sequence: Synthetic oligonucleotide
  Target: ATXN1; (-) strand; PAM type: NRG; PAM sequence: TAG
aattttcctagaaaagcaca

SEQ ID NO: 73730 - DNA, 20 bp, Artificial Sequence
  Description of Artificial Sequence: Synthetic oligonucleotide
  Target: ATXN1; (-) strand; PAM type: NRG; PAM sequence: AAG
tgtttccaattttcctagaa

SEQ ID NO: 73731 - DNA, 20 bp, Artificial Sequence
  Description of Artificial Sequence: Synthetic oligonucleotide
  Target: ATXN1; (-) strand; PAM type: NRG; PAM sequence: TAG
ttagctgtttccaattttcc

SEQ ID NO: 73732 - DNA, 20 bp, Artificial Sequence
  Description of Artificial Sequence: Synthetic oligonucleotide
  Target: ATXN1; (-) strand; PAM type: NRG; PAM sequence: TAG
agatttttttttttttacct

SEQ ID NO: 73733 - DNA, 20 bp, Artificial Sequence
  Description of Artificial Sequence: Synthetic oligonucleotide
  Target: ATXN1; (-) strand; PAM type: NRG; PAM sequence: CAG
gattaagacaaatgactttt

SEQ ID NO: 73734 - DNA, 20 bp, Artificial Sequence
  Description of Artificial Sequence: Synthetic oligonucleotide
  Target: ATXN1; (-) strand; PAM type: NRG; PAM sequence: AAG
ttggatttgaagactggatt

SEQ ID NO: 73735 - DNA, 20 bp, Artificial Sequence
  Description of Artificial Sequence: Synthetic oligonucleotide
  Target: ATXN1; (-) strand; PAM type: NRG; PAM sequence: TGG
atgaaattggatttgaagac

SEQ ID NO: 73736 - DNA, 20 bp, Artificial Sequence
  Description of Artificial Sequence: Synthetic oligonucleotide
  Target: ATXN1; (-) strand; PAM type: NRG; PAM sequence: AAG
aaacgatgaaattggatttg

SEQ ID NO: 73737 - DNA, 20 bp, Artificial Sequence
  Description of Artificial Sequence: Synthetic oligonucleotide
  Target: ATXN1; (-) strand; PAM type: NRG; PAM sequence: TGG
aggaataaaaacgatgaaat

SEQ ID NO: 73738 - DNA, 20 bp, Artificial Sequence
  Description of Artificial Sequence: Synthetic oligonucleotide
  Target: ATXN1; (-) strand; PAM type: NRG; PAM sequence: AGG
ctcttcattattccctgtga

SEQ ID NO: 73739 - DNA, 20 bp, Artificial Sequence
  Description of Artificial Sequence: Synthetic oligonucleotide
  Target: ATXN1; (-) strand; PAM type: NRG; PAM sequence: AAG
gctcttcattattccctgtg

SEQ ID NO: 73740 - DNA, 20 bp, Artificial Sequence
  Description of Artificial Sequence: Synthetic oligonucleotide
  Target: ATXN1; (-) strand; PAM type: NRG; PAM sequence: GAG
attaagtaaagagacttagg

SEQ ID NO: 73741 - DNA, 20 bp, Artificial Sequence
  Description of Artificial Sequence: Synthetic oligonucleotide
  Target: ATXN1; (-) strand; PAM type: NRG; PAM sequence: GGG
gaattaagtaaagagactta

SEQ ID NO: 73742 - DNA, 20 bp, Artificial Sequence
  Description of Artificial Sequence: Synthetic oligonucleotide
  Target: ATXN1; (-) strand; PAM type: NRG; PAM sequence: AGG
tgaattaagtaaagagactt

SEQ ID NO: 73743 - DNA, 20 bp, Artificial Sequence
  Description of Artificial Sequence: Synthetic oligonucleotide
  Target: ATXN1; (-) strand; PAM type: NRG; PAM sequence: TAG
ttgaattaagtaaagagact

SEQ ID NO: 73744 - DNA, 20 bp, Artificial Sequence
  Description of Artificial Sequence: Synthetic oligonucleotide
  Target: ATXN1; (-) strand; PAM type: NRG; PAM sequence: GAG
agaaaattgaattaagtaaa

SEQ ID NO: 73745 - DNA, 20 bp, Artificial Sequence
  Description of Artificial Sequence: Synthetic oligonucleotide
  Target: ATXN1; (-) strand; PAM type: NRG; PAM sequence: AAG
caagaaaattgaattaagta

SEQ ID NO: 73746 - DNA, 20 bp, Artificial Sequence
  Description of Artificial Sequence: Synthetic oligonucleotide
  Target: ATXN1; (-) strand; PAM type: NRG; PAM sequence: AAG
cagtacaagaaaattgaatt

SEQ ID NO: 73747 - DNA, 20 bp, Artificial Sequence
  Description of Artificial Sequence: Synthetic oligonucleotide
  Target: ATXN1; (-) strand; PAM type: NRG; PAM sequence: AAG
aaatactgtaagagcagtac

SEQ ID NO: 73748 - DNA, 20 bp, Artificial Sequence
  Description of Artificial Sequence: Synthetic oligonucleotide
  Target: ATXN1; (-) strand; PAM type: NRG; PAM sequence: CAG
tttggaaaatactgtaagag

SEQ ID NO: 73749 - DNA, 20 bp, Artificial Sequence
  Description of Artificial Sequence: Synthetic oligonucleotide
  Target: ATXN1; (-) strand; PAM type: NRG; PAM sequence: GAG
ttgtttggaaaatactgtaa

SEQ ID NO: 73750 - DNA, 20 bp, Artificial Sequence
  Description of Artificial Sequence: Synthetic oligonucleotide
  Target: ATXN1; (-) strand; PAM type: NRG; PAM sequence: AAG
ctttgtttggaaaatactgt

SEQ ID NO: 73751 - DNA, 20 bp, Artificial Sequence
  Description of Artificial Sequence: Synthetic oligonucleotide
  Target: ATXN1; (-) strand; PAM type: NRG; PAM sequence: TGG
tagaaaagaacagctttgtt

SEQ ID NO: 73752 - DNA, 20 bp, Artificial Sequence
  Description of Artificial Sequence: Synthetic oligonucleotide
  Target: ATXN1; (-) strand; PAM type: NRG; PAM sequence: CAG
ctatcatatgtagaaaagaa

SEQ ID NO: 73753 - DNA, 20 bp, Artificial Sequence
  Description of Artificial Sequence: Synthetic oligonucleotide
  Target: ATXN1; (-) strand; PAM type: NRG; PAM sequence: AAG
ctgaactatcatatgtagaa

SEQ ID NO: 73754 - DNA, 20 bp, Artificial Sequence
  Description of Artificial Sequence: Synthetic oligonucleotide
  Target: ATXN1; (-) strand; PAM type: NRG; PAM sequence: TAG
ctgggctgaactatcatatg

SEQ ID NO: 73755 - DNA, 20 bp, Artificial Sequence
  Description of Artificial Sequence: Synthetic oligonucleotide
  Target: ATXN1; (-) strand; PAM type: NRG; PAM sequence: GGG
tattcctgaggacatttgct

SEQ ID NO: 73756 - DNA, 20 bp, Artificial Sequence
  Description of Artificial Sequence: Synthetic oligonucleotide
  Target: ATXN1; (-) strand; PAM type: NRG; PAM sequence: TGG
ttattcctgaggacatttgc

SEQ ID NO: 73757 - DNA, 20 bp, Artificial Sequence
  Description of Artificial Sequence: Synthetic oligonucleotide
  Target: ATXN1; (-) strand; PAM type: NRG; PAM sequence: AGG
ctgtttgtttattattcctg

SEQ ID NO: 73758 - DNA, 20 bp, Artificial Sequence
  Description of Artificial Sequence: Synthetic oligonucleotide
  Target: ATXN1; (-) strand; PAM type: NRG; PAM sequence: GAG
actgtttgtttattattcct

SEQ ID NO: 73759 - DNA, 20 bp, Artificial Sequence
  Description of Artificial Sequence: Synthetic oligonucleotide
  Target: ATXN1; (-) strand; PAM type: NRG; PAM sequence: CAG
ttgcagagtgtaatttgtgg

SEQ ID NO: 73760 - DNA, 20 bp, Artificial Sequence
  Description of Artificial Sequence: Synthetic oligonucleotide
  Target: ATXN1; (-) strand; PAM type: NRG; PAM sequence: TGG
atgttgcagagtgtaatttg

SEQ ID NO: 73761 - DNA, 20 bp, Artificial Sequence
  Description of Artificial Sequence: Synthetic oligonucleotide
  Target: ATXN1; (-) strand; PAM type: NRG; PAM sequence: GAG
tttggatgaagaatgttgca

SEQ ID NO: 73762 - DNA, 20 bp, Artificial Sequence
  Description of Artificial Sequence: Synthetic oligonucleotide
  Target: ATXN1; (-) strand; PAM type: NRG; PAM sequence: CAG
gctttggatgaagaatgttg

SEQ ID NO: 73763 - DNA, 20 bp, Artificial Sequence
  Description of Artificial Sequence: Synthetic oligonucleotide
  Target: ATXN1; (-) strand; PAM type: NRG; PAM sequence: AAG
aattgaaaatgctttggatg

SEQ ID NO: 73764 - DNA, 20 bp, Artificial Sequence
  Description of Artificial Sequence: Synthetic oligonucleotide
  Target: ATXN1; (-) strand; PAM type: NRG; PAM sequence: TGG
gcttggaattgaaaatgctt

SEQ ID NO: 73765 - DNA, 20 bp, Artificial Sequence
  Description of Artificial Sequence: Synthetic oligonucleotide
  Target: ATXN1; (-) strand; PAM type: NRG; PAM sequence: TGG
tccttgtgtctttgcttgct

SEQ ID NO: 73766 - DNA, 20 bp, Artificial Sequence
  Description of Artificial Sequence: Synthetic oligonucleotide
  Target: ATXN1; (-) strand; PAM type: NRG; PAM sequence: CAG
gtgcagttcttgtaataagg

SEQ ID NO: 73767 - DNA, 20 bp, Artificial Sequence
  Description of Artificial Sequence: Synthetic oligonucleotide
  Target: ATXN1; (-) strand; PAM type: NRG; PAM sequence: AGG
tgtgtgcagttcttgtaata

SEQ ID NO: 73768 - DNA, 20 bp, Artificial Sequence
  Description of Artificial Sequence: Synthetic oligonucleotide
  Target: ATXN1; (-) strand; PAM type: NRG; PAM sequence: AAG
ttgtgtgcagttcttgtaat

SEQ ID NO: 73769 - DNA, 20 bp, Artificial Sequence
  Description of Artificial Sequence: Synthetic oligonucleotide
  Target: ATXN1; (-) strand; PAM type: NRG; PAM sequence: CAG
tacagattctctattgtgtg

SEQ ID NO: 73770 - DNA, 20 bp, Artificial Sequence
  Description of Artificial Sequence: Synthetic oligonucleotide
  Target: ATXN1; (-) strand; PAM type: NRG; PAM sequence: CAG
tgtcaataagtgtctgaata

SEQ ID NO: 73771 - DNA, 20 bp, Artificial Sequence
  Description of Artificial Sequence: Synthetic oligonucleotide
  Target: ATXN1; (-) strand; PAM type: NRG; PAM sequence: AAG
taacaggtttaagtgtcaat

SEQ ID NO: 73772 - DNA, 20 bp, Artificial Sequence
  Description of Artificial Sequence: Synthetic oligonucleotide
  Target: ATXN1; (-) strand; PAM type: NRG; PAM sequence: AAG
agttacatattaacaggttt

SEQ ID NO: 73773 - DNA, 20 bp, Artificial Sequence
  Description of Artificial Sequence: Synthetic oligonucleotide
  Target: ATXN1; (-) strand; PAM type: NRG; PAM sequence: AGG
agtaggagttacatattaac

SEQ ID NO: 73774 - DNA, 20 bp, Artificial Sequence
  Description of Artificial Sequence: Synthetic oligonucleotide
  Target: ATXN1; (-) strand; PAM type: NRG; PAM sequence: CAG
tagtaggagttacatattaa

SEQ ID NO: 73775 - DNA, 20 bp, Artificial Sequence
  Description of Artificial Sequence: Synthetic oligonucleotide
  Target: ATXN1; (-) strand; PAM type: NRG; PAM sequence: GAG
atcctttagaacaatagtag

SEQ ID NO: 73776 - DNA, 20 bp, Artificial Sequence
  Description of Artificial Sequence: Synthetic oligonucleotide
  Target: ATXN1; (-) strand; PAM type: NRG; PAM sequence: AGG
tcatcctttagaacaatagt

SEQ ID NO: 73777 - DNA, 20 bp, Artificial Sequence
  Description of Artificial Sequence: Synthetic oligonucleotide
  Target: ATXN1; (-) strand; PAM type: NRG; PAM sequence: TAG
ttcatcctttagaacaatag

SEQ ID NO: 73778 - DNA, 20 bp, Artificial Sequence
  Description of Artificial Sequence: Synthetic oligonucleotide
  Target: ATXN1; (-) strand; PAM type: NRG; PAM sequence: TAG
ttattcatcctttagaacaa

SEQ ID NO: 73779 - DNA, 20 bp, Artificial Sequence
  Description of Artificial Sequence: Synthetic oligonucleotide
  Target: ATXN1; (-) strand; PAM type: NRG; PAM sequence: TAG
gaatttgcttattcatcctt

SEQ ID NO: 73780 - DNA, 20 bp, Artificial Sequence
  Description of Artificial Sequence: Synthetic oligonucleotide
  Target: ATXN1; (-) strand; PAM type: NRG; PAM sequence: GAG
atgtaacattatatgtgcag

SEQ ID NO: 73781 - DNA, 20 bp, Artificial Sequence
  Description of Artificial Sequence: Synthetic oligonucleotide
  Target: ATXN1; (-) strand; PAM type: NRG; PAM sequence: AGG
tgatgtaacattatatgtgc

SEQ ID NO: 73782 - DNA, 20 bp, Artificial Sequence
  Description of Artificial Sequence: Synthetic oligonucleotide
  Target: ATXN1; (-) strand; PAM type: NRG; PAM sequence: CAG
atgatgtaacattatatgtg

SEQ ID NO: 73783 - DNA, 20 bp, Artificial Sequence
  Description of Artificial Sequence: Synthetic oligonucleotide
  Target: ATXN1; (-) strand; PAM type: NRG; PAM sequence: AAG
agtatttactattgtaatta

SEQ ID NO: 73784 - DNA, 20 bp, Artificial Sequence
  Description of Artificial Sequence: Synthetic oligonucleotide
  Target: ATXN1; (-) strand; PAM type: NRG; PAM sequence: CAG
gaaagtaaaattcctttcgg

SEQ ID NO: 73785 - DNA, 20 bp, Artificial Sequence
  Description of Artificial Sequence: Synthetic oligonucleotide
  Target: ATXN1; (-) strand; PAM type: NRG; PAM sequence: CGG
agtgaaagtaaaattccttt

SEQ ID NO: 73786 - DNA, 20 bp, Artificial Sequence
  Description of Artificial Sequence: Synthetic oligonucleotide
  Target: ATXN1; (-) strand; PAM type: NRG; PAM sequence: AAG
aaggtgatatgaaacagtga

SEQ ID NO: 73787 - DNA, 20 bp, Artificial Sequence
  Description of Artificial Sequence: Synthetic oligonucleotide
  Target: ATXN1; (-) strand; PAM type: NRG; PAM sequence: CAG
ttagaaaaggtgatatgaaa

SEQ ID NO: 73788 - DNA, 20 bp, Artificial Sequence
  Description of Artificial Sequence: Synthetic oligonucleotide
  Target: ATXN1; (-) strand; PAM type: NRG; PAM sequence: AGG
acattgacattaattagaaa

SEQ ID NO: 73789 - DNA, 20 bp, Artificial Sequence
  Description of Artificial Sequence: Synthetic oligonucleotide
  Target: ATXN1; (-) strand; PAM type: NRG; PAM sequence: AAG
cacattgacattaattagaa

SEQ ID NO: 73790 - DNA, 20 bp, Artificial Sequence
  Description of Artificial Sequence: Synthetic oligonucleotide
  Target: ATXN1; (-) strand; PAM type: NRG; PAM sequence: TAG
aaagacacattgacattaat

SEQ ID NO: 73791 - DNA, 20 bp, Artificial Sequence
  Description of Artificial Sequence: Synthetic oligonucleotide
  Target: ATXN1; (-) strand; PAM type: NRG; PAM sequence: AAG
gtatgctctcttacatggaa

SEQ ID NO: 73792 - DNA, 20 bp, Artificial Sequence
  Description of Artificial Sequence: Synthetic oligonucleotide
  Target: ATXN1; (-) strand; PAM type: NRG; PAM sequence: TGG
ctgctgtatgctctcttaca

SEQ ID NO: 73793 - DNA, 20 bp, Artificial Sequence
  Description of Artificial Sequence: Synthetic oligonucleotide
  Target: ATXN1; (-) strand; PAM type: NRG; PAM sequence: AAG
tacatttgggcagatacaca

SEQ ID NO: 73794 - DNA, 20 bp, Artificial Sequence
  Description of Artificial Sequence: Synthetic oligonucleotide
  Target: ATXN1; (-) strand; PAM type: NRG; PAM sequence: CAG
tgaatatgtgtacatttggg

SEQ ID NO: 73795 - DNA, 20 bp, Artificial Sequence
  Description of Artificial Sequence: Synthetic oligonucleotide
  Target: ATXN1; (-) strand; PAM type: NRG; PAM sequence: GGG
tcatgaatatgtgtacattt

SEQ ID NO: 73796 - DNA, 20 bp, Artificial Sequence
  Description of Artificial Sequence: Synthetic oligonucleotide
  Target: ATXN1; (-) strand; PAM type: NRG; PAM sequence: TGG
ttcatgaatatgtgtacatt

SEQ ID NO: 73797 - DNA, 20 bp, Artificial Sequence
  Description of Artificial Sequence: Synthetic oligonucleotide
  Target: ATXN1; (-) strand; PAM type: NRG; PAM sequence: GAG
gggttactctgtgtgcataa

SEQ ID NO: 73798 - DNA, 20 bp, Artificial Sequence
  Description of Artificial Sequence: Synthetic oligonucleotide
  Target: ATXN1; (-) strand; PAM type: NRG; PAM sequence: AAG
gggggttactctgtgtgcat

SEQ ID NO: 73799 - DNA, 20 bp, Artificial Sequence
  Description of Artificial Sequence: Synthetic oligonucleotide
  Target: ATXN1; (-) strand; PAM type: NRG; PAM sequence: GGG
ataaatgcatgctaacatgg

SEQ ID NO: 73800 - DNA, 20 bp, Artificial Sequence
  Description of Artificial Sequence: Synthetic oligonucleotide
  Target: ATXN1; (-) strand; PAM type: NRG; PAM sequence: GGG
tataaatgcatgctaacatg

SEQ ID NO: 73801 - DNA, 20 bp, Artificial Sequence
  Description of Artificial Sequence: Synthetic oligonucleotide
  Target: ATXN1; (-) strand; PAM type: NRG; PAM sequence: GGG
ttataaatgcatgctaacat

SEQ ID NO: 73802 - DNA, 20 bp, Artificial Sequence
  Description of Artificial Sequence: Synthetic oligonucleotide
  Target: ATXN1; (-) strand; PAM type: NRG; PAM sequence: TGG
tttataaatgcatgctaaca

SEQ ID NO: 73803 - DNA, 20 bp, Artificial Sequence
  Description of Artificial Sequence: Synthetic oligonucleotide
  Target: ATXN1; (-) strand; PAM type: NRG; PAM sequence: CAG
atgcatgctcggggtggggc

SEQ ID NO: 73804 - DNA, 20 bp, Artificial Sequence
  Description of Artificial Sequence: Synthetic oligonucleotide
  Target: ATXN1; (-) strand; PAM type: NRG; PAM sequence: GGG
ctccatgcatgctcggggtg

SEQ ID NO: 73805 - DNA, 20 bp, Artificial Sequence
  Description of Artificial Sequence: Synthetic oligonucleotide
  Target: ATXN1; (-) strand; PAM type: NRG; PAM sequence: GGG
actccatgcatgctcggggt

SEQ ID NO: 73806 - DNA, 20 bp, Artificial Sequence
  Description of Artificial Sequence: Synthetic oligonucleotide
  Target: ATXN1; (-) strand; PAM type: NRG; PAM sequence: TGG
tactccatgcatgctcgggg

SEQ ID NO: 73807 - DNA, 20 bp, Artificial Sequence
  Description of Artificial Sequence: Synthetic oligonucleotide
  Target: ATXN1; (-) strand; PAM type: NRG; PAM sequence: GGG
gtatactccatgcatgctcg

SEQ ID NO: 73808 - DNA, 20 bp, Artificial Sequence
  Description of Artificial Sequence: Synthetic oligonucleotide
  Target: ATXN1; (-) strand; PAM type: NRG; PAM sequence: GGG
tgtatactccatgcatgctc

SEQ ID NO: 73809 - DNA, 20 bp, Artificial Sequence
  Description of Artificial Sequence: Synthetic oligonucleotide
  Target: ATXN1; (-) strand; PAM type: NRG; PAM sequence: CGG
gtgtatactccatgcatgct

SEQ ID NO: 73810 - DNA, 20 bp, Artificial Sequence
  Description of Artificial Sequence: Synthetic oligonucleotide
  Target: ATXN1; (-) strand; PAM type: NRG; PAM sequence: TGG
aaaagcaaaaggaagtcaac

SEQ ID NO: 73811 - DNA, 20 bp, Artificial Sequence
  Description of Artificial Sequence: Synthetic oligonucleotide
  Target: ATXN1; (-) strand; PAM type: NRG; PAM sequence: AAG
tctcctataaaagcaaaagg

SEQ ID NO: 73812 - DNA, 20 bp, Artificial Sequence
  Description of Artificial Sequence: Synthetic oligonucleotide
  Target: ATXN1; (-) strand; PAM type: NRG; PAM sequence: AGG
caatctcctataaaagcaaa

SEQ ID NO: 73813 - DNA, 20 bp, Artificial Sequence
  Description of Artificial Sequence: Synthetic oligonucleotide
  Target: ATXN1; (-) strand; PAM type: NRG; PAM sequence: AAG
tcaatctcctataaaagcaa

SEQ ID NO: 73814 - DNA, 20 bp, Artificial Sequence
  Description of Artificial Sequence: Synthetic oligonucleotide
  Target: ATXN1; (-) strand; PAM type: NRG; PAM sequence: AAG
tttatgtcaatctcctataa

SEQ ID NO: 73815 - DNA, 20 bp, Artificial Sequence
  Description of Artificial Sequence: Synthetic oligonucleotide
  Target: ATXN1; (-) strand; PAM type: NRG; PAM sequence: TAG
agtgtctacttgtctttttt

SEQ ID NO: 73816 - DNA, 20 bp, Artificial Sequence
  Description of Artificial Sequence: Synthetic oligonucleotide
  Target: ATXN1; (-) strand; PAM type: NRG; PAM sequence: AAG
tcttaatcacaggctccatg

SEQ ID NO: 73817 - DNA, 20 bp, Artificial Sequence
  Description of Artificial Sequence: Synthetic oligonucleotide
  Target: ATXN1; (-) strand; PAM type: NRG; PAM sequence: AGG
ttagcttctctcttaatcac

SEQ ID NO: 73818 - DNA, 20 bp, Artificial Sequence
  Description of Artificial Sequence: Synthetic oligonucleotide
  Target: ATXN1; (-) strand; PAM type: NRG; PAM sequence: CAG
attagcttctctcttaatca

SEQ ID NO: 73819 - DNA, 20 bp, Artificial Sequence
  Description of Artificial Sequence: Synthetic oligonucleotide
  Target: ATXN1; (-) strand; PAM type: NRG; PAM sequence: TAG
catcagcccatctgtctcat

SEQ ID NO: 73820 - DNA, 20 bp, Artificial Sequence
  Description of Artificial Sequence: Synthetic oligonucleotide
  Target: ATXN1; (-) strand; PAM type: NRG; PAM sequence: CAG
ctgaagttccctttatgcat

SEQ ID NO: 73821 - DNA, 20 bp, Artificial Sequence
  Description of Artificial Sequence: Synthetic oligonucleotide
  Target: ATXN1; (-) strand; PAM type: NRG; PAM sequence: AAG
gagtgtgggctggtgtgctg

SEQ ID NO: 73822 - DNA, 20 bp, Artificial Sequence
  Description of Artificial Sequence: Synthetic oligonucleotide
  Target: ATXN1; (-) strand; PAM type: NRG; PAM sequence: TGG
aatctttactgagtgtgggc

SEQ ID NO: 73823 - DNA, 20 bp, Artificial Sequence
  Description of Artificial Sequence: Synthetic oligonucleotide
  Target: ATXN1; (-) strand; PAM type: NRG; PAM sequence: GGG
ggtaaatctttactgagtgt

SEQ ID NO: 73824 - DNA, 20 bp, Artificial Sequence
  Description of Artificial Sequence: Synthetic oligonucleotide
  Target: ATXN1; (-) strand; PAM type: NRG; PAM sequence: TGG
cggtaaatctttactgagtg

SEQ ID NO: 73825 - DNA, 20 bp, Artificial Sequence
  Description of Artificial Sequence: Synthetic oligonucleotide
  Target: ATXN1; (-) strand; PAM type: NRG; PAM sequence: GAG
aagcacggtaaatctttact

SEQ ID NO: 73826 - DNA, 20 bp, Artificial Sequence
  Description of Artificial Sequence: Synthetic oligonucleotide
  Target: ATXN1; (-) strand; PAM type: NRG; PAM sequence: CGG
gaaacggagacagtgaagca

SEQ ID NO: 73827 - DNA, 20 bp, Artificial Sequence
  Description of Artificial Sequence: Synthetic oligonucleotide
  Target: ATXN1; (-) strand; PAM type: NRG; PAM sequence: AAG
agactgaaacggagacagtg

SEQ ID NO: 73828 - DNA, 20 bp, Artificial Sequence
  Description of Artificial Sequence: Synthetic oligonucleotide
  Target: ATXN1; (-) strand; PAM type: NRG; PAM sequence: CAG
gatgaagactgaaacggaga

SEQ ID NO: 73829 - DNA, 20 bp, Artificial Sequence
  Description of Artificial Sequence: Synthetic oligonucleotide
  Target: ATXN1; (-) strand; PAM type: NRG; PAM sequence: GAG
acatgatgaagactgaaacg

SEQ ID NO: 73830 - DNA, 20 bp, Artificial Sequence
  Description of Artificial Sequence: Synthetic oligonucleotide
  Target: ATXN1; (-) strand; PAM type: NRG; PAM sequence: CGG
ccacatgatgaagactgaaa

SEQ ID NO: 73831 - DNA, 20 bp, Artificial Sequence
  Description of Artificial Sequence: Synthetic oligonucleotide
  Target: ATXN1; (-) strand; PAM type: NRG; PAM sequence: AAG
aagtagcatgccacatgatg

SEQ ID NO: 73832 - DNA, 20 bp, Artificial Sequence
  Description of Artificial Sequence: Synthetic oligonucleotide
  Target: ATXN1; (-) strand; PAM type: NRG; PAM sequence: TAG
ggggacaagagtaatgtaag

SEQ ID NO: 73833 - DNA, 20 bp, Artificial Sequence
  Description of Artificial Sequence: Synthetic oligonucleotide
  Target: ATXN1; (-) strand; PAM type: NRG; PAM sequence: AAG
tctggggacaagagtaatgt

SEQ ID NO: 73834 - DNA, 20 bp, Artificial Sequence
  Description of Artificial Sequence: Synthetic oligonucleotide
  Target: ATXN1; (-) strand; PAM type: NRG; PAM sequence: GAG
tgtctgtggtctggggacaa

SEQ ID NO: 73835 - DNA, 20 bp, Artificial Sequence
  Description of Artificial Sequence: Synthetic oligonucleotide
  Target: ATXN1; (-) strand; PAM type: NRG; PAM sequence: AAG
tgtgtctgtggtctggggac

SEQ ID NO: 73836 - DNA, 20 bp, Artificial Sequence
  Description of Artificial Sequence: Synthetic oligonucleotide
  Target: ATXN1; (-) strand; PAM type: NRG; PAM sequence: GGG
cggggtgtgtctgtggtctg

SEQ ID NO: 73837 - DNA, 20 bp, Artificial Sequence
  Description of Artificial Sequence: Synthetic oligonucleotide
  Target: ATXN1; (-) strand; PAM type: NRG; PAM sequence: GGG
gcggggtgtgtctgtggtct

SEQ ID NO: 73838 - DNA, 20 bp, Artificial Sequence
  Description of Artificial Sequence: Synthetic oligonucleotide
  Target: ATXN1; (-) strand; PAM type: NRG; PAM sequence: TGG
agcggggtgtgtctgtggtc

SEQ ID NO: 73839 - DNA, 20 bp, Artificial Sequence
  Description of Artificial Sequence: Synthetic oligonucleotide
  Target: ATXN1; (-) strand; PAM type: NRG; PAM sequence: TGG
agaaaagcggggtgtgtctg

SEQ ID NO: 73840 - DNA, 20 bp, Artificial Sequence
  Description of Artificial Sequence: Synthetic oligonucleotide
  Target: ATXN1; (-) strand; PAM type: NRG; PAM sequence: GGG
ggtctgggcagagaaaagcg

SEQ ID NO: 73841 - DNA, 20 bp, Artificial Sequence
  Description of Artificial Sequence: Synthetic oligonucleotide
  Target: ATXN1; (-) strand; PAM type: NRG; PAM sequence: GGG
aggtctgggcagagaaaagc

SEQ ID NO: 73842 - DNA, 20 bp, Artificial Sequence
  Description of Artificial Sequence: Synthetic oligonucleotide
  Target: ATXN1; (-) strand; PAM type: NRG; PAM sequence: CGG
gaggtctgggcagagaaaag

SEQ ID NO: 73843 - DNA, 20 bp, Artificial Sequence
  Description of Artificial Sequence: Synthetic oligonucleotide
  Target: ATXN1; (-) strand; PAM type: NRG; PAM sequence: AAG
agggaggtctgggcagagaa

SEQ ID NO: 73844 - DNA, 20 bp, Artificial Sequence
  Description of Artificial Sequence: Synthetic oligonucleotide
  Target: ATXN1; (-) strand; PAM type: NRG; PAM sequence: GAG
aatttagggaggtctgggca

SEQ ID NO: 73845 - DNA, 20 bp, Artificial Sequence
  Description of Artificial Sequence: Synthetic oligonucleotide
  Target: ATXN1; (-) strand; PAM type: NRG; PAM sequence: CAG
ctaatttagggaggtctggg

SEQ ID NO: 73846 - DNA, 20 bp, Artificial Sequence
  Description of Artificial Sequence: Synthetic oligonucleotide
  Target: ATXN1; (-) strand; PAM type: NRG; PAM sequence: GGG
atcctaatttagggaggtct

SEQ ID NO: 73847 - DNA, 20 bp, Artificial Sequence
  Description of Artificial Sequence: Synthetic oligonucleotide
  Target: ATXN1; (-) strand; PAM type: NRG; PAM sequence: TGG
aatcctaatttagggaggtc

SEQ ID NO: 73848 - DNA, 20 bp, Artificial Sequence
  Description of Artificial Sequence: Synthetic oligonucleotide
  Target: ATXN1; (-) strand; PAM type: NRG; PAM sequence: AGG
ttgataatcctaatttaggg

SEQ ID NO: 73849 - DNA, 20 bp, Artificial Sequence
  Description of Artificial Sequence: Synthetic oligonucleotide
  Target: ATXN1; (-) strand; PAM type: NRG; PAM sequence: GAG
tttgataatcctaatttagg

SEQ ID NO: 73850 - DNA, 20 bp, Artificial Sequence
  Description of Artificial Sequence: Synthetic oligonucleotide
  Target: ATXN1; (-) strand; PAM type: NRG; PAM sequence: GGG
catttgataatcctaattta

SEQ ID NO: 73851 - DNA, 20 bp, Artificial Sequence
  Description of Artificial Sequence: Synthetic oligonucleotide
  Target: ATXN1; (-) strand; PAM type: NRG; PAM sequence: AGG
tcatttgataatcctaattt

SEQ ID NO: 73852 - DNA, 20 bp, Artificial Sequence
  Description of Artificial Sequence: Synthetic oligonucleotide
  Target: ATXN1; (-) strand; PAM type: NRG; PAM sequence: TAG
gtcatttgataatcctaatt

SEQ ID NO: 73853 - DNA, 20 bp, Artificial Sequence
  Description of Artificial Sequence: Synthetic oligonucleotide
  Target: ATXN1; (-) strand; PAM type: NRG; PAM sequence: AAG
gaataacaacattaaagcag

SEQ ID NO: 73854 - DNA, 20 bp, Artificial Sequence
  Description of Artificial Sequence: Synthetic oligonucleotide
  Target: ATXN1; (-) strand; PAM type: NRG; PAM sequence: CAG
cttgaataacaacattaaag

SEQ ID NO: 73855 - DNA, 20 bp, Artificial Sequence
  Description of Artificial Sequence: Synthetic oligonucleotide
  Target: ATXN1; (-) strand; PAM type: NRG; PAM sequence: AAG
aaccttgaataacaacatta

SEQ ID NO: 73856 - DNA, 20 bp, Artificial Sequence
  Description of Artificial Sequence: Synthetic oligonucleotide
  Target: ATXN1; (-) strand; PAM type: NRG; PAM sequence: GAG
ttatagtaaatattgcctgt

SEQ ID NO: 73857 - DNA, 20 bp, Artificial Sequence
  Description of Artificial Sequence: Synthetic oligonucleotide
  Target: ATXN1; (-) strand; PAM type: NRG; PAM sequence: TAG
ggccaaaccacaagatttta

SEQ ID NO: 73858 - DNA, 20 bp, Artificial Sequence
  Description of Artificial Sequence: Synthetic oligonucleotide
  Target: ATXN1; (-) strand; PAM type: NRG; PAM sequence: AAG
accgtgcccggccaaaccac

SEQ ID NO: 73859 - DNA, 20 bp, Artificial Sequence
  Description of Artificial Sequence: Synthetic oligonucleotide
  Target: ATXN1; (-) strand; PAM type: NRG; PAM sequence: CGG
caggcatgagccaccgtgcc

SEQ ID NO: 73860 - DNA, 20 bp, Artificial Sequence
  Description of Artificial Sequence: Synthetic oligonucleotide
  Target: ATXN1; (-) strand; PAM type: NRG; PAM sequence: GAG
agggctgggattgcaggcat

SEQ ID NO: 73861 - DNA, 20 bp, Artificial Sequence
  Description of Artificial Sequence: Synthetic oligonucleotide
  Target: ATXN1; (-) strand; PAM type: NRG; PAM sequence: AGG
tcccaaagggctgggattgc

SEQ ID NO: 73862 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagggctgggattg

SEQ ID NO: 73863 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagggct

SEQ ID NO: 73864 - DNA, 20 bp, Artificial Sequence
  Description of Artificial Sequence: Synthetic oligonucleotide
  Target: ATXN1; (-) strand; PAM type: NRG; PAM sequence: TGG
tcctcggcctcccaaagggc

SEQ ID NO: 73865 - DNA, 20 bp, Artificial Sequence
  Description of Artificial Sequence: Synthetic oligonucleotide
  Target: ATXN1; (-) strand; PAM type: NRG; PAM sequence: GGG
accctcctcggcctcccaaa

SEQ ID NO: 73866 - DNA, 20 bp, Artificial Sequence
  Description of Artificial Sequence: Synthetic oligonucleotide
  Target: ATXN1; (-) strand; PAM type: NRG; PAM sequence: AGG
caccctcctcggcctcccaa

SEQ ID NO: 73867 - DNA, 20 bp, Artificial Sequence
  Description of Artificial Sequence: Synthetic oligonucleotide
  Target: ATXN1; (-) strand; PAM type: NRG; PAM sequence: AAG
ccaccctcctcggcctccca

SEQ ID NO: 73868 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatccaccctcct

SEQ ID NO: 73869 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctggcctc

SEQ ID NO: 73870 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctggcct

SEQ ID NO: 73871 - DNA, 20 bp, Artificial Sequence
  Description of Artificial Sequence: Synthetic oligonucleotide
  Target: ATXN1; (-) strand; PAM type: NRG; PAM sequence: TGG
ctaggctggtctcgaactcc

SEQ ID NO: 73872 - DNA, 20 bp, Artificial Sequence
  Description of Artificial Sequence: Synthetic oligonucleotide
  Target: ATXN1; (-) strand; PAM type: NRG; PAM sequence: TGG
tttcactatgttggctaggc

SEQ ID NO: 73873 - DNA, 20 bp, Artificial Sequence
  Description of Artificial Sequence: Synthetic oligonucleotide
  Target: ATXN1; (-) strand; PAM type: NRG; PAM sequence: AGG
ggggtttcactatgttggct

SEQ ID NO: 73874 - DNA, 20 bp, Artificial Sequence
  Description of Artificial Sequence: Synthetic oligonucleotide
  Target: ATXN1; (-) strand; PAM type: NRG; PAM sequence: TAG
tggggtttcactatgttggc

SEQ ID NO: 73875 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcactatgt

SEQ ID NO: 73876 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 73877 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 73878 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 73879 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 73880 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 73881 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtatttt

SEQ ID NO: 73882 - DNA, 20 bp, Artificial Sequence
  Description of Artificial Sequence: Synthetic oligonucleotide
  Target: ATXN1; (-) strand; PAM type: NRG; PAM sequence: TGG
caggtgtgcgccactgcacc

SEQ ID NO: 73883 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggactac

SEQ ID NO: 73884 - DNA, 20 bp, Artificial Sequence
  Description of Artificial Sequence: Synthetic oligonucleotide
  Target: ATXN1; (-) strand; PAM type: NRG; PAM sequence: CAG
ttcccaagtagctgggacta

SEQ ID NO: 73885 - DNA, 20 bp, Artificial Sequence
  Description of Artificial Sequence: Synthetic oligonucleotide
  Target: ATXN1; (-) strand; PAM type: NRG; PAM sequence: GGG
cctcagcttcccaagtagct

SEQ ID NO: 73886 - DNA, 20 bp, Artificial Sequence
  Description of Artificial Sequence: Synthetic oligonucleotide
  Target: ATXN1; (-) strand; PAM type: NRG; PAM sequence: TGG
gcctcagcttcccaagtagc

SEQ ID NO: 73887 - DNA, 20 bp, Artificial Sequence
  Description of Artificial Sequence: Synthetic oligonucleotide
  Target: ATXN1; (-) strand; PAM type: NRG; PAM sequence: TAG
ttttgcctcagcttcccaag

SEQ ID NO: 73888 - DNA, 20 bp, Artificial Sequence
  Description of Artificial Sequence: Synthetic oligonucleotide
  Target: ATXN1; (-) strand; PAM type: NRG; PAM sequence: AAG
tccttttgcctcagcttccc

SEQ ID NO: 73889 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaatccttttgcct

SEQ ID NO: 73890 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccaggttc

SEQ ID NO: 73891 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctctgcctccc

SEQ ID NO: 73892 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctctgcctcc

SEQ ID NO: 73893 - DNA, 20 bp, Artificial Sequence
  Description of Artificial Sequence: Synthetic oligonucleotide
  Target: ATXN1; (-) strand; PAM type: NRG; PAM sequence: CGG
ggagtgcaatggcacgatct

SEQ ID NO: 73894 - DNA, 20 bp, Artificial Sequence
  Description of Artificial Sequence: Synthetic oligonucleotide
  Target: ATXN1; (-) strand; PAM type: NRG; PAM sequence: TGG
ttgcccaagctggagtgcaa

SEQ ID NO: 73895 - DNA, 20 bp, Artificial Sequence
  Description of Artificial Sequence: Synthetic oligonucleotide
  Target: ATXN1; (-) strand; PAM type: NRG; PAM sequence: GAG
ttgctctgttgcccaagctg

SEQ ID NO: 73896 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgttgcccaagc

SEQ ID NO: 73897 - DNA, 20 bp, Artificial Sequence
  Description of Artificial Sequence: Synthetic oligonucleotide
  Target: ATXN1; (-) strand; PAM type: NRG; PAM sequence: AAG
agagtcttgctctgttgccc

SEQ ID NO: 73898 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 73899 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaga

SEQ ID NO: 73900 - DNA, 20 bp, Artificial Sequence
  Description of Artificial Sequence: Synthetic oligonucleotide
  Target: ATXN1; (-) strand; PAM type: NRG; PAM sequence: GAG
cctttttttttttttttttt

SEQ ID NO: 73901 - DNA, 20 bp, Artificial Sequence
  Description of Artificial Sequence: Synthetic oligonucleotide
  Target: ATXN1; (-) strand; PAM type: NRG; PAM sequence: CGG
attgtccactctctgttaag

SEQ ID NO: 73902 - DNA, 20 bp, Artificial Sequence
  Description of Artificial Sequence: Synthetic oligonucleotide
  Target: ATXN1; (-) strand; PAM type: NRG; PAM sequence: AAG
agaattgtccactctctgtt

SEQ ID NO: 73903 - DNA, 20 bp, Artificial Sequence
  Description of Artificial Sequence: Synthetic oligonucleotide
  Target: ATXN1; (-) strand; PAM type: NRG; PAM sequence: CAG
tattctggtaagccctgtaa

SEQ ID NO: 73904 - DNA, 20 bp, Artificial Sequence
  Description of Artificial Sequence: Synthetic oligonucleotide
  Target: ATXN1; (-) strand; PAM type: NRG; PAM sequence: AAG
ttttccaaaaatattctggt

SEQ ID NO: 73905 - DNA, 20 bp, Artificial Sequence
  Description of Artificial Sequence: Synthetic oligonucleotide
  Target: ATXN1; (-) strand; PAM type: NRG; PAM sequence: TGG
gaatttttccaaaaatattc

SEQ ID NO: 73906 - DNA, 20 bp, Artificial Sequence
  Description of Artificial Sequence: Synthetic oligonucleotide
  Target: ATXN1; (-) strand; PAM type: NRG; PAM sequence: CAG
cagaaattcttctatgttta

SEQ ID NO: 73907 - DNA, 20 bp, Artificial Sequence
  Description of Artificial Sequence: Synthetic oligonucleotide
  Target: ATXN1; (-) strand; PAM type: NRG; PAM sequence: CAG
tgcttctcatttttctggct

SEQ ID NO: 73908 - DNA, 20 bp, Artificial Sequence
  Description of Artificial Sequence: Synthetic oligonucleotide
  Target: ATXN1; (-) strand; PAM type: NRG; PAM sequence: TGG
ttttctgcttctcatttttc

SEQ ID NO: 73909 - DNA, 20 bp, Artificial Sequence
  Description of Artificial Sequence: Synthetic oligonucleotide
  Target: ATXN1; (-) strand; PAM type: NRG; PAM sequence: AGG
tagagaagcagtcatatcag

SEQ ID NO: 73910 - DNA, 20 bp, Artificial Sequence
  Description of Artificial Sequence: Synthetic oligonucleotide
  Target: ATXN1; (-) strand; PAM type: NRG; PAM sequence: GAG
ttagagaagcagtcatatca

SEQ ID NO: 73911 - DNA, 20 bp, Artificial Sequence
  Description of Artificial Sequence: Synthetic oligonucleotide
  Target: ATXN1; (-) strand; PAM type: NRG; PAM sequence: CAG
gcttagagaagcagtcatat

SEQ ID NO: 73912 - DNA, 20 bp, Artificial Sequence
  Description of Artificial Sequence: Synthetic oligonucleotide
  Target: ATXN1; (-) strand; PAM type: NRG; PAM sequence: CAG
gtggaaatagcttagagaag

SEQ ID NO: 73913 - DNA, 20 bp, Artificial Sequence
  Description of Artificial Sequence: Synthetic oligonucleotide
  Target: ATXN1; (-) strand; PAM type: NRG; PAM sequence: AAG
catgtggaaatagcttagag

SEQ ID NO: 73914 - DNA, 20 bp, Artificial Sequence
  Description of Artificial Sequence: Synthetic oligonucleotide
  Target: ATXN1; (-) strand; PAM type: NRG; PAM sequence: GAG
tcacatgtggaaatagctta

SEQ ID NO: 73915 - DNA, 20 bp, Artificial Sequence
  Description of Artificial Sequence: Synthetic oligonucleotide
  Target: ATXN1; (-) strand; PAM type: NRG; PAM sequence: TAG
aatcacatgtggaaatagct

SEQ ID NO: 73916 - DNA, 20 bp, Artificial Sequence
  Description of Artificial Sequence: Synthetic oligonucleotide
  Target: ATXN1; (-) strand; PAM type: NRG; PAM sequence: TAG
acagtaatcacatgtggaaa

SEQ ID NO: 73917 - DNA, 20 bp, Artificial Sequence
  Description of Artificial Sequence: Synthetic oligonucleotide
  Target: ATXN1; (-) strand; PAM type: NRG; PAM sequence: TGG
tcagagacagtaatcacatg

SEQ ID NO: 73918 - DNA, 20 bp, Artificial Sequence
  Description of Artificial Sequence: Synthetic oligonucleotide
  Target: ATXN1; (-) strand; PAM type: NRG; PAM sequence: CAG
atggagtgagctctcagaga

SEQ ID NO: 73919 - DNA, 20 bp, Artificial Sequence
  Description of Artificial Sequence: Synthetic oligonucleotide
  Target: ATXN1; (-) strand; PAM type: NRG; PAM sequence: GAG
tggcatggagtgagctctca

SEQ ID NO: 73920 - DNA, 20 bp, Artificial Sequence
  Description of Artificial Sequence: Synthetic oligonucleotide
  Target: ATXN1; (-) strand; PAM type: NRG; PAM sequence: CAG
tatggcatggagtgagctct

SEQ ID NO: 73921 - DNA, 20 bp, Artificial Sequence
  Description of Artificial Sequence: Synthetic oligonucleotide
  Target: ATXN1; (-) strand; PAM type: NRG; PAM sequence: GAG
aatttcttatggcatggagt

SEQ ID NO: 73922 - DNA, 20 bp, Artificial Sequence
  Description of Artificial Sequence: Synthetic oligonucleotide
  Target: ATXN1; (-) strand; PAM type: NRG; PAM sequence: GAG
ctgcaatttcttatggcatg

SEQ ID NO: 73923 - DNA, 20 bp, Artificial Sequence
  Description of Artificial Sequence: Synthetic oligonucleotide
  Target: ATXN1; (-) strand; PAM type: NRG; PAM sequence: TGG
ctctgcaatttcttatggca

SEQ ID NO: 73924 - DNA, 20 bp, Artificial Sequence
  Description of Artificial Sequence: Synthetic oligonucleotide
  Target: ATXN1; (-) strand; PAM type: NRG; PAM sequence: TGG
tataactctgcaatttctta

SEQ ID NO: 73925 - DNA, 20 bp, Artificial Sequence
  Description of Artificial Sequence: Synthetic oligonucleotide
  Target: ATXN1; (-) strand; PAM type: NRG; PAM sequence: GAG
aaaatgttttgtaaattgta

SEQ ID NO: 73926 - DNA, 20 bp, Artificial Sequence
  Description of Artificial Sequence: Synthetic oligonucleotide
  Target: ATXN1; (-) strand; PAM type: NRG; PAM sequence: TAG
tgaaaatgttttgtaaattg

SEQ ID NO: 73927 - DNA, 20 bp, Artificial Sequence
  Description of Artificial Sequence: Synthetic oligonucleotide
  Target: ATXN1; (-) strand; PAM type: NRG; PAM sequence: GAG
gggtattgtgatgatcaaat

SEQ ID NO: 73928 - DNA, 20 bp, Artificial Sequence
  Description of Artificial Sequence: Synthetic oligonucleotide
  Target: ATXN1; (-) strand; PAM type: NRG; PAM sequence: GGG
ttataatatctgtctcacag

SEQ ID NO: 73929 - DNA, 20 bp, Artificial Sequence
  Description of Artificial Sequence: Synthetic oligonucleotide
  Target: ATXN1; (-) strand; PAM type: NRG; PAM sequence: GGG
attataatatctgtctcaca

SEQ ID NO: 73930 - DNA, 20 bp, Artificial Sequence
  Description of Artificial Sequence: Synthetic oligonucleotide
  Target: ATXN1; (-) strand; PAM type: NRG; PAM sequence: AGG
aattataatatctgtctcac

SEQ ID NO: 73931 - DNA, 20 bp, Artificial Sequence
  Description of Artificial Sequence: Synthetic oligonucleotide
  Target: ATXN1; (-) strand; PAM type: NRG; PAM sequence: CAG
taattataatatctgtctca

SEQ ID NO: 73932 - DNA, 20 bp, Artificial Sequence
  Description of Artificial Sequence: Synthetic oligonucleotide
  Target: ATXN1; (-) strand; PAM type: NRG; PAM sequence: TAG
ttttccgcatctctataaaa

SEQ ID NO: 73933 - DNA, 20 bp, Artificial Sequence
  Description of Artificial Sequence: Synthetic oligonucleotide
  Target: ATXN1; (-) strand; PAM type: NRG; PAM sequence: GGG
ggaaatcactcaaaatctga

SEQ ID NO: 73934 - DNA, 20 bp, Artificial Sequence
  Description of Artificial Sequence: Synthetic oligonucleotide
  Target: ATXN1; (-) strand; PAM type: NRG; PAM sequence: AGG
gggaaatcactcaaaatctg

SEQ ID NO: 73935 - DNA, 20 bp, Artificial Sequence
  Description of Artificial Sequence: Synthetic oligonucleotide
  Target: ATXN1; (-) strand; PAM type: NRG; PAM sequence: GAG
agggaaatcactcaaaatct

SEQ ID NO: 73936 - DNA, 20 bp, Artificial Sequence
  Description of Artificial Sequence: Synthetic oligonucleotide
  Target: ATXN1; (-) strand; PAM type: NRG; PAM sequence: GGG
ttatcagctttgtgacctta

SEQ ID NO: 73937 - DNA, 20 bp, Artificial Sequence
  Description of Artificial Sequence: Synthetic oligonucleotide
  Target: ATXN1; (-) strand; PAM type: NRG; PAM sequence: AGG
cttatcagctttgtgacctt

SEQ ID NO: 73938 - DNA, 20 bp, Artificial Sequence
  Description of Artificial Sequence: Synthetic oligonucleotide
  Target: ATXN1; (-) strand; PAM type: NRG; PAM sequence: TAG
acttatcagctttgtgacct

SEQ ID NO: 73939 - DNA, 20 bp, Artificial Sequence
  Description of Artificial Sequence: Synthetic oligonucleotide
  Target: ATXN1; (-) strand; PAM type: NRG; PAM sequence: CAG
atctcagttctgcaacttat

SEQ ID NO: 73940 - DNA, 20 bp, Artificial Sequence
  Description of Artificial Sequence: Synthetic oligonucleotide
  Target: ATXN1; (-) strand; PAM type: NRG; PAM sequence: CAG
gaaattctagttttgaatct

SEQ ID NO: 73941 - DNA, 20 bp, Artificial Sequence
  Description of Artificial Sequence: Synthetic oligonucleotide
  Target: ATXN1; (-) strand; PAM type: NRG; PAM sequence: TAG
aaatacaatatcagaaattc

SEQ ID NO: 73942 - DNA, 20 bp, Artificial Sequence
  Description of Artificial Sequence: Synthetic oligonucleotide
  Target: ATXN1; (-) strand; PAM type: NRG; PAM sequence: CAG
gagaaaatgaaatacaatat

SEQ ID NO: 73943 - DNA, 20 bp, Artificial Sequence
  Description of Artificial Sequence: Synthetic oligonucleotide
  Target: ATXN1; (-) strand; PAM type: NRG; PAM sequence: GAG
taataaaattaatgtagtgg

SEQ ID NO: 73944 - DNA, 20 bp, Artificial Sequence
  Description of Artificial Sequence: Synthetic oligonucleotide
  Target: ATXN1; (-) strand; PAM type: NRG; PAM sequence: GGG
tgtaataaaattaatgtagt

SEQ ID NO: 73945 - DNA, 20 bp, Artificial Sequence
  Description of Artificial Sequence: Synthetic oligonucleotide
  Target: ATXN1; (-) strand; PAM type: NRG; PAM sequence: TGG
atgtaataaaattaatgtag

SEQ ID NO: 73946 - DNA, 20 bp, Artificial Sequence
  Description of Artificial Sequence: Synthetic oligonucleotide
  Target: ATXN1; (-) strand; PAM type: NRG; PAM sequence: TAG
aaaatgtaataaaattaatg

SEQ ID NO: 73947 - DNA, 20 bp, Artificial Sequence
  Description of Artificial Sequence: Synthetic oligonucleotide
  Target: ATXN1; (-) strand; PAM type: NRG; PAM sequence: AAG
atagaaccaaaaatgaattc

SEQ ID NO: 73948 - DNA, 20 bp, Artificial Sequence
  Description of Artificial Sequence: Synthetic oligonucleotide
  Target: ATXN1; (-) strand; PAM type: NRG; PAM sequence: TAG
tagagtctactattataaaa

SEQ ID NO: 73949 - DNA, 20 bp, Artificial Sequence
  Description of Artificial Sequence: Synthetic oligonucleotide
  Target: ATXN1; (-) strand; PAM type: NRG; PAM sequence: GAG
tgtaatgagcagaatttata

SEQ ID NO: 73950 - DNA, 20 bp, Artificial Sequence
  Description of Artificial Sequence: Synthetic oligonucleotide
  Target: ATXN1; (-) strand; PAM type: NRG; PAM sequence: TAG
tatgtaatgagcagaattta

SEQ ID NO: 73951 - DNA, 20 bp, Artificial Sequence
  Description of Artificial Sequence: Synthetic oligonucleotide
  Target: ATXN1; (-) strand; PAM type: NRG; PAM sequence: CAG
taaaatgtttatgtaatgag

SEQ ID NO: 73952 - DNA, 20 bp, Artificial Sequence
  Description of Artificial Sequence: Synthetic oligonucleotide
  Target: ATXN1; (-) strand; PAM type: NRG; PAM sequence: GAG
acataaaatgtttatgtaat

SEQ ID NO: 73953 - DNA, 20 bp, Artificial Sequence
  Description of Artificial Sequence: Synthetic oligonucleotide
  Target: ATXN1; (-) strand; PAM type: NRG; PAM sequence: AAG
aaagagtcagtttcatttag

SEQ ID NO: 73954 - DNA, 20 bp, Artificial Sequence
  Description of Artificial Sequence: Synthetic oligonucleotide
  Target: ATXN1; (-) strand; PAM type: NRG; PAM sequence: TAG
attaaagagtcagtttcatt

SEQ ID NO: 73955 - DNA, 20 bp, Artificial Sequence
  Description of Artificial Sequence: Synthetic oligonucleotide
  Target: ATXN1; (-) strand; PAM type: NRG; PAM sequence: CAG
aaatttagagattaaagagt

SEQ ID NO: 73956 - DNA, 20 bp, Artificial Sequence
  Description of Artificial Sequence: Synthetic oligonucleotide
  Target: ATXN1; (-) strand; PAM type: NRG; PAM sequence: GAG
caaaaaatttagagattaaa

SEQ ID NO: 73957 - DNA, 20 bp, Artificial Sequence
  Description of Artificial Sequence: Synthetic oligonucleotide
  Target: ATXN1; (-) strand; PAM type: NRG; PAM sequence: AAG
accaaaaaatttagagatta

SEQ ID NO: 73958 - DNA, 20 bp, Artificial Sequence
  Description of Artificial Sequence: Synthetic oligonucleotide
  Target: ATXN1; (-) strand; PAM type: NRG; PAM sequence: GAG
gaacgttaccaaaaaattta

SEQ ID NO: 73959 - DNA, 20 bp, Artificial Sequence
  Description of Artificial Sequence: Synthetic oligonucleotide
  Target: ATXN1; (-) strand; PAM type: NRG; PAM sequence: TAG
tagaacgttaccaaaaaatt

SEQ ID NO: 73960 - DNA, 20 bp, Artificial Sequence
  Description of Artificial Sequence: Synthetic oligonucleotide
  Target: ATXN1; (-) strand; PAM type: NRG; PAM sequence: TAG
attttagtttaaccagaaaa

SEQ ID NO: 73961 - DNA, 20 bp, Artificial Sequence
  Description of Artificial Sequence: Synthetic oligonucleotide
  Target: ATXN1; (-) strand; PAM type: NRG; PAM sequence: CAG
cctgggcattttagtttaac

SEQ ID NO: 73962 - DNA, 20 bp, Artificial Sequence
  Description of Artificial Sequence: Synthetic oligonucleotide
  Target: ATXN1; (-) strand; PAM type: NRG; PAM sequence: TAG
ataagggaacctgggcattt

SEQ ID NO: 73963 - DNA, 20 bp, Artificial Sequence
  Description of Artificial Sequence: Synthetic oligonucleotide
  Target: ATXN1; (-) strand; PAM type: NRG; PAM sequence: GGG
agcagatgataagggaacct

SEQ ID NO: 73964 - DNA, 20 bp, Artificial Sequence
  Description of Artificial Sequence: Synthetic oligonucleotide
  Target: ATXN1; (-) strand; PAM type: NRG; PAM sequence: TGG
aagcagatgataagggaacc

SEQ ID NO: 73965 - DNA, 20 bp, Artificial Sequence
  Description of Artificial Sequence: Synthetic oligonucleotide
  Target: ATXN1; (-) strand; PAM type: NRG; PAM sequence: GGG
ataaagaaagcagatgataa

SEQ ID NO: 73966 - DNA, 20 bp, Artificial Sequence
  Description of Artificial Sequence: Synthetic oligonucleotide
  Target: ATXN1; (-) strand; PAM type: NRG; PAM sequence: AGG
aataaagaaagcagatgata

SEQ ID NO: 73967 - DNA, 20 bp, Artificial Sequence
  Description of Artificial Sequence: Synthetic oligonucleotide
  Target: ATXN1; (-) strand; PAM type: NRG; PAM sequence: AAG
gaataaagaaagcagatgat

SEQ ID NO: 73968 - DNA, 20 bp, Artificial Sequence
  Description of Artificial Sequence: Synthetic oligonucleotide
  Target: ATXN1; (-) strand; PAM type: NRG; PAM sequence: CAG
attccagggaataaagaaag

SEQ ID NO: 73969 - DNA, 20 bp, Artificial Sequence
  Description of Artificial Sequence: Synthetic oligonucleotide
  Target: ATXN1; (-) strand; PAM type: NRG; PAM sequence: AAG
aagattccagggaataaaga

SEQ ID NO: 73970 - DNA, 20 bp, Artificial Sequence
  Description of Artificial Sequence: Synthetic oligonucleotide
  Target: ATXN1; (-) strand; PAM type: NRG; PAM sequence: AAG
aaggaagattccagggaata

SEQ ID NO: 73971 - DNA, 20 bp, Artificial Sequence
  Description of Artificial Sequence: Synthetic oligonucleotide
  Target: ATXN1; (-) strand; PAM type: NRG; PAM sequence: GGG
ctctcaaaaggaagattcca

SEQ ID NO: 73972 - DNA, 20 bp, Artificial Sequence
  Description of Artificial Sequence: Synthetic oligonucleotide
  Target: ATXN1; (-) strand; PAM type: NRG; PAM sequence: AGG
tctctcaaaaggaagattcc

SEQ ID NO: 73973 - DNA, 20 bp, Artificial Sequence
  Description of Artificial Sequence: Synthetic oligonucleotide
  Target: ATXN1; (-) strand; PAM type: NRG; PAM sequence: CAG
atctctcaaaaggaagattc

SEQ ID NO: 73974 - DNA, 20 bp, Artificial Sequence
  Description of Artificial Sequence: Synthetic oligonucleotide
  Target: ATXN1; (-) strand; PAM type: NRG; PAM sequence: AAG
acatcatatctctcaaaagg

SEQ ID NO: 73975 - DNA, 20 bp, Artificial Sequence
  Description of Artificial Sequence: Synthetic oligonucleotide
  Target: ATXN1; (-) strand; PAM type: NRG; PAM sequence: AGG
ggaacatcatatctctcaaa

SEQ ID NO: 73976 - DNA, 20 bp, Artificial Sequence
  Description of Artificial Sequence: Synthetic oligonucleotide
  Target: ATXN1; (-) strand; PAM type: NRG; PAM sequence: AAG
tggaacatcatatctctcaa

SEQ ID NO: 73977 - DNA, 20 bp, Artificial Sequence
  Description of Artificial Sequence: Synthetic oligonucleotide
  Target: ATXN1; (-) strand; PAM type: NRG; PAM sequence: TGG
atcctcagatcctcagataa

SEQ ID NO: 73978 - DNA, 20 bp, Artificial Sequence
  Description of Artificial Sequence: Synthetic oligonucleotide
  Target: ATXN1; (-) strand; PAM type: NRG; PAM sequence: CAG
gttagaaatcctcagatcct

SEQ ID NO: 73979 - DNA, 20 bp, Artificial Sequence
  Description of Artificial Sequence: Synthetic oligonucleotide
  Target: ATXN1; (-) strand; PAM type: NRG; PAM sequence: CAG
tcaacatagttagaaatcct

SEQ ID NO: 73980 - DNA, 20 bp, Artificial Sequence
  Description of Artificial Sequence: Synthetic oligonucleotide
  Target: ATXN1; (-) strand; PAM type: NRG; PAM sequence: TAG
ggaagatttgtcaacatagt

SEQ ID NO: 73981 - DNA, 20 bp, Artificial Sequence
  Description of Artificial Sequence: Synthetic oligonucleotide
  Target: ATXN1; (-) strand; PAM type: NRG; PAM sequence: TAG
aaaaggaagatttgtcaaca

SEQ ID NO: 73982 - DNA, 20 bp, Artificial Sequence
  Description of Artificial Sequence: Synthetic oligonucleotide
  Target: ATXN1; (-) strand; PAM type: NRG; PAM sequence: AAG
agtttttaaaaagcaaaagg

SEQ ID NO: 73983 - DNA, 20 bp, Artificial Sequence
  Description of Artificial Sequence: Synthetic oligonucleotide
  Target: ATXN1; (-) strand; PAM type: NRG; PAM sequence: AGG
aacagtttttaaaaagcaaa

SEQ ID NO: 73984 - DNA, 20 bp, Artificial Sequence
  Description of Artificial Sequence: Synthetic oligonucleotide
  Target: ATXN1; (-) strand; PAM type: NRG; PAM sequence: AAG
caacagtttttaaaaagcaa

SEQ ID NO: 73985 - DNA, 20 bp, Artificial Sequence
  Description of Artificial Sequence: Synthetic oligonucleotide
  Target: ATXN1; (-) strand; PAM type: NRG; PAM sequence: AAG
gtgcagcaacagtttttaaa

SEQ ID NO: 73986 - DNA, 20 bp, Artificial Sequence
  Description of Artificial Sequence: Synthetic oligonucleotide
  Target: ATXN1; (-) strand; PAM type: NRG; PAM sequence: CAG
ctcagcaatatgtgcagcaa

SEQ ID NO: 73987 - DNA, 20 bp, Artificial Sequence
  Description of Artificial Sequence: Synthetic oligonucleotide
  Target: ATXN1; (-) strand; PAM type: NRG; PAM sequence: CAG
aagctactcagcaatatgtg

SEQ ID NO: 73988 - DNA, 20 bp, Artificial Sequence
  Description of Artificial Sequence: Synthetic oligonucleotide
  Target: ATXN1; (-) strand; PAM type: NRG; PAM sequence: CAG
ggataaatttgaaagctact

SEQ ID NO: 73989 - DNA, 20 bp, Artificial Sequence
  Description of Artificial Sequence: Synthetic oligonucleotide
  Target: ATXN1; (-) strand; PAM type: NRG; PAM sequence: AAG
gtcgtagtggataaatttga

SEQ ID NO: 73990 - DNA, 20 bp, Artificial Sequence
  Description of Artificial Sequence: Synthetic oligonucleotide
  Target: ATXN1; (-) strand; PAM type: NRG; PAM sequence: TGG
tatgagcgtggaagtcgtag

SEQ ID NO: 73991 - DNA, 20 bp, Artificial Sequence
  Description of Artificial Sequence: Synthetic oligonucleotide
  Target: ATXN1; (-) strand; PAM type: NRG; PAM sequence: TAG
ggatatgagcgtggaagtcg

SEQ ID NO: 73992 - DNA, 20 bp, Artificial Sequence
  Description of Artificial Sequence: Synthetic oligonucleotide
  Target: ATXN1; (-) strand; PAM type: NRG; PAM sequence: AAG
atattaggatatgagcgtgg

SEQ ID NO: 73993 - DNA, 20 bp, Artificial Sequence
  Description of Artificial Sequence: Synthetic oligonucleotide
  Target: ATXN1; (-) strand; PAM type: NRG; PAM sequence: TGG
taaatattaggatatgagcg

SEQ ID NO: 73994 - DNA, 20 bp, Artificial Sequence
  Description of Artificial Sequence: Synthetic oligonucleotide
  Target: ATXN1; (-) strand; PAM type: NRG; PAM sequence: GAG
tgtgataaatattaggatat

SEQ ID NO: 73995 - DNA, 20 bp, Artificial Sequence
  Description of Artificial Sequence: Synthetic oligonucleotide
  Target: ATXN1; (-) strand; PAM type: NRG; PAM sequence: AGG
tagccattgtgataaatatt

SEQ ID NO: 73996 - DNA, 20 bp, Artificial Sequence
  Description of Artificial Sequence: Synthetic oligonucleotide
  Target: ATXN1; (-) strand; PAM type: NRG; PAM sequence: TAG
gtagccattgtgataaatat

SEQ ID NO: 73997 - DNA, 20 bp, Artificial Sequence
  Description of Artificial Sequence: Synthetic oligonucleotide
  Target: ATXN1; (-) strand; PAM type: NRG; PAM sequence: TAG
tcagattttctggaatgggg

SEQ ID NO: 73998 - DNA, 20 bp, Artificial Sequence
  Description of Artificial Sequence: Synthetic oligonucleotide
  Target: ATXN1; (-) strand; PAM type: NRG; PAM sequence: GGG
tcttcagattttctggaatg

SEQ ID NO: 73999 - DNA, 20 bp, Artificial Sequence
  Description of Artificial Sequence: Synthetic oligonucleotide
  Target: ATXN1; (-) strand; PAM type: NRG; PAM sequence: GGG
ctcttcagattttctggaat

SEQ ID NO: 74000 - DNA, 20 bp, Artificial Sequence
  Description of Artificial Sequence: Synthetic oligonucleotide
  Target: ATXN1; (-) strand; PAM type: NRG; PAM sequence: TGG
actcttcagattttctggaa

SEQ ID NO: 74001 - DNA, 20 bp, Artificial Sequence
  Description of Artificial Sequence: Synthetic oligonucleotide
  Target: ATXN1; (-) strand; PAM type: NRG; PAM sequence: TGG
gtagaactcttcagattttc

SEQ ID NO: 74002 - DNA, 20 bp, Artificial Sequence
  Description of Artificial Sequence: Synthetic oligonucleotide
  Target: ATXN1; (-) strand; PAM type: NRG; PAM sequence: CAG
agtacaaatgtagaactctt

SEQ ID NO: 74003 - DNA, 20 bp, Artificial Sequence
  Description of Artificial Sequence: Synthetic oligonucleotide
  Target: ATXN1; (-) strand; PAM type: NRG; PAM sequence: TAG
gatgtggttgagtacaaatg

SEQ ID NO: 74004 - DNA, 20 bp, Artificial Sequence
  Description of Artificial Sequence: Synthetic oligonucleotide
  Target: ATXN1; (-) strand; PAM type: NRG; PAM sequence: GAG
ttcgagaagtagatgtggtt

SEQ ID NO: 74005 - DNA, 20 bp, Artificial Sequence
  Description of Artificial Sequence: Synthetic oligonucleotide
  Target: ATXN1; (-) strand; PAM type: NRG; PAM sequence: TGG
gaagattcgagaagtagatg

SEQ ID NO: 74006 - DNA, 20 bp, Artificial Sequence
  Description of Artificial Sequence: Synthetic oligonucleotide
  Target: ATXN1; (-) strand; PAM type: NRG; PAM sequence: TAG
gagaaagaagattcgagaag

SEQ ID NO: 74007 - DNA, 20 bp, Artificial Sequence
  Description of Artificial Sequence: Synthetic oligonucleotide
  Target: ATXN1; (-) strand; PAM type: NRG; PAM sequence: AAG
acagagaaagaagattcgag

SEQ ID NO: 74008 - DNA, 20 bp, Artificial Sequence
  Description of Artificial Sequence: Synthetic oligonucleotide
  Target: ATXN1; (-) strand; PAM type: NRG; PAM sequence: GAG
gtgacagagaaagaagattc

SEQ ID NO: 74009 - DNA, 20 bp, Artificial Sequence
  Description of Artificial Sequence: Synthetic oligonucleotide
  Target: ATXN1; (-) strand; PAM type: NRG; PAM sequence: AAG
aataacagtgacagagaaag

SEQ ID NO: 74010 - DNA, 20 bp, Artificial Sequence
  Description of Artificial Sequence: Synthetic oligonucleotide
  Target: ATXN1; (-) strand; PAM type: NRG; PAM sequence: AAG
gggaataacagtgacagaga

SEQ ID NO: 74011 - DNA, 20 bp, Artificial Sequence
  Description of Artificial Sequence: Synthetic oligonucleotide
  Target: ATXN1; (-) strand; PAM type: NRG; PAM sequence: GAG
tcttgggaataacagtgaca

SEQ ID NO: 74012 - DNA, 20 bp, Artificial Sequence
  Description of Artificial Sequence: Synthetic oligonucleotide
  Target: ATXN1; (-) strand; PAM type: NRG; PAM sequence: CAG
gatcttgggaataacagtga

SEQ ID NO: 74013 - DNA, 20 bp, Artificial Sequence
  Description of Artificial Sequence: Synthetic oligonucleotide
  Target: ATXN1; (-) strand; PAM type: NRG; PAM sequence: CAG
ttccaggatcttgggaataa

SEQ ID NO: 74014 - DNA, 20 bp, Artificial Sequence
  Description of Artificial Sequence: Synthetic oligonucleotide
  Target: ATXN1; (-) strand; PAM type: NRG; PAM sequence: GGG
ctgtttaattccaggatctt

SEQ ID NO: 74015 - DNA, 20 bp, Artificial Sequence
  Description of Artificial Sequence: Synthetic oligonucleotide
  Target: ATXN1; (-) strand; PAM type: NRG; PAM sequence: TGG
tctgtttaattccaggatct

SEQ ID NO: 74016 - DNA, 20 bp, Artificial Sequence
  Description of Artificial Sequence: Synthetic oligonucleotide
  Target: ATXN1; (-) strand; PAM type: NRG; PAM sequence: AGG
aaactcttctgtttaattcc

SEQ ID NO: 74017 - DNA, 20 bp, Artificial Sequence
  Description of Artificial Sequence: Synthetic oligonucleotide
  Target: ATXN1; (-) strand; PAM type: NRG; PAM sequence: CAG
aaaactcttctgtttaattc

SEQ ID NO: 74018 - DNA, 20 bp, Artificial Sequence
  Description of Artificial Sequence: Synthetic oligonucleotide
  Target: ATXN1; (-) strand; PAM type: NRG; PAM sequence: AGG
gatgaactgactgaccagaa

SEQ ID NO: 74019 - DNA, 20 bp, Artificial Sequence
  Description of Artificial Sequence: Synthetic oligonucleotide
  Target: ATXN1; (-) strand; PAM type: NRG; PAM sequence: AAG
ggatgaactgactgaccaga

SEQ ID NO: 74020 - DNA, 20 bp, Artificial Sequence
  Description of Artificial Sequence: Synthetic oligonucleotide
  Target: ATXN1; (-) strand; PAM type: NRG; PAM sequence: CAG
ggaaggatgaactgactgac

SEQ ID NO: 74021 - DNA, 20 bp, Artificial Sequence
  Description of Artificial Sequence: Synthetic oligonucleotide
  Target: ATXN1; (-) strand; PAM type: NRG; PAM sequence: AGG
ccctttgggctggctctgga

SEQ ID NO: 74022 - DNA, 20 bp, Artificial Sequence
  Description of Artificial Sequence: Synthetic oligonucleotide
  Target: ATXN1; (-) strand; PAM type: NRG; PAM sequence: AAG
accctttgggctggctctgg

SEQ ID NO: 74023 - DNA, 20 bp, Artificial Sequence
  Description of Artificial Sequence: Synthetic oligonucleotide
  Target: ATXN1; (-) strand; PAM type: NRG; PAM sequence: TGG
agcaccctttgggctggctc

SEQ ID NO: 74024 - DNA, 20 bp, Artificial Sequence
  Description of Artificial Sequence: Synthetic oligonucleotide
  Target: ATXN1; (-) strand; PAM type: NRG; PAM sequence: TGG
tgttaaagcaccctttgggc

SEQ ID NO: 74025 - DNA, 20 bp, Artificial Sequence
  Description of Artificial Sequence: Synthetic oligonucleotide
  Target: ATXN1; (-) strand; PAM type: NRG; PAM sequence: GGG
gtgatgttaaagcacccttt

SEQ ID NO: 74026 - DNA, 20 bp, Artificial Sequence
  Description of Artificial Sequence: Synthetic oligonucleotide
  Target: ATXN1; (-) strand; PAM type: NRG; PAM sequence: TGG
agtgatgttaaagcaccctt

SEQ ID NO: 74027 - DNA, 20 bp, Artificial Sequence
  Description of Artificial Sequence: Synthetic oligonucleotide
  Target: ATXN1; (-) strand; PAM type: NRG; PAM sequence: AAG
gctgagaaggagtgatgtta

SEQ ID NO: 74028 - DNA, 20 bp, Artificial Sequence
  Description of Artificial Sequence: Synthetic oligonucleotide
  Target: ATXN1; (-) strand; PAM type: NRG; PAM sequence: GAG
gaaagtactcagctgagaag

SEQ ID NO: 74029 - DNA, 20 bp, Artificial Sequence
  Description of Artificial Sequence: Synthetic oligonucleotide
  Target: ATXN1; (-) strand; PAM type: NRG; PAM sequence: AGG
cagaaagtactcagctgaga

SEQ ID NO: 74030 - DNA, 20 bp, Artificial Sequence
  Description of Artificial Sequence: Synthetic oligonucleotide
  Target: ATXN1; (-) strand; PAM type: NRG; PAM sequence: AAG
tcagaaagtactcagctgag

SEQ ID NO: 74031 - DNA, 20 bp, Artificial Sequence
  Description of Artificial Sequence: Synthetic oligonucleotide
  Target: ATXN1; (-) strand; PAM type: NRG; PAM sequence: GAG
acatcagaaagtactcagct

SEQ ID NO: 74032 - DNA, 20 bp, Artificial Sequence
  Description of Artificial Sequence: Synthetic oligonucleotide
  Target: ATXN1; (-) strand; PAM type: NRG; PAM sequence: CAG
ttataacatcagaaagtact

SEQ ID NO: 74033 - DNA, 20 bp, Artificial Sequence
  Description of Artificial Sequence: Synthetic oligonucleotide
  Target: ATXN1; (-) strand; PAM type: NRG; PAM sequence: AAG
aagcatgttataacatcaga

SEQ ID NO: 74034 - DNA, 20 bp, Artificial Sequence
  Description of Artificial Sequence: Synthetic oligonucleotide
  Target: ATXN1; (-) strand; PAM type: NRG; PAM sequence: CAG
aggtaagcatgttataacat

SEQ ID NO: 74035 - DNA, 20 bp, Artificial Sequence
  Description of Artificial Sequence: Synthetic oligonucleotide
  Target: ATXN1; (-) strand; PAM type: NRG; PAM sequence: AAG
cataagatagtgttgtaggt

SEQ ID NO: 74036 - DNA, 20 bp, Artificial Sequence
  Description of Artificial Sequence: Synthetic oligonucleotide
  Target: ATXN1; (-) strand; PAM type: NRG; PAM sequence: AGG
cctgcataagatagtgttgt

SEQ ID NO: 74037 - DNA, 20 bp, Artificial Sequence
  Description of Artificial Sequence: Synthetic oligonucleotide
  Target: ATXN1; (-) strand; PAM type: NRG; PAM sequence: TAG
ccctgcataagatagtgttg

SEQ ID NO: 74038 - DNA, 20 bp, Artificial Sequence
  Description of Artificial Sequence: Synthetic oligonucleotide
  Target: ATXN1; (-) strand; PAM type: NRG; PAM sequence: TAG
cttttgccccctgcataaga

SEQ ID NO: 74039 - DNA, 20 bp, Artificial Sequence
  Description of Artificial Sequence: Synthetic oligonucleotide
  Target: ATXN1; (-) strand; PAM type: NRG; PAM sequence: AAG
cttccttttgccccctgcat

SEQ ID NO: 74040 - DNA, 20 bp, Artificial Sequence
  Description of Artificial Sequence: Synthetic oligonucleotide
  Target: ATXN1; (-) strand; PAM type: NRG; PAM sequence: AAG
taaatggatctgtcttttta

SEQ ID NO: 74041 - DNA, 20 bp, Artificial Sequence
  Description of Artificial Sequence: Synthetic oligonucleotide
  Target: ATXN1; (-) strand; PAM type: NRG; PAM sequence: TGG
aggctgtgctggcacataaa

SEQ ID NO: 74042 - DNA, 20 bp, Artificial Sequence
  Description of Artificial Sequence: Synthetic oligonucleotide
  Target: ATXN1; (-) strand; PAM type: NRG; PAM sequence: TGG
ctctagttatcaggctgtgc

SEQ ID NO: 74043 - DNA, 20 bp, Artificial Sequence
  Description of Artificial Sequence: Synthetic oligonucleotide
  Target: ATXN1; (-) strand; PAM type: NRG; PAM sequence: AGG
ttcctgctactctagttatc

SEQ ID NO: 74044 - DNA, 20 bp, Artificial Sequence
  Description of Artificial Sequence: Synthetic oligonucleotide
  Target: ATXN1; (-) strand; PAM type: NRG; PAM sequence: CAG
tttcctgctactctagttat

SEQ ID NO: 74045 - DNA, 20 bp, Artificial Sequence
  Description of Artificial Sequence: Synthetic oligonucleotide
  Target: ATXN1; (-) strand; PAM type: NRG; PAM sequence: TAG
ttctctttttcctgctactc

SEQ ID NO: 74046 - DNA, 20 bp, Artificial Sequence
  Description of Artificial Sequence: Synthetic oligonucleotide
  Target: ATXN1; (-) strand; PAM type: NRG; PAM sequence: GGG
tacacacaccccaaaaaggg

SEQ ID NO: 74047 - DNA, 20 bp, Artificial Sequence
  Description of Artificial Sequence: Synthetic oligonucleotide
  Target: ATXN1; (-) strand; PAM type: NRG; PAM sequence: GGG
ctacacacaccccaaaaagg

SEQ ID NO: 74048 - DNA, 20 bp, Artificial Sequence
  Description of Artificial Sequence: Synthetic oligonucleotide
  Target: ATXN1; (-) strand; PAM type: NRG; PAM sequence: GGG
cctacacacaccccaaaaag

SEQ ID NO: 74049 - DNA, 20 bp, Artificial Sequence
  Description of Artificial Sequence: Synthetic oligonucleotide
  Target: ATXN1; (-) strand; PAM type: NRG; PAM sequence: GGG
ccctacacacaccccaaaaa

SEQ ID NO: 74050 - DNA, 20 bp, Artificial Sequence
  Description of Artificial Sequence: Synthetic oligonucleotide
  Target: ATXN1; (-) strand; PAM type: NRG; PAM sequence: AGG
cccctacacacaccccaaaa

SEQ ID NO: 74051 - DNA, 20 bp, Artificial Sequence
  Description of Artificial Sequence: Synthetic oligonucleotide
  Target: ATXN1; (-) strand; PAM type: NRG; PAM sequence: AAG
tcccctacacacaccccaaa

SEQ ID NO: 74052 - DNA, 20 bp, Artificial Sequence
  Description of Artificial Sequence: Synthetic oligonucleotide
  Target: ATXN1; (-) strand; PAM type: NRG; PAM sequence: AAG
ggaatatagtgaccacagtc

SEQ ID NO: 74053 - DNA, 20 bp, Artificial Sequence
  Description of Artificial Sequence: Synthetic oligonucleotide
  Target: ATXN1; (-) strand; PAM type: NRG; PAM sequence: CAG
ctgctggaatatagtgacca

SEQ ID NO: 74054 - DNA, 20 bp, Artificial Sequence
  Description of Artificial Sequence: Synthetic oligonucleotide
  Target: ATXN1; (-) strand; PAM type: NRG; PAM sequence: TAG
cttgtgtcactgctggaata

SEQ ID NO: 74055 - DNA, 20 bp, Artificial Sequence
  Description of Artificial Sequence: Synthetic oligonucleotide
  Target: ATXN1; (-) strand; PAM type: NRG; PAM sequence: TGG
gctctaacttgtgtcactgc

SEQ ID NO: 74056 - DNA, 20 bp, Artificial Sequence
  Description of Artificial Sequence: Synthetic oligonucleotide
  Target: ATXN1; (-) strand; PAM type: NRG; PAM sequence: AAG
aatgcggacttcagccccag

SEQ ID NO: 74057 - DNA, 20 bp, Artificial Sequence
  Description of Artificial Sequence: Synthetic oligonucleotide
  Target: ATXN1; (-) strand; PAM type: NRG; PAM sequence: CAG
gacaatgcggacttcagccc

SEQ ID NO: 74058 - DNA, 20 bp, Artificial Sequence
  Description of Artificial Sequence: Synthetic oligonucleotide
  Target: ATXN1; (-) strand; PAM type: NRG; PAM sequence: CAG
tgtttagacaatgcggactt

SEQ ID NO: 74059 - DNA, 20 bp, Artificial Sequence
  Description of Artificial Sequence: Synthetic oligonucleotide
  Target: ATXN1; (-) strand; PAM type: NRG; PAM sequence: CGG
actgtcctgtttagacaatg

SEQ ID NO: 74060 - DNA, 20 bp, Artificial Sequence
  Description of Artificial Sequence: Synthetic oligonucleotide
  Target: ATXN1; (-) strand; PAM type: NRG; PAM sequence: TAG
caaagtctgactgtcctgtt

SEQ ID NO: 74061 - DNA, 20 bp, Artificial Sequence
  Description of Artificial Sequence: Synthetic oligonucleotide
  Target: ATXN1; (-) strand; PAM type: NRG; PAM sequence: AAG
tgggaggatggtttgcccca

SEQ ID NO: 74062 - DNA, 20 bp, Artificial Sequence
  Description of Artificial Sequence: Synthetic oligonucleotide
  Target: ATXN1; (-) strand; PAM type: NRG; PAM sequence: TGG
tgggcaataagatgggagga

SEQ ID NO: 74063 - DNA, 20 bp, Artificial Sequence
  Description of Artificial Sequence: Synthetic oligonucleotide
  Target: ATXN1; (-) strand; PAM type: NRG; PAM sequence: AGG
gaattgggcaataagatggg

SEQ ID NO: 74064 - DNA, 20 bp, Artificial Sequence
  Description of Artificial Sequence: Synthetic oligonucleotide
  Target: ATXN1; (-) strand; PAM type: NRG; PAM sequence: GAG
ggaattgggcaataagatgg

SEQ ID NO: 74065 - DNA, 20 bp, Artificial Sequence
  Description of Artificial Sequence: Synthetic oligonucleotide
  Target: ATXN1; (-) strand; PAM type: NRG; PAM sequence: GGG
gtggaattgggcaataagat

SEQ ID NO: 74066 - DNA, 20 bp, Artificial Sequence
  Description of Artificial Sequence: Synthetic oligonucleotide
  Target: ATXN1; (-) strand; PAM type: NRG; PAM sequence: TGG
agtggaattgggcaataaga

SEQ ID NO: 74067 - DNA, 20 bp, Artificial Sequence
  Description of Artificial Sequence: Synthetic oligonucleotide
  Target: ATXN1; (-) strand; PAM type: NRG; PAM sequence: AAG
ggaaagtggaattgggcaat

SEQ ID NO: 74068 - DNA, 20 bp, Artificial Sequence
  Description of Artificial Sequence: Synthetic oligonucleotide
  Target: ATXN1; (-) strand; PAM type: NRG; PAM sequence: GGG
acagcagggaaagtggaatt

SEQ ID NO: 74069 - DNA, 20 bp, Artificial Sequence
  Description of Artificial Sequence: Synthetic oligonucleotide
  Target: ATXN1; (-) strand; PAM type: NRG; PAM sequence: TGG
aacagcagggaaagtggaat

SEQ ID NO: 74070 - DNA, 20 bp, Artificial Sequence
  Description of Artificial Sequence: Synthetic oligonucleotide
  Target: ATXN1; (-) strand; PAM type: NRG; PAM sequence: TGG
cattaaaacagcagggaaag

SEQ ID NO: 74071 - DNA, 20 bp, Artificial Sequence
  Description of Artificial Sequence: Synthetic oligonucleotide
  Target: ATXN1; (-) strand; PAM type: NRG; PAM sequence: AAG
tcccattaaaacagcaggga

SEQ ID NO: 74072 - DNA, 20 bp, Artificial Sequence
  Description of Artificial Sequence: Synthetic oligonucleotide
  Target: ATXN1; (-) strand; PAM type: NRG; PAM sequence: GGG
ataatcccattaaaacagca

SEQ ID NO: 74073 - DNA, 20 bp, Artificial Sequence
  Description of Artificial Sequence: Synthetic oligonucleotide
  Target: ATXN1; (-) strand; PAM type: NRG; PAM sequence: AGG
aataatcccattaaaacagc

SEQ ID NO: 74074 - DNA, 20 bp, Artificial Sequence
  Description of Artificial Sequence: Synthetic oligonucleotide
  Target: ATXN1; (-) strand; PAM type: NRG; PAM sequence: CAG
aaataatcccattaaaacag

SEQ ID NO: 74075 - DNA, 20 bp, Artificial Sequence
  Description of Artificial Sequence: Synthetic oligonucleotide
  Target: ATXN1; (-) strand; PAM type: NRG; PAM sequence: CAG
ccaaaataatcccattaaaa

SEQ ID NO: 74076 - DNA, 20 bp, Artificial Sequence
  Description of Artificial Sequence: Synthetic oligonucleotide
  Target: ATXN1; (-) strand; PAM type: NRG; PAM sequence: CAG
aaggagtgagacagaaatag

SEQ ID NO: 74077 - DNA, 20 bp, Artificial Sequence
  Description of Artificial Sequence: Synthetic oligonucleotide
  Target: ATXN1; (-) strand; PAM type: NRG; PAM sequence: TAG
gaaaaggagtgagacagaaa

SEQ ID NO: 74078 - DNA, 20 bp, Artificial Sequence
  Description of Artificial Sequence: Synthetic oligonucleotide
  Target: ATXN1; (-) strand; PAM type: NRG; PAM sequence: CAG
tttggggaaaaggagtgaga

SEQ ID NO: 74079 - DNA, 20 bp, Artificial Sequence
  Description of Artificial Sequence: Synthetic oligonucleotide
  Target: ATXN1; (-) strand; PAM type: NRG; PAM sequence: GAG
acagtttggggaaaaggagt

SEQ ID NO: 74080 - DNA, 20 bp, Artificial Sequence
  Description of Artificial Sequence: Synthetic oligonucleotide
  Target: ATXN1; (-) strand; PAM type: NRG; PAM sequence: GAG
tatgacagtttggggaaaag

SEQ ID NO: 74081 - DNA, 20 bp, Artificial Sequence
  Description of Artificial Sequence: Synthetic oligonucleotide
  Target: ATXN1; (-) strand; PAM type: NRG; PAM sequence: AGG
tatatgacagtttggggaaa

SEQ ID NO: 74082 - DNA, 20 bp, Artificial Sequence
  Description of Artificial Sequence: Synthetic oligonucleotide
  Target: ATXN1; (-) strand; PAM type: NRG; PAM sequence: AAG
ttatatgacagtttggggaa

SEQ ID NO: 74083 - DNA, 20 bp, Artificial Sequence
  Description of Artificial Sequence: Synthetic oligonucleotide
  Target: ATXN1; (-) strand; PAM type: NRG; PAM sequence: GGG
agtacttatatgacagtttg

SEQ ID NO: 74084 - DNA, 20 bp, Artificial Sequence
  Description of Artificial Sequence: Synthetic oligonucleotide
  Target: ATXN1; (-) strand; PAM type: NRG; PAM sequence: GGG
cagtacttatatgacagttt

SEQ ID NO: 74085 - DNA, 20 bp, Artificial Sequence
  Description of Artificial Sequence: Synthetic oligonucleotide
  Target: ATXN1; (-) strand; PAM type: NRG; PAM sequence: TGG
gcagtacttatatgacagtt

SEQ ID NO: 74086 - DNA, 20 bp, Artificial Sequence
  Description of Artificial Sequence: Synthetic oligonucleotide
  Target: ATXN1; (-) strand; PAM type: NRG; PAM sequence: CAG
aagctgcagtacttatatga

SEQ ID NO: 74087 - DNA, 20 bp, Artificial Sequence
  Description of Artificial Sequence: Synthetic oligonucleotide
  Target: ATXN1; (-) strand; PAM type: NRG; PAM sequence: CAG
gctgggaagtagtcaagctg

SEQ ID NO: 74088 - DNA, 20 bp, Artificial Sequence
  Description of Artificial Sequence: Synthetic oligonucleotide
  Target: ATXN1; (-) strand; PAM type: NRG; PAM sequence: AAG
ttggcagctgggaagtagtc

SEQ ID NO: 74089 - DNA, 20 bp, Artificial Sequence
  Description of Artificial Sequence: Synthetic oligonucleotide
  Target: ATXN1; (-) strand; PAM type: NRG; PAM sequence: TAG
gaaatttggcagctgggaag

SEQ ID NO: 74090 - DNA, 20 bp, Artificial Sequence
  Description of Artificial Sequence: Synthetic oligonucleotide
  Target: ATXN1; (-) strand; PAM type: NRG; PAM sequence: AAG
agtgaaatttggcagctggg

SEQ ID NO: 74091 - DNA, 20 bp, Artificial Sequence
  Description of Artificial Sequence: Synthetic oligonucleotide
  Target: ATXN1; (-) strand; PAM type: NRG; PAM sequence: GGG
tggagtgaaatttggcagct

SEQ ID NO: 74092 - DNA, 20 bp, Artificial Sequence
  Description of Artificial Sequence: Synthetic oligonucleotide
  Target: ATXN1; (-) strand; PAM type: NRG; PAM sequence: TGG
ctggagtgaaatttggcagc

SEQ ID NO: 74093 - DNA, 20 bp, Artificial Sequence
  Description of Artificial Sequence: Synthetic oligonucleotide
  Target: ATXN1; (-) strand; PAM type: NRG; PAM sequence: CAG
atctctggagtgaaatttgg

SEQ ID NO: 74094 - DNA, 20 bp, Artificial Sequence
  Description of Artificial Sequence: Synthetic oligonucleotide
  Target: ATXN1; (-) strand; PAM type: NRG; PAM sequence: TGG
gccatctctggagtgaaatt

SEQ ID NO: 74095 - DNA, 20 bp, Artificial Sequence
  Description of Artificial Sequence: Synthetic oligonucleotide
  Target: ATXN1; (-) strand; PAM type: NRG; PAM sequence: GAG
ctgaaatacagccatctctg

SEQ ID NO: 74096 - DNA, 20 bp, Artificial Sequence
  Description of Artificial Sequence: Synthetic oligonucleotide
  Target: ATXN1; (-) strand; PAM type: NRG; PAM sequence: TGG
cactgaaatacagccatctc

SEQ ID NO: 74097 - DNA, 20 bp, Artificial Sequence
  Description of Artificial Sequence: Synthetic oligonucleotide
  Target: ATXN1; (-) strand; PAM type: NRG; PAM sequence: CAG
cttcacttgccactgaaata

SEQ ID NO: 74098 - DNA, 20 bp, Artificial Sequence
  Description of Artificial Sequence: Synthetic oligonucleotide
  Target: ATXN1; (-) strand; PAM type: NRG; PAM sequence: GGG
gagtatttcgatgacacaga

SEQ ID NO: 74099 - DNA, 20 bp, Artificial Sequence
  Description of Artificial Sequence: Synthetic oligonucleotide
  Target: ATXN1; (-) strand; PAM type: NRG; PAM sequence: AGG
tgagtatttcgatgacacag

SEQ ID NO: 74100 - DNA, 20 bp, Artificial Sequence
  Description of Artificial Sequence: Synthetic oligonucleotide
  Target: ATXN1; (-) strand; PAM type: NRG; PAM sequence: GAG
atgagtatttcgatgacaca

SEQ ID NO: 74101 - DNA, 20 bp, Artificial Sequence
  Description of Artificial Sequence: Synthetic oligonucleotide
  Target: ATXN1; (-) strand; PAM type: NRG; PAM sequence: CAG
aaatgagtatttcgatgaca

SEQ ID NO: 74102 - DNA, 20 bp, Artificial Sequence
  Description of Artificial Sequence: Synthetic oligonucleotide
  Target: ATXN1; (-) strand; PAM type: NRG; PAM sequence: GAG
agatgcttaaccccttaaat

SEQ ID NO: 74103 - DNA, 20 bp, Artificial Sequence
  Description of Artificial Sequence: Synthetic oligonucleotide
  Target: ATXN1; (-) strand; PAM type: NRG; PAM sequence: CAG
gcacaaaggcaaccctcttc

SEQ ID NO: 74104 - DNA, 20 bp, Artificial Sequence
  Description of Artificial Sequence: Synthetic oligonucleotide
  Target: ATXN1; (-) strand; PAM type: NRG; PAM sequence: AGG
aacactctgttcatgcacaa

SEQ ID NO: 74105 - DNA, 20 bp, Artificial Sequence
  Description of Artificial Sequence: Synthetic oligonucleotide
  Target: ATXN1; (-) strand; PAM type: NRG; PAM sequence: AAG
aaacactctgttcatgcaca

SEQ ID NO: 74106 - DNA, 20 bp, Artificial Sequence
  Description of Artificial Sequence: Synthetic oligonucleotide
  Target: ATXN1; (-) strand; PAM type: NRG; PAM sequence: TAG
aatgacctccttctccagga

SEQ ID NO: 74107 - DNA, 20 bp, Artificial Sequence
  Description of Artificial Sequence: Synthetic oligonucleotide
  Target: ATXN1; (-) strand; PAM type: NRG; PAM sequence: AGG
agctaatgacctccttctcc

SEQ ID NO: 74108 - DNA, 20 bp, Artificial Sequence
  Description of Artificial Sequence: Synthetic oligonucleotide
  Target: ATXN1; (-) strand; PAM type: NRG; PAM sequence: CAG
gagctaatgacctccttctc

SEQ ID NO: 74109 - DNA, 20 bp, Artificial Sequence
  Description of Artificial Sequence: Synthetic oligonucleotide
  Target: ATXN1; (-) strand; PAM type: NRG; PAM sequence: GAG
tcttccatcttgctcaggtg

SEQ ID NO: 74110 - DNA, 20 bp, Artificial Sequence
  Description of Artificial Sequence: Synthetic oligonucleotide
  Target: ATXN1; (-) strand; PAM type: NRG; PAM sequence: TGG
tgtcttccatcttgctcagg

SEQ ID NO: 74111 - DNA, 20 bp, Artificial Sequence
  Description of Artificial Sequence: Synthetic oligonucleotide
  Target: ATXN1; (-) strand; PAM type: NRG; PAM sequence: AGG
gtgtgtcttccatcttgctc

SEQ ID NO: 74112 - DNA, 20 bp, Artificial Sequence
  Description of Artificial Sequence: Synthetic oligonucleotide
  Target: ATXN1; (-) strand; PAM type: NRG; PAM sequence: CAG
tgtgtgtcttccatcttgct

SEQ ID NO: 74113 - DNA, 20 bp, Artificial Sequence
  Description of Artificial Sequence: Synthetic oligonucleotide
  Target: ATXN1; (-) strand; PAM type: NRG; PAM sequence: TGG
tggctgcatagagtgttttt

SEQ ID NO: 74114 - DNA, 20 bp, Artificial Sequence
  Description of Artificial Sequence: Synthetic oligonucleotide
  Target: ATXN1; (-) strand; PAM type: NRG; PAM sequence: GAG
tgcattttagtggctgcata

SEQ ID NO: 74115 - DNA, 20 bp, Artificial Sequence
  Description of Artificial Sequence: Synthetic oligonucleotide
  Target: ATXN1; (-) strand; PAM type: NRG; PAM sequence: TAG
cgtgcattttagtggctgca

SEQ ID NO: 74116 - DNA, 20 bp, Artificial Sequence
  Description of Artificial Sequence: Synthetic oligonucleotide
  Target: ATXN1; (-) strand; PAM type: NRG; PAM sequence: TGG
gttttccccgtgcattttag

SEQ ID NO: 74117 - DNA, 20 bp, Artificial Sequence
  Description of Artificial Sequence: Synthetic oligonucleotide
  Target: ATXN1; (-) strand; PAM type: NRG; PAM sequence: TAG
tctgttttccccgtgcattt

SEQ ID NO: 74118 - DNA, 20 bp, Artificial Sequence
  Description of Artificial Sequence: Synthetic oligonucleotide
  Target: ATXN1; (-) strand; PAM type: NRG; PAM sequence: CGG
ggaaaagaacctatgaaaag

SEQ ID NO: 74119 - DNA, 20 bp, Artificial Sequence
  Description of Artificial Sequence: Synthetic oligonucleotide
  Target: ATXN1; (-) strand; PAM type: NRG; PAM sequence: AAG
tgtggaaaagaacctatgaa

SEQ ID NO: 74120 - DNA, 20 bp, Artificial Sequence
  Description of Artificial Sequence: Synthetic oligonucleotide
  Target: ATXN1; (-) strand; PAM type: NRG; PAM sequence: AAG
actttgaagtccctgtggaa

SEQ ID NO: 74121 - DNA, 20 bp, Artificial Sequence
  Description of Artificial Sequence: Synthetic oligonucleotide
  Target: ATXN1; (-) strand; PAM type: NRG; PAM sequence: TGG
ttaagactttgaagtccctg

SEQ ID NO: 74122 - DNA, 20 bp, Artificial Sequence
  Description of Artificial Sequence: Synthetic oligonucleotide
  Target: ATXN1; (-) strand; PAM type: NRG; PAM sequence: AAG
cttgatgctttaagactttg

SEQ ID NO: 74123 - DNA, 20 bp, Artificial Sequence
  Description of Artificial Sequence: Synthetic oligonucleotide
  Target: ATXN1; (-) strand; PAM type: NRG; PAM sequence: AAG
ttttgcaaccttgatgcttt

SEQ ID NO: 74124 - DNA, 20 bp, Artificial Sequence
  Description of Artificial Sequence: Synthetic oligonucleotide
  Target: ATXN1; (-) strand; PAM type: NRG; PAM sequence: AGG
catgagtggtttgctctcag

SEQ ID NO: 74125 - DNA, 20 bp, Artificial Sequence
  Description of Artificial Sequence: Synthetic oligonucleotide
  Target: ATXN1; (-) strand; PAM type: NRG; PAM sequence: GAG
acatgagtggtttgctctca

SEQ ID NO: 74126 - DNA, 20 bp, Artificial Sequence
  Description of Artificial Sequence: Synthetic oligonucleotide
  Target: ATXN1; (-) strand; PAM type: NRG; PAM sequence: CAG
taacatgagtggtttgctct

SEQ ID NO: 74127 - DNA, 20 bp, Artificial Sequence
  Description of Artificial Sequence: Synthetic oligonucleotide
  Target: ATXN1; (-) strand; PAM type: NRG; PAM sequence: TGG
ttctccatctgtaacatgag

SEQ ID NO: 74128 - DNA, 20 bp, Artificial Sequence
  Description of Artificial Sequence: Synthetic oligonucleotide
  Target: ATXN1; (-) strand; PAM type: NRG; PAM sequence: GAG
aagttctccatctgtaacat

SEQ ID NO: 74129 - DNA, 20 bp, Artificial Sequence
  Description of Artificial Sequence: Synthetic oligonucleotide
  Target: ATXN1; (-) strand; PAM type: NRG; PAM sequence: AAG
ctcagtgaccctgtgcttcc

SEQ ID NO: 74130 - DNA, 20 bp, Artificial Sequence
  Description of Artificial Sequence: Synthetic oligonucleotide
  Target: ATXN1; (-) strand; PAM type: NRG; PAM sequence: CAG
ggggctttgaccaaggtact

SEQ ID NO: 74131 - DNA, 20 bp, Artificial Sequence
  Description of Artificial Sequence: Synthetic oligonucleotide
  Target: ATXN1; (-) strand; PAM type: NRG; PAM sequence: AGG
gggggggggggctttgacca

SEQ ID NO: 74132 - DNA, 20 bp, Artificial Sequence
  Description of Artificial Sequence: Synthetic oligonucleotide
  Target: ATXN1; (-) strand; PAM type: NRG; PAM sequence: AAG
ggggggggggggctttgacc

SEQ ID NO: 74133 - DNA, 20 bp, Artificial Sequence
  Description of Artificial Sequence: Synthetic oligonucleotide
  Target: ATXN1; (-) strand; PAM type: NRG; PAM sequence: GGG
aatcggcgggtggggggggg

SEQ ID NO: 74134 - DNA, 20 bp, Artificial Sequence
  Description of Artificial Sequence: Synthetic oligonucleotide
  Target: ATXN1; (-) strand; PAM type: NRG; PAM sequence: GGG
gaatcggcgggtgggggggg

SEQ ID NO: 74135 - DNA, 20 bp, Artificial Sequence
  Description of Artificial Sequence: Synthetic oligonucleotide
  Target: ATXN1; (-) strand; PAM type: NRG; PAM sequence: GGG
tgaatcggcgggtggggggg

SEQ ID NO: 74136 - DNA, 20 bp, Artificial Sequence
  Description of Artificial Sequence: Synthetic oligonucleotide
  Target: ATXN1; (-) strand; PAM type: NRG; PAM sequence: GGG
atgaatcggcgggtgggggg

SEQ ID NO: 74137 - DNA, 20 bp, Artificial Sequence
  Description of Artificial Sequence: Synthetic oligonucleotide
  Target: ATXN1; (-) strand; PAM type: NRG; PAM sequence: GGG
aatgaatcggcgggtggggg

SEQ ID NO: 74138 - DNA, 20 bp, Artificial Sequence
  Description of Artificial Sequence: Synthetic oligonucleotide
  Target: ATXN1; (-) strand; PAM type: NRG; PAM sequence: GGG
gaatgaatcggcgggtgggg

SEQ ID NO: 74139 - DNA, 20 bp, Artificial Sequence
  Description of Artificial Sequence: Synthetic oligonucleotide
  Target: ATXN1; (-) strand; PAM type: NRG; PAM sequence: GGG
ggaatgaatcggcgggtggg

SEQ ID NO: 74140 - DNA, 20 bp, Artificial Sequence
  Description of Artificial Sequence: Synthetic oligonucleotide
  Target: ATXN1; (-) strand; PAM type: NRG; PAM sequence: GGG
gggaatgaatcggcgggtgg

SEQ ID NO: 74141 - DNA, 20 bp, Artificial Sequence
  Description of Artificial Sequence: Synthetic oligonucleotide
  Target: ATXN1; (-) strand; PAM type: NRG; PAM sequence: GGG
tgggaatgaatcggcgggtg

SEQ ID NO: 74142 - DNA, 20 bp, Artificial Sequence
  Description of Artificial Sequence: Synthetic oligonucleotide
  Target: ATXN1; (-) strand; PAM type: NRG; PAM sequence: GGG
ttgggaatgaatcggcgggt

SEQ ID NO: 74143 - DNA, 20 bp, Artificial Sequence
  Description of Artificial Sequence: Synthetic oligonucleotide
  Target: ATXN1; (-) strand; PAM type: NRG; PAM sequence: TGG
cttgggaatgaatcggcggg

SEQ ID NO: 74144 - DNA, 20 bp, Artificial Sequence
  Description of Artificial Sequence: Synthetic oligonucleotide
  Target: ATXN1; (-) strand; PAM type: NRG; PAM sequence: GGG
ggacttgggaatgaatcggc

SEQ ID NO: 74145 - DNA, 20 bp, Artificial Sequence
  Description of Artificial Sequence: Synthetic oligonucleotide
  Target: ATXN1; (-) strand; PAM type: NRG; PAM sequence: CGG
tggacttgggaatgaatcgg

SEQ ID NO: 74146 - DNA, 20 bp, Artificial Sequence
  Description of Artificial Sequence: Synthetic oligonucleotide
  Target: ATXN1; (-) strand; PAM type: NRG; PAM sequence: CGG
ccttggacttgggaatgaat

SEQ ID NO: 74147 - DNA, 20 bp, Artificial Sequence
  Description of Artificial Sequence: Synthetic oligonucleotide
  Target: ATXN1; (-) strand; PAM type: NRG; PAM sequence: GGG
agtgaaacgcccttggactt

SEQ ID NO: 74148 - DNA, 20 bp, Artificial Sequence
  Description of Artificial Sequence: Synthetic oligonucleotide
  Target: ATXN1; (-) strand; PAM type: NRG; PAM sequence: TGG
aagtgaaacgcccttggact

SEQ ID NO: 74149 - DNA, 20 bp, Artificial Sequence
  Description of Artificial Sequence: Synthetic oligonucleotide
  Target: ATXN1; (-) strand; PAM type: NRG; PAM sequence: TGG
aaattcaagtgaaacgccct

SEQ ID NO: 74150 - DNA, 20 bp, Artificial Sequence
  Description of Artificial Sequence: Synthetic oligonucleotide
  Target: ATXN1; (-) strand; PAM type: NRG; PAM sequence: AAG
taaagccaaattcaaaattc

SEQ ID NO: 74151 - DNA, 20 bp, Artificial Sequence
  Description of Artificial Sequence: Synthetic oligonucleotide
  Target: ATXN1; (-) strand; PAM type: NRG; PAM sequence: AAG
tctgagtgtgtctgcagata

SEQ ID NO: 74152 - DNA, 20 bp, Artificial Sequence
  Description of Artificial Sequence: Synthetic oligonucleotide
  Target: ATXN1; (-) strand; PAM type: NRG; PAM sequence: CAG
tgatactctgagtgtgtctg

SEQ ID NO: 74153 - DNA, 20 bp, Artificial Sequence
  Description of Artificial Sequence: Synthetic oligonucleotide
  Target: ATXN1; (-) strand; PAM type: NRG; PAM sequence: GAG
tgacggagatgtgatactct

SEQ ID NO: 74154 - DNA, 20 bp, Artificial Sequence
  Description of Artificial Sequence: Synthetic oligonucleotide
  Target: ATXN1; (-) strand; PAM type: NRG; PAM sequence: GAG
tgtgcttgacttgactgacg

SEQ ID NO: 74155 - DNA, 20 bp, Artificial Sequence
  Description of Artificial Sequence: Synthetic oligonucleotide
  Target: ATXN1; (-) strand; PAM type: NRG; PAM sequence: CGG
tctgtgcttgacttgactga

SEQ ID NO: 74156 - DNA, 20 bp, Artificial Sequence
  Description of Artificial Sequence: Synthetic oligonucleotide
  Target: ATXN1; (-) strand; PAM type: NRG; PAM sequence: GGG
tgccgtgtgctttagaagct

SEQ ID NO: 74157 - DNA, 20 bp, Artificial Sequence
  Description of Artificial Sequence: Synthetic oligonucleotide
  Target: ATXN1; (-) strand; PAM type: NRG; PAM sequence: TGG
atgccgtgtgctttagaagc

SEQ ID NO: 74158 - DNA, 20 bp, Artificial Sequence
  Description of Artificial Sequence: Synthetic oligonucleotide
  Target: ATXN1; (-) strand; PAM type: NRG; PAM sequence: AAG
gctgatgccgtgtgctttag

SEQ ID NO: 74159 - DNA, 20 bp, Artificial Sequence
  Description of Artificial Sequence: Synthetic oligonucleotide
  Target: ATXN1; (-) strand; PAM type: NRG; PAM sequence: TAG
agtgctgatgccgtgtgctt

SEQ ID NO: 74160 - DNA, 20 bp, Artificial Sequence
  Description of Artificial Sequence: Synthetic oligonucleotide
  Target: ATXN1; (-) strand; PAM type: NRG; PAM sequence: CAG
agccaaacaaaacaagaatt

SEQ ID NO: 74161 - DNA, 20 bp, Artificial Sequence
  Description of Artificial Sequence: Synthetic oligonucleotide
  Target: ATXN1; (-) strand; PAM type: NRG; PAM sequence: AAG
taaacatagccaaacaaaac

SEQ ID NO: 74162 - DNA, 20 bp, Artificial Sequence
  Description of Artificial Sequence: Synthetic oligonucleotide
  Target: ATXN1; (-) strand; PAM type: NRG; PAM sequence: TAG
agtacctaaacaaataaaca

SEQ ID NO: 74163 - DNA, 20 bp, Artificial Sequence
  Description of Artificial Sequence: Synthetic oligonucleotide
  Target: ATXN1; (-) strand; PAM type: NRG; PAM sequence: GAG
ttcctggtggagattttcct

SEQ ID NO: 74164 - DNA, 20 bp, Artificial Sequence
  Description of Artificial Sequence: Synthetic oligonucleotide
  Target: ATXN1; (-) strand; PAM type: NRG; PAM sequence: GAG
ccctgtattttttcctggtg

SEQ ID NO: 74165 - DNA, 20 bp, Artificial Sequence
  Description of Artificial Sequence: Synthetic oligonucleotide
  Target: ATXN1; (-) strand; PAM type: NRG; PAM sequence: TGG
caccctgtattttttcctgg

SEQ ID NO: 74166 - DNA, 20 bp, Artificial Sequence
  Description of Artificial Sequence: Synthetic oligonucleotide
  Target: ATXN1; (-) strand; PAM type: NRG; PAM sequence: TGG
caacaccctgtattttttcc

SEQ ID NO: 74167 - DNA, 20 bp, Artificial Sequence
  Description of Artificial Sequence: Synthetic oligonucleotide
  Target: ATXN1; (-) strand; PAM type: NRG; PAM sequence: TAG
acattgcctggcctggcaca

SEQ ID NO: 74168 - DNA, 20 bp, Artificial Sequence
  Description of Artificial Sequence: Synthetic oligonucleotide
  Target: ATXN1; (-) strand; PAM type: NRG; PAM sequence: TGG
cctgagaacattgcctggcc

SEQ ID NO: 74169 - DNA, 20 bp, Artificial Sequence
  Description of Artificial Sequence: Synthetic oligonucleotide
  Target: ATXN1; (-) strand; PAM type: NRG; PAM sequence: TGG
ataaacctgagaacattgcc

SEQ ID NO: 74170 - DNA, 20 bp, Artificial Sequence
  Description of Artificial Sequence: Synthetic oligonucleotide
  Target: ATXN1; (-) strand; PAM type: NRG; PAM sequence: GAG
aattgtatacatataaacct

SEQ ID NO: 74171 - DNA, 20 bp, Artificial Sequence
  Description of Artificial Sequence: Synthetic oligonucleotide
  Target: ATXN1; (-) strand; PAM type: NRG; PAM sequence: CAG
gggagccacagagccactgt

SEQ ID NO: 74172 - DNA, 20 bp, Artificial Sequence
  Description of Artificial Sequence: Synthetic oligonucleotide
  Target: ATXN1; (-) strand; PAM type: NRG; PAM sequence: GAG
tctctaaaatgggagccaca

SEQ ID NO: 74173 - DNA, 20 bp, Artificial Sequence
  Description of Artificial Sequence: Synthetic oligonucleotide
  Target: ATXN1; (-) strand; PAM type: NRG; PAM sequence: CAG
tctctctaaaatgggagcca

SEQ ID NO: 74174 - DNA, 20 bp, Artificial Sequence
  Description of Artificial Sequence: Synthetic oligonucleotide
  Target: ATXN1; (-) strand; PAM type: NRG; PAM sequence: GAG
tctctctctctctaaaatgg

SEQ ID NO: 74175 - DNA, 20 bp, Artificial Sequence
  Description of Artificial Sequence: Synthetic oligonucleotide
  Target: ATXN1; (-) strand; PAM type: NRG; PAM sequence: GGG
tctctctctctctctaaaat

SEQ ID NO: 74176 - DNA, 20 bp, Artificial Sequence
  Description of Artificial Sequence: Synthetic oligonucleotide
  Target: ATXN1; (-) strand; PAM type: NRG; PAM sequence: TGG
ctctctctctctctctaaaa

SEQ ID NO: 74177 - DNA, 20 bp, Artificial Sequence
  Description of Artificial Sequence: Synthetic oligonucleotide
  Target: ATXN1; (-) strand; PAM type: NRG; PAM sequence: TGG
aaggtagtttttttttgagt

SEQ ID NO: 74178 - DNA, 20 bp, Artificial Sequence
  Description of Artificial Sequence: Synthetic oligonucleotide
  Target: ATXN1; (-) strand; PAM type: NRG; PAM sequence: GAG
tgggaaggtagttttttttt

SEQ ID NO: 74179 - DNA, 20 bp, Artificial Sequence
  Description of Artificial Sequence: Synthetic oligonucleotide
  Target: ATXN1; (-) strand; PAM type: NRG; PAM sequence: TAG
tttagtaaaatttgggaagg

SEQ ID NO: 74180 - DNA, 20 bp, Artificial Sequence
  Description of Artificial Sequence: Synthetic oligonucleotide
  Target: ATXN1; (-) strand; PAM type: NRG; PAM sequence: AGG
tgttttagtaaaatttggga

SEQ ID NO: 74181 - DNA, 20 bp, Artificial Sequence
  Description of Artificial Sequence: Synthetic oligonucleotide
  Target: ATXN1; (-) strand; PAM type: NRG; PAM sequence: AAG
atgttttagtaaaatttggg

SEQ ID NO: 74182 - DNA, 20 bp, Artificial Sequence
  Description of Artificial Sequence: Synthetic oligonucleotide
  Target: ATXN1; (-) strand; PAM type: NRG; PAM sequence: GGG
tgaatgttttagtaaaattt

SEQ ID NO: 74183 - DNA, 20 bp, Artificial Sequence
  Description of Artificial Sequence: Synthetic oligonucleotide
  Target: ATXN1; (-) strand; PAM type: NRG; PAM sequence: TGG
ctgaatgttttagtaaaatt

SEQ ID NO: 74184 - DNA, 20 bp, Artificial Sequence
  Description of Artificial Sequence: Synthetic oligonucleotide
  Target: ATXN1; (-) strand; PAM type: NRG; PAM sequence: TAG
tagatttttgctgaatgttt

SEQ ID NO: 74185 - DNA, 20 bp, Artificial Sequence
  Description of Artificial Sequence: Synthetic oligonucleotide
  Target: ATXN1; (-) strand; PAM type: NRG; PAM sequence: TAG
gtatatcactggtaattttt

SEQ ID NO: 74186 - DNA, 20 bp, Artificial Sequence
  Description of Artificial Sequence: Synthetic oligonucleotide
  Target: ATXN1; (-) strand; PAM type: NRG; PAM sequence: TGG
ataagtgagaagtatatcac

SEQ ID NO: 74187 - DNA, 20 bp, Artificial Sequence
  Description of Artificial Sequence: Synthetic oligonucleotide
  Target: ATXN1; (-) strand; PAM type: NRG; PAM sequence: AAG
atctcttcagaataagtgag

SEQ ID NO: 74188 - DNA, 20 bp, Artificial Sequence
  Description of Artificial Sequence: Synthetic oligonucleotide
  Target: ATXN1; (-) strand; PAM type: NRG; PAM sequence: GAG
atcatctcttcagaataagt

SEQ ID NO: 74189 - DNA, 20 bp, Artificial Sequence
  Description of Artificial Sequence: Synthetic oligonucleotide
  Target: ATXN1; (-) strand; PAM type: NRG; PAM sequence: AAG
aaggatcatctcttcagaat

SEQ ID NO: 74190 - DNA, 20 bp, Artificial Sequence
  Description of Artificial Sequence: Synthetic oligonucleotide
  Target: ATXN1; (-) strand; PAM type: NRG; PAM sequence: CAG
attaagaaggatcatctctt

SEQ ID NO: 74191 - DNA, 20 bp, Artificial Sequence
  Description of Artificial Sequence: Synthetic oligonucleotide
  Target: ATXN1; (-) strand; PAM type: NRG; PAM sequence: AGG
atatgccaaaagtattaaga

SEQ ID NO: 74192 - DNA, 20 bp, Artificial Sequence
  Description of Artificial Sequence: Synthetic oligonucleotide
  Target: ATXN1; (-) strand; PAM type: NRG; PAM sequence: AAG
tatatgccaaaagtattaag

SEQ ID NO: 74193 - DNA, 20 bp, Artificial Sequence
  Description of Artificial Sequence: Synthetic oligonucleotide
  Target: ATXN1; (-) strand; PAM type: NRG; PAM sequence: AAG
agctatatgccaaaagtatt

SEQ ID NO: 74194 - DNA, 20 bp, Artificial Sequence
  Description of Artificial Sequence: Synthetic oligonucleotide
  Target: ATXN1; (-) strand; PAM type: NRG; PAM sequence: AAG
aagaagcagctatatgccaa

SEQ ID NO: 74195 - DNA, 20 bp, Artificial Sequence
  Description of Artificial Sequence: Synthetic oligonucleotide
  Target: ATXN1; (-) strand; PAM type: NRG; PAM sequence: CAG
ttttttttattagcaagaag

SEQ ID NO: 74196 - DNA, 20 bp, Artificial Sequence
  Description of Artificial Sequence: Synthetic oligonucleotide
  Target: ATXN1; (-) strand; PAM type: NRG; PAM sequence: AAG
actttttttttattagcaag

SEQ ID NO: 74197 - DNA, 20 bp, Artificial Sequence
  Description of Artificial Sequence: Synthetic oligonucleotide
  Target: ATXN1; (-) strand; PAM type: NRG; PAM sequence: AAG
agtactttttttttattagc

SEQ ID NO: 74198 - DNA, 20 bp, Artificial Sequence
  Description of Artificial Sequence: Synthetic oligonucleotide
  Target: ATXN1; (-) strand; PAM type: NRG; PAM sequence: TAG
tggaagtactttttttttat

SEQ ID NO: 74199 - DNA, 20 bp, Artificial Sequence
  Description of Artificial Sequence: Synthetic oligonucleotide
  Target: ATXN1; (-) strand; PAM type: NRG; PAM sequence: AAG
taatatacagaacatcttgg

SEQ ID NO: 74200 - DNA, 20 bp, Artificial Sequence
  Description of Artificial Sequence: Synthetic oligonucleotide
  Target: ATXN1; (-) strand; PAM type: NRG; PAM sequence: TGG
aaataatatacagaacatct

SEQ ID NO: 74201 - DNA, 20 bp, Artificial Sequence
  Description of Artificial Sequence: Synthetic oligonucleotide
  Target: ATXN1; (-) strand; PAM type: NRG; PAM sequence: CAG
taagatttggaaataatata

SEQ ID NO: 74202 - DNA, 20 bp, Artificial Sequence
  Description of Artificial Sequence: Synthetic oligonucleotide
  Target: ATXN1; (-) strand; PAM type: NRG; PAM sequence: TGG
gaaacaactgttataagatt

SEQ ID NO: 74203 - DNA, 20 bp, Artificial Sequence
  Description of Artificial Sequence: Synthetic oligonucleotide
  Target: ATXN1; (-) strand; PAM type: NRG; PAM sequence: AAG
attgttgaaacaactgttat

SEQ ID NO: 74204 - DNA, 20 bp, Artificial Sequence
  Description of Artificial Sequence: Synthetic oligonucleotide
  Target: ATXN1; (-) strand; PAM type: NRG; PAM sequence: TAG
tcatttcatcagtgttcaaa

SEQ ID NO: 74205 - DNA, 20 bp, Artificial Sequence
  Description of Artificial Sequence: Synthetic oligonucleotide
  Target: ATXN1; (-) strand; PAM type: NRG; PAM sequence: CAG
attagtgcttctcatttcat

SEQ ID NO: 74206 - DNA, 20 bp, Artificial Sequence
  Description of Artificial Sequence: Synthetic oligonucleotide
  Target: ATXN1; (-) strand; PAM type: NRG; PAM sequence: TAG
ctgtgctccctgaatatcat

SEQ ID NO: 74207 - DNA, 20 bp, Artificial Sequence
  Description of Artificial Sequence: Synthetic oligonucleotide
  Target: ATXN1; (-) strand; PAM type: NRG; PAM sequence: AAG
gttccctttctccctaactc

SEQ ID NO: 74208 - DNA, 20 bp, Artificial Sequence
  Description of Artificial Sequence: Synthetic oligonucleotide
  Target: ATXN1; (-) strand; PAM type: NRG; PAM sequence: CAG
tggaagagaaaatgaacatc

SEQ ID NO: 74209 - DNA, 20 bp, Artificial Sequence
  Description of Artificial Sequence: Synthetic oligonucleotide
  Target: ATXN1; (-) strand; PAM type: NRG; PAM sequence: GAG
tataggattcagcggtggaa

SEQ ID NO: 74210 - DNA, 20 bp, Artificial Sequence
  Description of Artificial Sequence: Synthetic oligonucleotide
  Target: ATXN1; (-) strand; PAM type: NRG; PAM sequence: AAG
attataggattcagcggtgg

SEQ ID NO: 74211 - DNA, 20 bp, Artificial Sequence
  Description of Artificial Sequence: Synthetic oligonucleotide
  Target: ATXN1; (-) strand; PAM type: NRG; PAM sequence: TGG
gacattataggattcagcgg

SEQ ID NO: 74212 - DNA, 20 bp, Artificial Sequence
  Description of Artificial Sequence: Synthetic oligonucleotide
  Target: ATXN1; (-) strand; PAM type: NRG; PAM sequence: CGG
tttgacattataggattcag

SEQ ID NO: 74213 - DNA, 20 bp, Artificial Sequence
  Description of Artificial Sequence: Synthetic oligonucleotide
  Target: ATXN1; (-) strand; PAM type: NRG; PAM sequence: CAG
gcttttgacattataggatt

SEQ ID NO: 74214 - DNA, 20 bp, Artificial Sequence
  Description of Artificial Sequence: Synthetic oligonucleotide
  Target: ATXN1; (-) strand; PAM type: NRG; PAM sequence: AGG
aggagagcttttgacattat

SEQ ID NO: 74215 - DNA, 20 bp, Artificial Sequence
  Description of Artificial Sequence: Synthetic oligonucleotide
  Target: ATXN1; (-) strand; PAM type: NRG; PAM sequence: TAG
taggagagcttttgacatta

SEQ ID NO: 74216 - DNA, 20 bp, Artificial Sequence
  Description of Artificial Sequence: Synthetic oligonucleotide
  Target: ATXN1; (-) strand; PAM type: NRG; PAM sequence: GAG
ttcaggaatgtgagatagga

SEQ ID NO: 74217 - DNA, 20 bp, Artificial Sequence
  Description of Artificial Sequence: Synthetic oligonucleotide
  Target: ATXN1; (-) strand; PAM type: NRG; PAM sequence: GAG
aattcaggaatgtgagatag

SEQ ID NO: 74218 - DNA, 20 bp, Artificial Sequence
  Description of Artificial Sequence: Synthetic oligonucleotide
  Target: ATXN1; (-) strand; PAM type: NRG; PAM sequence: AGG
taaattcaggaatgtgagat

SEQ ID NO: 74219 - DNA, 20 bp, Artificial Sequence
  Description of Artificial Sequence: Synthetic oligonucleotide
  Target: ATXN1; (-) strand; PAM type: NRG; PAM sequence: TAG
ctaaattcaggaatgtgaga

SEQ ID NO: 74220 - DNA, 20 bp, Artificial Sequence
  Description of Artificial Sequence: Synthetic oligonucleotide
  Target: ATXN1; (-) strand; PAM type: NRG; PAM sequence: GAG
ttttctaaattcaggaatgt

SEQ ID NO: 74221 - DNA, 20 bp, Artificial Sequence
  Description of Artificial Sequence: Synthetic oligonucleotide
  Target: ATXN1; (-) strand; PAM type: NRG; PAM sequence: AGG
taaatatgttttctaaattc

SEQ ID NO: 74222 - DNA, 20 bp, Artificial Sequence
  Description of Artificial Sequence: Synthetic oligonucleotide
  Target: ATXN1; (-) strand; PAM type: NRG; PAM sequence: CAG
ttaaatatgttttctaaatt

SEQ ID NO: 74223 - DNA, 20 bp, Artificial Sequence
  Description of Artificial Sequence: Synthetic oligonucleotide
  Target: ATXN1; (-) strand; PAM type: NRG; PAM sequence: AAG
agaggttatcaaatgaaatg

SEQ ID NO: 74224 - DNA, 20 bp, Artificial Sequence
  Description of Artificial Sequence: Synthetic oligonucleotide
  Target: ATXN1; (-) strand; PAM type: NRG; PAM sequence: AGG
tcactatttttttctcttag

SEQ ID NO: 74225 - DNA, 20 bp, Artificial Sequence
  Description of Artificial Sequence: Synthetic oligonucleotide
  Target: ATXN1; (-) strand; PAM type: NRG; PAM sequence: GAG
atcactatttttttctctta

SEQ ID NO: 74226 - DNA, 20 bp, Artificial Sequence
  Description of Artificial Sequence: Synthetic oligonucleotide
  Target: ATXN1; (-) strand; PAM type: NRG; PAM sequence: TAG
aaatcactatttttttctct

SEQ ID NO: 74227 - DNA, 20 bp, Artificial Sequence
  Description of Artificial Sequence: Synthetic oligonucleotide
  Target: ATXN1; (-) strand; PAM type: NRG; PAM sequence: TGG
atcaaaatgacagtattcta

SEQ ID NO: 74228 - DNA, 20 bp, Artificial Sequence
  Description of Artificial Sequence: Synthetic oligonucleotide
  Target: ATXN1; (-) strand; PAM type: NRG; PAM sequence: CAG
atacagctttatcaaaatga

SEQ ID NO: 74229 - DNA, 20 bp, Artificial Sequence
  Description of Artificial Sequence: Synthetic oligonucleotide
  Target: ATXN1; (-) strand; PAM type: NRG; PAM sequence: CAG
gtagaaatccaactttcata

SEQ ID NO: 74230 - DNA, 20 bp, Artificial Sequence
  Description of Artificial Sequence: Synthetic oligonucleotide
  Target: ATXN1; (-) strand; PAM type: NRG; PAM sequence: TAG
agtgcgggcaaaactcgagg

SEQ ID NO: 74231 - DNA, 20 bp, Artificial Sequence
  Description of Artificial Sequence: Synthetic oligonucleotide
  Target: ATXN1; (-) strand; PAM type: NRG; PAM sequence: AGG
caaagtgcgggcaaaactcg

SEQ ID NO: 74232 - DNA, 20 bp, Artificial Sequence
  Description of Artificial Sequence: Synthetic oligonucleotide
  Target: ATXN1; (-) strand; PAM type: NRG; PAM sequence: GAG
tcaaagtgcgggcaaaactc

SEQ ID NO: 74233 - DNA, 20 bp, Artificial Sequence
  Description of Artificial Sequence: Synthetic oligonucleotide
  Target: ATXN1; (-) strand; PAM type: NRG; PAM sequence: GGG
aaccatactactcaaagtgc

SEQ ID NO: 74234 - DNA, 20 bp, Artificial Sequence
  Description of Artificial Sequence: Synthetic oligonucleotide
  Target: ATXN1; (-) strand; PAM type: NRG; PAM sequence: CGG
aaaccatactactcaaagtg

SEQ ID NO: 74235 - DNA, 20 bp, Artificial Sequence
  Description of Artificial Sequence: Synthetic oligonucleotide
  Target: ATXN1; (-) strand; PAM type: NRG; PAM sequence: AAG
ttggcaaaccatactactca

SEQ ID NO: 74236 - DNA, 20 bp, Artificial Sequence
  Description of Artificial Sequence: Synthetic oligonucleotide
  Target: ATXN1; (-) strand; PAM type: NRG; PAM sequence: TGG
actaatgctgctttcaatgt

SEQ ID NO: 74237 - DNA, 20 bp, Artificial Sequence
  Description of Artificial Sequence: Synthetic oligonucleotide
  Target: ATXN1; (-) strand; PAM type: NRG; PAM sequence: CAG
ccctaaagcagactgctgca

SEQ ID NO: 74238 - DNA, 20 bp, Artificial Sequence
  Description of Artificial Sequence: Synthetic oligonucleotide
  Target: ATXN1; (-) strand; PAM type: NRG; PAM sequence: CAG
ttcttattgctaccctaaag

SEQ ID NO: 74239 - DNA, 20 bp, Artificial Sequence
  Description of Artificial Sequence: Synthetic oligonucleotide
  Target: ATXN1; (-) strand; PAM type: NRG; PAM sequence: AAG
tctttcttattgctacccta

SEQ ID NO: 74240 - DNA, 20 bp, Artificial Sequence
  Description of Artificial Sequence: Synthetic oligonucleotide
  Target: ATXN1; (-) strand; PAM type: NRG; PAM sequence: AAG
ttagaaaatggttgatatca

SEQ ID NO: 74241 - DNA, 20 bp, Artificial Sequence
  Description of Artificial Sequence: Synthetic oligonucleotide
  Target: ATXN1; (-) strand; PAM type: NRG; PAM sequence: TGG
tcttaaaacacattagaaaa

SEQ ID NO: 74242 - DNA, 20 bp, Artificial Sequence
  Description of Artificial Sequence: Synthetic oligonucleotide
  Target: ATXN1; (-) strand; PAM type: NRG; PAM sequence: TAG
tgtttactcttaaaacacat

SEQ ID NO: 74243 - DNA, 20 bp, Artificial Sequence
  Description of Artificial Sequence: Synthetic oligonucleotide
  Target: ATXN1; (-) strand; PAM type: NRG; PAM sequence: TAG
ataactctcatgaaataagg

SEQ ID NO: 74244 - DNA, 20 bp, Artificial Sequence
  Description of Artificial Sequence: Synthetic oligonucleotide
  Target: ATXN1; (-) strand; PAM type: NRG; PAM sequence: AGG
gtaataactctcatgaaata

SEQ ID NO: 74245 - DNA, 20 bp, Artificial Sequence
  Description of Artificial Sequence: Synthetic oligonucleotide
  Target: ATXN1; (-) strand; PAM type: NRG; PAM sequence: AAG
tgtaataactctcatgaaat

SEQ ID NO: 74246 - DNA, 20 bp, Artificial Sequence
  Description of Artificial Sequence: Synthetic oligonucleotide
  Target: ATXN1; (-) strand; PAM type: NRG; PAM sequence: TAG
tcagtatggaaacattcaca

SEQ ID NO: 74247 - DNA, 20 bp, Artificial Sequence
  Description of Artificial Sequence: Synthetic oligonucleotide
  Target: ATXN1; (-) strand; PAM type: NRG; PAM sequence: TGG
tatgatttctggtgtcagta

SEQ ID NO: 74248 - DNA, 20 bp, Artificial Sequence
  Description of Artificial Sequence: Synthetic oligonucleotide
  Target: ATXN1; (-) strand; PAM type: NRG; PAM sequence: CAG
aataatatgatttctggtgt

SEQ ID NO: 74249 - DNA, 20 bp, Artificial Sequence
  Description of Artificial Sequence: Synthetic oligonucleotide
  Target: ATXN1; (-) strand; PAM type: NRG; PAM sequence: TGG
tttataaataatatgatttc

SEQ ID NO: 74250 - DNA, 20 bp, Artificial Sequence
  Description of Artificial Sequence: Synthetic oligonucleotide
  Target: ATXN1; (-) strand; PAM type: NRG; PAM sequence: AAG
tgaagcattttattctttga

SEQ ID NO: 74251 - DNA, 20 bp, Artificial Sequence
  Description of Artificial Sequence: Synthetic oligonucleotide
  Target: ATXN1; (-) strand; PAM type: NRG; PAM sequence: AAG
acttaccaggcttctttatg

SEQ ID NO: 74252 - DNA, 20 bp, Artificial Sequence
  Description of Artificial Sequence: Synthetic oligonucleotide
  Target: ATXN1; (-) strand; PAM type: NRG; PAM sequence: AGG
aagttttaaaataacttacc

SEQ ID NO: 74253 - DNA, 20 bp, Artificial Sequence
  Description of Artificial Sequence: Synthetic oligonucleotide
  Target: ATXN1; (-) strand; PAM type: NRG; PAM sequence: CAG
aaagttttaaaataacttac

SEQ ID NO: 74254 - DNA, 20 bp, Artificial Sequence
  Description of Artificial Sequence: Synthetic oligonucleotide
  Target: ATXN1; (-) strand; PAM type: NRG; PAM sequence: AAG
aaactattttggatacttta

SEQ ID NO: 74255 - DNA, 20 bp, Artificial Sequence
  Description of Artificial Sequence: Synthetic oligonucleotide
  Target: ATXN1; (-) strand; PAM type: NRG; PAM sequence: TGG
gcgtagcttttaaactattt

SEQ ID NO: 74256 - DNA, 20 bp, Artificial Sequence
  Description of Artificial Sequence: Synthetic oligonucleotide
  Target: ATXN1; (-) strand; PAM type: NRG; PAM sequence: TAG
ttgtgttttatatgtaggcg

SEQ ID NO: 74257 - DNA, 20 bp, Artificial Sequence
  Description of Artificial Sequence: Synthetic oligonucleotide
  Target: ATXN1; (-) strand; PAM type: NRG; PAM sequence: AGG
gtatattgtgttttatatgt

SEQ ID NO: 74258 - DNA, 20 bp, Artificial Sequence
  Description of Artificial Sequence: Synthetic oligonucleotide
  Target: ATXN1; (-) strand; PAM type: NRG; PAM sequence: TAG
agtatattgtgttttatatg

SEQ ID NO: 74259 - DNA, 20 bp, Artificial Sequence
  Description of Artificial Sequence: Synthetic oligonucleotide
  Target: ATXN1; (-) strand; PAM type: NRG; PAM sequence: GAG
atgtagggtcaaagattcaa

SEQ ID NO: 74260 - DNA, 20 bp, Artificial Sequence
  Description of Artificial Sequence: Synthetic oligonucleotide
  Target: ATXN1; (-) strand; PAM type: NRG; PAM sequence: AAG
aaatgtagggtcaaagattc

SEQ ID NO: 74261 - DNA, 20 bp, Artificial Sequence
  Description of Artificial Sequence: Synthetic oligonucleotide
  Target: ATXN1; (-) strand; PAM type: NRG; PAM sequence: AAG
agcgaaaaaatgtagggtca

SEQ ID NO: 74262 - DNA, 20 bp, Artificial Sequence
  Description of Artificial Sequence: Synthetic oligonucleotide
  Target: ATXN1; (-) strand; PAM type: NRG; PAM sequence: GGG
aggaaaagcgaaaaaatgta

SEQ ID NO: 74263 - DNA, 20 bp, Artificial Sequence
  Description of Artificial Sequence: Synthetic oligonucleotide
  Target: ATXN1; (-) strand; PAM type: NRG; PAM sequence: AGG
taggaaaagcgaaaaaatgt

SEQ ID NO: 74264 - DNA, 20 bp, Artificial Sequence
  Description of Artificial Sequence: Synthetic oligonucleotide
  Target: ATXN1; (-) strand; PAM type: NRG; PAM sequence: TAG
ttaggaaaagcgaaaaaatg

SEQ ID NO: 74265 - DNA, 20 bp, Artificial Sequence
  Description of Artificial Sequence: Synthetic oligonucleotide
  Target: ATXN1; (-) strand; PAM type: NRG; PAM sequence: AAG
tttaatgatttttttaggaa

SEQ ID NO: 74266 - DNA, 20 bp, Artificial Sequence
  Description of Artificial Sequence: Synthetic oligonucleotide
  Target: ATXN1; (-) strand; PAM type: NRG; PAM sequence: AGG
agacatttaatgattttttt

SEQ ID NO: 74267 - DNA, 20 bp, Artificial Sequence
  Description of Artificial Sequence: Synthetic oligonucleotide
  Target: ATXN1; (-) strand; PAM type: NRG; PAM sequence: TAG
gagacatttaatgatttttt

SEQ ID NO: 74268 - DNA, 20 bp, Artificial Sequence
  Description of Artificial Sequence: Synthetic oligonucleotide
  Target: ATXN1; (-) strand; PAM type: NRG; PAM sequence: GAG
ttgggtaaaggcattatttt

SEQ ID NO: 74269 - DNA, 20 bp, Artificial Sequence
  Description of Artificial Sequence: Synthetic oligonucleotide
  Target: ATXN1; (-) strand; PAM type: NRG; PAM sequence: AGG
ttcatagccagtttgggtaa

SEQ ID NO: 74270 - DNA, 20 bp, Artificial Sequence
  Description of Artificial Sequence: Synthetic oligonucleotide
  Target: ATXN1; (-) strand; PAM type: NRG; PAM sequence: AAG
attcatagccagtttgggta

SEQ ID NO: 74271 - DNA, 20 bp, Artificial Sequence
  Description of Artificial Sequence: Synthetic oligonucleotide
  Target: ATXN1; (-) strand; PAM type: NRG; PAM sequence: GGG
ccataattcatagccagttt

SEQ ID NO: 74272 - DNA, 20 bp, Artificial Sequence
  Description of Artificial Sequence: Synthetic oligonucleotide
  Target: ATXN1; (-) strand; PAM type: NRG; PAM sequence: TGG
tccataattcatagccagtt

SEQ ID NO: 74273 - DNA, 20 bp, Artificial Sequence
  Description of Artificial Sequence: Synthetic oligonucleotide
  Target: ATXN1; (-) strand; PAM type: NRG; PAM sequence: CAG
tagcctccataattcatagc

SEQ ID NO: 74274 - DNA, 20 bp, Artificial Sequence
  Description of Artificial Sequence: Synthetic oligonucleotide
  Target: ATXN1; (-) strand; PAM type: NRG; PAM sequence: TAG
tagatagcctccataattca

SEQ ID NO: 74275 - DNA, 20 bp, Artificial Sequence
  Description of Artificial Sequence: Synthetic oligonucleotide
  Target: ATXN1; (-) strand; PAM type: NRG; PAM sequence: TAG
cccttccttcaatctgtaga

SEQ ID NO: 74276 - DNA, 20 bp, Artificial Sequence
  Description of Artificial Sequence: Synthetic oligonucleotide
  Target: ATXN1; (-) strand; PAM type: NRG; PAM sequence: TAG
cccacccttccttcaatctg

SEQ ID NO: 74277 - DNA, 20 bp, Artificial Sequence
  Description of Artificial Sequence: Synthetic oligonucleotide
  Target: ATXN1; (-) strand; PAM type: NRG; PAM sequence: CAG
cttccccaaaatttatcttt

SEQ ID NO: 74278 - DNA, 20 bp, Artificial Sequence
  Description of Artificial Sequence: Synthetic oligonucleotide
  Target: ATXN1; (-) strand; PAM type: NRG; PAM sequence: CAG
gatattaagtatttaaaaca

SEQ ID NO: 74279 - DNA, 20 bp, Artificial Sequence
  Description of Artificial Sequence: Synthetic oligonucleotide
  Target: ATXN1; (-) strand; PAM type: NRG; PAM sequence: AAG
aagaaaatcctactgatatt

SEQ ID NO: 74280 - DNA, 20 bp, Artificial Sequence
  Description of Artificial Sequence: Synthetic oligonucleotide
  Target: ATXN1; (-) strand; PAM type: NRG; PAM sequence: AAG
aaatgtacatttctaaggtt

SEQ ID NO: 74281 - DNA, 20 bp, Artificial Sequence
  Description of Artificial Sequence: Synthetic oligonucleotide
  Target: ATXN1; (-) strand; PAM type: NRG; PAM sequence: AGG
ggttgaaatgtacatttcta

SEQ ID NO: 74282 - DNA, 20 bp, Artificial Sequence
  Description of Artificial Sequence: Synthetic oligonucleotide
  Target: ATXN1; (-) strand; PAM type: NRG; PAM sequence: AAG
aggttgaaatgtacatttct

SEQ ID NO: 74283 - DNA, 20 bp, Artificial Sequence
  Description of Artificial Sequence: Synthetic oligonucleotide
  Target: ATXN1; (-) strand; PAM type: NRG; PAM sequence: AGG
ggttgaaaatgaaatgaaaa

SEQ ID NO: 74284 - DNA, 20 bp, Artificial Sequence
  Description of Artificial Sequence: Synthetic oligonucleotide
  Target: ATXN1; (-) strand; PAM type: NRG; PAM sequence: AAG
aggttgaaaatgaaatgaaa

SEQ ID NO: 74285 - DNA, 20 bp, Artificial Sequence
  Description of Artificial Sequence: Synthetic oligonucleotide
  Target: ATXN1; (-) strand; PAM type: NRG; PAM sequence: AGG
tcgactacatctatatcata

SEQ ID NO: 74286 - DNA, 20 bp, Artificial Sequence
  Description of Artificial Sequence: Synthetic oligonucleotide
  Target: ATXN1; (-) strand; PAM type: NRG; PAM sequence: AAG
ttcgactacatctatatcat

SEQ ID NO: 74287 - DNA, 20 bp, Artificial Sequence
  Description of Artificial Sequence: Synthetic oligonucleotide
  Target: ATXN1; (-) strand; PAM type: NRG; PAM sequence: GAG
aagaaaaactgtagggttgt

SEQ ID NO: 74288 - DNA, 20 bp, Artificial Sequence
  Description of Artificial Sequence: Synthetic oligonucleotide
  Target: ATXN1; (-) strand; PAM type: NRG; PAM sequence: GGG
acacaaaaagaaaaactgta

SEQ ID NO: 74289 - DNA, 20 bp, Artificial Sequence
  Description of Artificial Sequence: Synthetic oligonucleotide
  Target: ATXN1; (-) strand; PAM type: NRG; PAM sequence: AGG
aacacaaaaagaaaaactgt

SEQ ID NO: 74290 - DNA, 20 bp, Artificial Sequence
  Description of Artificial Sequence: Synthetic oligonucleotide
  Target: ATXN1; (-) strand; PAM type: NRG; PAM sequence: TAG
aaacacaaaaagaaaaactg

SEQ ID NO: 74291 - DNA, 20 bp, Artificial Sequence
  Description of Artificial Sequence: Synthetic oligonucleotide
  Target: ATXN1; (-) strand; PAM type: NRG; PAM sequence: AAG
ttatcctacagaaacacaaa

SEQ ID NO: 74292 - DNA, 20 bp, Artificial Sequence
  Description of Artificial Sequence: Synthetic oligonucleotide
  Target: ATXN1; (-) strand; PAM type: NRG; PAM sequence: CAG
gaaatgtttcctttatccta

SEQ ID NO: 74293 - DNA, 20 bp, Artificial Sequence
  Description of Artificial Sequence: Synthetic oligonucleotide
  Target: ATXN1; (-) strand; PAM type: NRG; PAM sequence: AGG
caccccgcccctcagctctt

SEQ ID NO: 74294 - DNA, 20 bp, Artificial Sequence
  Description of Artificial Sequence: Synthetic oligonucleotide
  Target: ATXN1; (-) strand; PAM type: NRG; PAM sequence: TAG
ccaccccgcccctcagctct

SEQ ID NO: 74295 - DNA, 20 bp, Artificial Sequence
  Description of Artificial Sequence: Synthetic oligonucleotide
  Target: ATXN1; (-) strand; PAM type: NRG; PAM sequence: CAG
atgtaacccaccccgcccct

SEQ ID NO: 74296 - DNA, 20 bp, Artificial Sequence
  Description of Artificial Sequence: Synthetic oligonucleotide
  Target: ATXN1; (-) strand; PAM type: NRG; PAM sequence: AGG
catggggtcttttccccttc

SEQ ID NO: 74297 - DNA, 20 bp, Artificial Sequence
  Description of Artificial Sequence: Synthetic oligonucleotide
  Target: ATXN1; (-) strand; PAM type: NRG; PAM sequence: CAG
acatggggtcttttcccctt

SEQ ID NO: 74298 - DNA, 20 bp, Artificial Sequence
  Description of Artificial Sequence: Synthetic oligonucleotide
  Target: ATXN1; (-) strand; PAM type: NRG; PAM sequence: GGG
acagtgcattctcgaacatg

SEQ ID NO: 74299 - DNA, 20 bp, Artificial Sequence
  Description of Artificial Sequence: Synthetic oligonucleotide
  Target: ATXN1; (-) strand; PAM type: NRG; PAM sequence: GGG
cacagtgcattctcgaacat

SEQ ID NO: 74300 - DNA, 20 bp, Artificial Sequence
  Description of Artificial Sequence: Synthetic oligonucleotide
  Target: ATXN1; (-) strand; PAM type: NRG; PAM sequence: TGG
acacagtgcattctcgaaca

SEQ ID NO: 74301 - DNA, 20 bp, Artificial Sequence
  Description of Artificial Sequence: Synthetic oligonucleotide
  Target: ATXN1; (-) strand; PAM type: NRG; PAM sequence: CAG
cacacacacacacacacaca

SEQ ID NO: 74302 - DNA, 20 bp, Artificial Sequence
  Description of Artificial Sequence: Synthetic oligonucleotide
  Target: ATXN1; (-) strand; PAM type: NRG; PAM sequence: CAG
tccccatccacacacccacc

SEQ ID NO: 74303 - DNA, 20 bp, Artificial Sequence
  Description of Artificial Sequence: Synthetic oligonucleotide
  Target: ATXN1; (-) strand; PAM type: NRG; PAM sequence: GAG
tttctttaacatgtccagtt

SEQ ID NO: 74304 - DNA, 20 bp, Artificial Sequence
  Description of Artificial Sequence: Synthetic oligonucleotide
  Target: ATXN1; (-) strand; PAM type: NRG; PAM sequence: CAG
tcttctttctttaacatgtc

SEQ ID NO: 74305 - DNA, 20 bp, Artificial Sequence
  Description of Artificial Sequence: Synthetic oligonucleotide
  Target: ATXN1; (-) strand; PAM type: NRG; PAM sequence: CAG
catccaccacgtactctacc

SEQ ID NO: 74306 - DNA, 20 bp, Artificial Sequence
  Description of Artificial Sequence: Synthetic oligonucleotide
  Target: ATXN1; (-) strand; PAM type: NRG; PAM sequence: GGG
cctggtcagctgctctcttc

SEQ ID NO: 74307 - DNA, 20 bp, Artificial Sequence
  Description of Artificial Sequence: Synthetic oligonucleotide
  Target: ATXN1; (-) strand; PAM type: NRG; PAM sequence: CGG
ccctggtcagctgctctctt

SEQ ID NO: 74308 - DNA, 20 bp, Artificial Sequence
  Description of Artificial Sequence: Synthetic oligonucleotide
  Target: ATXN1; (-) strand; PAM type: NRG; PAM sequence: CAG
ctattgtatccctccctggt

SEQ ID NO: 74309 - DNA, 20 bp, Artificial Sequence
  Description of Artificial Sequence: Synthetic oligonucleotide
  Target: ATXN1; (-) strand; PAM type: NRG; PAM sequence: TGG
ttctctattgtatccctccc

SEQ ID NO: 74310 - DNA, 20 bp, Artificial Sequence
  Description of Artificial Sequence: Synthetic oligonucleotide
  Target: ATXN1; (-) strand; PAM type: NRG; PAM sequence: CGG
aaaggctgcatttttagctt

SEQ ID NO: 74311 - DNA, 20 bp, Artificial Sequence
  Description of Artificial Sequence: Synthetic oligonucleotide
  Target: ATXN1; (-) strand; PAM type: NRG; PAM sequence: TAG
tttggtaaaggctgcatttt

SEQ ID NO: 74312 - DNA, 20 bp, Artificial Sequence
  Description of Artificial Sequence: Synthetic oligonucleotide
  Target: ATXN1; (-) strand; PAM type: NRG; PAM sequence: AGG
ccttgacctgcatttggtaa

SEQ ID NO: 74313 - DNA, 20 bp, Artificial Sequence
  Description of Artificial Sequence: Synthetic oligonucleotide
  Target: ATXN1; (-) strand; PAM type: NRG; PAM sequence: AAG
gccttgacctgcatttggta

SEQ ID NO: 74314 - DNA, 20 bp, Artificial Sequence
  Description of Artificial Sequence: Synthetic oligonucleotide
  Target: ATXN1; (-) strand; PAM type: NRG; PAM sequence: TGG
cttaggccttgacctgcatt

SEQ ID NO: 74315 - DNA, 20 bp, Artificial Sequence
  Description of Artificial Sequence: Synthetic oligonucleotide
  Target: ATXN1; (-) strand; PAM type: NRG; PAM sequence: AGG
gagatttcttttatctcctt

SEQ ID NO: 74316 - DNA, 20 bp, Artificial Sequence
  Description of Artificial Sequence: Synthetic oligonucleotide
  Target: ATXN1; (-) strand; PAM type: NRG; PAM sequence: TAG
agagatttcttttatctcct

SEQ ID NO: 74317 - DNA, 20 bp, Artificial Sequence
  Description of Artificial Sequence: Synthetic oligonucleotide
  Target: ATXN1; (-) strand; PAM type: NRG; PAM sequence: GAG
taaataacaggctctgctca

SEQ ID NO: 74318 - DNA, 20 bp, Artificial Sequence
  Description of Artificial Sequence: Synthetic oligonucleotide
  Target: ATXN1; (-) strand; PAM type: NRG; PAM sequence: CAG
cttaaataacaggctctgct

SEQ ID NO: 74319 - DNA, 20 bp, Artificial Sequence
  Description of Artificial Sequence: Synthetic oligonucleotide
  Target: ATXN1; (-) strand; PAM type: NRG; PAM sequence: AGG
ttagtggtctcttaaataac

SEQ ID NO: 74320 - DNA, 20 bp, Artificial Sequence
  Description of Artificial Sequence: Synthetic oligonucleotide
  Target: ATXN1; (-) strand; PAM type: NRG; PAM sequence: CAG
tttagtggtctcttaaataa

SEQ ID NO: 74321 - DNA, 20 bp, Artificial Sequence
  Description of Artificial Sequence: Synthetic oligonucleotide
  Target: ATXN1; (-) strand; PAM type: NRG; PAM sequence: TGG
ccattcctgggtgcttttag

SEQ ID NO: 74322 - DNA, 20 bp, Artificial Sequence
  Description of Artificial Sequence: Synthetic oligonucleotide
  Target: ATXN1; (-) strand; PAM type: NRG; PAM sequence: TAG
cctccattcctgggtgcttt

SEQ ID NO: 74323 - DNA, 20 bp, Artificial Sequence
  Description of Artificial Sequence: Synthetic oligonucleotide
  Target: ATXN1; (-) strand; PAM type: NRG; PAM sequence: GGG
accttcctccctccattcct

SEQ ID NO: 74324 - DNA, 20 bp, Artificial Sequence
  Description of Artificial Sequence: Synthetic oligonucleotide
  Target: ATXN1; (-) strand; PAM type: NRG; PAM sequence: TGG
taccttcctccctccattcc

SEQ ID NO: 74325 - DNA, 20 bp, Artificial Sequence
  Description of Artificial Sequence: Synthetic oligonucleotide
  Target: ATXN1; (-) strand; PAM type: NRG; PAM sequence: TGG
cagcattgtttgtgggattg

SEQ ID NO: 74326 - DNA, 20 bp, Artificial Sequence
  Description of Artificial Sequence: Synthetic oligonucleotide
  Target: ATXN1; (-) strand; PAM type: NRG; PAM sequence: GGG
ttccactcagcattgtttgt

SEQ ID NO: 74327 - DNA, 20 bp, Artificial Sequence
  Description of Artificial Sequence: Synthetic oligonucleotide
  Target: ATXN1; (-) strand; PAM type: NRG; PAM sequence: TGG
cttccactcagcattgtttg

SEQ ID NO: 74328 - DNA, 20 bp, Artificial Sequence
  Description of Artificial Sequence: Synthetic oligonucleotide
  Target: ATXN1; (-) strand; PAM type: NRG; PAM sequence: CAG
ctatttggtacccttccact

SEQ ID NO: 74329 - DNA, 20 bp, Artificial Sequence
  Description of Artificial Sequence: Synthetic oligonucleotide
  Target: ATXN1; (-) strand; PAM type: NRG; PAM sequence: TGG
atcttgacctctttactatt

SEQ ID NO: 74330 - DNA, 20 bp, Artificial Sequence
  Description of Artificial Sequence: Synthetic oligonucleotide
  Target: ATXN1; (-) strand; PAM type: NRG; PAM sequence: TAG
taggttccagatctaaataa

SEQ ID NO: 74331 - DNA, 20 bp, Artificial Sequence
  Description of Artificial Sequence: Synthetic oligonucleotide
  Target: ATXN1; (-) strand; PAM type: NRG; PAM sequence: CAG
tttaaacagattttaggttc

SEQ ID NO: 74332 - DNA, 20 bp, Artificial Sequence
  Description of Artificial Sequence: Synthetic oligonucleotide
  Target: ATXN1; (-) strand; PAM type: NRG; PAM sequence: AGG
gttcactttaaacagatttt

SEQ ID NO: 74333 - DNA, 20 bp, Artificial Sequence
  Description of Artificial Sequence: Synthetic oligonucleotide
  Target: ATXN1; (-) strand; PAM type: NRG; PAM sequence: TAG
agttcactttaaacagattt

SEQ ID NO: 74334 - DNA, 20 bp, Artificial Sequence
  Description of Artificial Sequence: Synthetic oligonucleotide
  Target: ATXN1; (-) strand; PAM type: NRG; PAM sequence: CAG
tttatttagttcactttaaa

SEQ ID NO: 74335 - DNA, 20 bp, Artificial Sequence
  Description of Artificial Sequence: Synthetic oligonucleotide
  Target: ATXN1; (-) strand; PAM type: NRG; PAM sequence: TAG
catgcataattaactttatt

SEQ ID NO: 74336 - DNA, 20 bp, Artificial Sequence
  Description of Artificial Sequence: Synthetic oligonucleotide
  Target: ATXN1; (-) strand; PAM type: NRG; PAM sequence: GAG
tataattcacctcagagagt

SEQ ID NO: 74337 - DNA, 20 bp, Artificial Sequence
  Description of Artificial Sequence: Synthetic oligonucleotide
  Target: ATXN1; (-) strand; PAM type: NRG; PAM sequence: GAG
ccactataattcacctcaga

SEQ ID NO: 74338 - DNA, 20 bp, Artificial Sequence
  Description of Artificial Sequence: Synthetic oligonucleotide
  Target: ATXN1; (-) strand; PAM type: NRG; PAM sequence: GAG
acccactataattcacctca

SEQ ID NO: 74339 - DNA, 20 bp, Artificial Sequence
  Description of Artificial Sequence: Synthetic oligonucleotide
  Target: ATXN1; (-) strand; PAM type: NRG; PAM sequence: CAG
ttacccactataattcacct

SEQ ID NO: 74340 - DNA, 20 bp, Artificial Sequence
  Description of Artificial Sequence: Synthetic oligonucleotide
  Target: ATXN1; (-) strand; PAM type: NRG; PAM sequence: CAG
aaggaagaatcgaggtgcac

SEQ ID NO: 74341 - DNA, 20 bp, Artificial Sequence
  Description of Artificial Sequence: Synthetic oligonucleotide
  Target: ATXN1; (-) strand; PAM type: NRG; PAM sequence: AGG
accacccaaaggaagaatcg

SEQ ID NO: 74342 - DNA, 20 bp, Artificial Sequence
  Description of Artificial Sequence: Synthetic oligonucleotide
  Target: ATXN1; (-) strand; PAM type: NRG; PAM sequence: GAG
aaccacccaaaggaagaatc

SEQ ID NO: 74343 - DNA, 20 bp, Artificial Sequence
  Description of Artificial Sequence: Synthetic oligonucleotide
  Target: ATXN1; (-) strand; PAM type: NRG; PAM sequence: AAG
ttttcttaaccacccaaagg

SEQ ID NO: 74344 - DNA, 20 bp, Artificial Sequence
  Description of Artificial Sequence: Synthetic oligonucleotide
  Target: ATXN1; (-) strand; PAM type: NRG; PAM sequence: AGG
gatttttcttaaccacccaa

SEQ ID NO: 74345 - DNA, 20 bp, Artificial Sequence
  Description of Artificial Sequence: Synthetic oligonucleotide
  Target: ATXN1; (-) strand; PAM type: NRG; PAM sequence: AAG
tgatttttcttaaccaccca

SEQ ID NO: 74346 - DNA, 20 bp, Artificial Sequence
  Description of Artificial Sequence: Synthetic oligonucleotide
  Target: ATXN1; (-) strand; PAM type: NRG; PAM sequence: TGG
accgtgtctttatcacagta

SEQ ID NO: 74347 - DNA, 20 bp, Artificial Sequence
  Description of Artificial Sequence: Synthetic oligonucleotide
  Target: ATXN1; (-) strand; PAM type: NRG; PAM sequence: CAG
atgtcaccgtgtctttatca

SEQ ID NO: 74348 - DNA, 20 bp, Artificial Sequence
  Description of Artificial Sequence: Synthetic oligonucleotide
  Target: ATXN1; (-) strand; PAM type: NRG; PAM sequence: TGG
ctacaaacatgttagaaaga

SEQ ID NO: 74349 - DNA, 20 bp, Artificial Sequence
  Description of Artificial Sequence: Synthetic oligonucleotide
  Target: ATXN1; (-) strand; PAM type: NRG; PAM sequence: AAG
aactctacaaacatgttaga

SEQ ID NO: 74350 - DNA, 20 bp, Artificial Sequence
  Description of Artificial Sequence: Synthetic oligonucleotide
  Target: ATXN1; (-) strand; PAM type: NRG; PAM sequence: TAG
ttataactctacaaacatgt

SEQ ID NO: 74351 - DNA, 20 bp, Artificial Sequence
  Description of Artificial Sequence: Synthetic oligonucleotide
  Target: ATXN1; (-) strand; PAM type: NRG; PAM sequence: GAG
tccttaagaaattgtgaaat

SEQ ID NO: 74352 - DNA, 20 bp, Artificial Sequence
  Description of Artificial Sequence: Synthetic oligonucleotide
  Target: ATXN1; (-) strand; PAM type: NRG; PAM sequence: AAG
tattgacaatccatatcctt

SEQ ID NO: 74353 - DNA, 20 bp, Artificial Sequence
  Description of Artificial Sequence: Synthetic oligonucleotide
  Target: ATXN1; (-) strand; PAM type: NRG; PAM sequence: AGG
ggctactcatctctcaattt

SEQ ID NO: 74354 - DNA, 20 bp, Artificial Sequence
  Description of Artificial Sequence: Synthetic oligonucleotide
  Target: ATXN1; (-) strand; PAM type: NRG; PAM sequence: TAG
gggctactcatctctcaatt

SEQ ID NO: 74355 - DNA, 20 bp, Artificial Sequence
  Description of Artificial Sequence: Synthetic oligonucleotide
  Target: ATXN1; (-) strand; PAM type: NRG; PAM sequence: GGG
tagggccagtaaagatcatc

SEQ ID NO: 74356 - DNA, 20 bp, Artificial Sequence
  Description of Artificial Sequence: Synthetic oligonucleotide
  Target: ATXN1; (-) strand; PAM type: NRG; PAM sequence: CGG
ctagggccagtaaagatcat

SEQ ID NO: 74357 - DNA, 20 bp, Artificial Sequence
  Description of Artificial Sequence: Synthetic oligonucleotide
  Target: ATXN1; (-) strand; PAM type: NRG; PAM sequence: AAG
cacagttgctagggccagta

SEQ ID NO: 74358 - DNA, 20 bp, Artificial Sequence
  Description of Artificial Sequence: Synthetic oligonucleotide
  Target: ATXN1; (-) strand; PAM type: NRG; PAM sequence: CAG
gaatgcacagttgctagggc

SEQ ID NO: 74359 - DNA, 20 bp, Artificial Sequence
  Description of Artificial Sequence: Synthetic oligonucleotide
  Target: ATXN1; (-) strand; PAM type: NRG; PAM sequence: GGG
cctcgaatgcacagttgcta

SEQ ID NO: 74360 - DNA, 20 bp, Artificial Sequence
  Description of Artificial Sequence: Synthetic oligonucleotide
  Target: ATXN1; (-) strand; PAM type: NRG; PAM sequence: AGG
ccctcgaatgcacagttgct

SEQ ID NO: 74361 - DNA, 20 bp, Artificial Sequence
  Description of Artificial Sequence: Synthetic oligonucleotide
  Target: ATXN1; (-) strand; PAM type: NRG; PAM sequence: TAG
cccctcgaatgcacagttgc

SEQ ID NO: 74362 - DNA, 20 bp, Artificial Sequence
  Description of Artificial Sequence: Synthetic oligonucleotide
  Target: ATXN1; (-) strand; PAM type: NRG; PAM sequence: CAG
tctaacacccctcgaatgca

SEQ ID NO: 74363 - DNA, 20 bp, Artificial Sequence
  Description of Artificial Sequence: Synthetic oligonucleotide
  Target: ATXN1; (-) strand; PAM type: NRG; PAM sequence: AAG
aatgaagaaggtaaggagag

SEQ ID NO: 74364 - DNA, 20 bp, Artificial Sequence
  Description of Artificial Sequence: Synthetic oligonucleotide
  Target: ATXN1; (-) strand; PAM type: NRG; PAM sequence: GAG
ggaaatgaagaaggtaagga

SEQ ID NO: 74365 - DNA, 20 bp, Artificial Sequence
  Description of Artificial Sequence: Synthetic oligonucleotide
  Target: ATXN1; (-) strand; PAM type: NRG; PAM sequence: GAG
caggaaatgaagaaggtaag

SEQ ID NO: 74366 - DNA, 20 bp, Artificial Sequence
  Description of Artificial Sequence: Synthetic oligonucleotide
  Target: ATXN1; (-) strand; PAM type: NRG; PAM sequence: AGG
gccaggaaatgaagaaggta

SEQ ID NO: 74367 - DNA, 20 bp, Artificial Sequence
  Description of Artificial Sequence: Synthetic oligonucleotide
  Target: ATXN1; (-) strand; PAM type: NRG; PAM sequence: AAG
ggccaggaaatgaagaaggt

SEQ ID NO: 74368 - DNA, 20 bp, Artificial Sequence
  Description of Artificial Sequence: Synthetic oligonucleotide
  Target: ATXN1; (-) strand; PAM type: NRG; PAM sequence: AGG
accaggccaggaaatgaaga

SEQ ID NO: 74369 - DNA, 20 bp, Artificial Sequence
  Description of Artificial Sequence: Synthetic oligonucleotide
  Target: ATXN1; (-) strand; PAM type: NRG; PAM sequence: AAG
gaccaggccaggaaatgaag

SEQ ID NO: 74370 - DNA, 20 bp, Artificial Sequence
  Description of Artificial Sequence: Synthetic oligonucleotide
  Target: ATXN1; (-) strand; PAM type: NRG; PAM sequence: AAG
ccggaccaggccaggaaatg

SEQ ID NO: 74371 - DNA, 20 bp, Artificial Sequence
  Description of Artificial Sequence: Synthetic oligonucleotide
  Target: ATXN1; (-) strand; PAM type: NRG; PAM sequence: AGG
gttgacagccggaccaggcc

SEQ ID NO: 74372 - DNA, 20 bp, Artificial Sequence
  Description of Artificial Sequence: Synthetic oligonucleotide
  Target: ATXN1; (-) strand; PAM type: NRG; PAM sequence: CAG
tgttgacagccggaccaggc

SEQ ID NO: 74373 - DNA, 20 bp, Artificial Sequence
  Description of Artificial Sequence: Synthetic oligonucleotide
  Target: ATXN1; (-) strand; PAM type: NRG; PAM sequence: AGG
tgattgttgacagccggacc

SEQ ID NO: 74374 - DNA, 20 bp, Artificial Sequence
  Description of Artificial Sequence: Synthetic oligonucleotide
  Target: ATXN1; (-) strand; PAM type: NRG; PAM sequence: CAG
gtgattgttgacagccggac

SEQ ID NO: 74375 - DNA, 20 bp, Artificial Sequence
  Description of Artificial Sequence: Synthetic oligonucleotide
  Target: ATXN1; (-) strand; PAM type: NRG; PAM sequence: CGG
aggttgtgattgttgacagc

SEQ ID NO: 74376 - DNA, 20 bp, Artificial Sequence
  Description of Artificial Sequence: Synthetic oligonucleotide
  Target: ATXN1; (-) strand; PAM type: NRG; PAM sequence: CAG
aatgaggttgtgattgttga

SEQ ID NO: 74377 - DNA, 20 bp, Artificial Sequence
  Description of Artificial Sequence: Synthetic oligonucleotide
  Target: ATXN1; (-) strand; PAM type: NRG; PAM sequence: AGG
atagtcagggactgacaatg

SEQ ID NO: 74378 - DNA, 20 bp, Artificial Sequence
  Description of Artificial Sequence: Synthetic oligonucleotide
  Target: ATXN1; (-) strand; PAM type: NRG; PAM sequence: GAG
aatagtcagggactgacaat

SEQ ID NO: 74379 - DNA, 20 bp, Artificial Sequence
  Description of Artificial Sequence: Synthetic oligonucleotide
  Target: ATXN1; (-) strand; PAM type: NRG; PAM sequence: GGG
aaagaaccagagaatagtca

SEQ ID NO: 74380 - DNA, 20 bp, Artificial Sequence
  Description of Artificial Sequence: Synthetic oligonucleotide
  Target: ATXN1; (-) strand; PAM type: NRG; PAM sequence: AGG
gaaagaaccagagaatagtc

SEQ ID NO: 74381 - DNA, 20 bp, Artificial Sequence
  Description of Artificial Sequence: Synthetic oligonucleotide
  Target: ATXN1; (-) strand; PAM type: NRG; PAM sequence: CAG
agaaagaaccagagaatagt

SEQ ID NO: 74382 - DNA, 20 bp, Artificial Sequence
  Description of Artificial Sequence: Synthetic oligonucleotide
  Target: ATXN1; (-) strand; PAM type: NRG; PAM sequence: TAG
gaacagaaagaaccagagaa

SEQ ID NO: 74383 - DNA, 20 bp, Artificial Sequence
  Description of Artificial Sequence: Synthetic oligonucleotide
  Target: ATXN1; (-) strand; PAM type: NRG; PAM sequence: GAG
gcatagaacagaaagaacca

SEQ ID NO: 74384 - DNA, 20 bp, Artificial Sequence
  Description of Artificial Sequence: Synthetic oligonucleotide
  Target: ATXN1; (-) strand; PAM type: NRG; PAM sequence: CAG
aggcatagaacagaaagaac

SEQ ID NO: 74385 - DNA, 20 bp, Artificial Sequence
  Description of Artificial Sequence: Synthetic oligonucleotide
  Target: ATXN1; (-) strand; PAM type: NRG; PAM sequence: AAG
tctggaaggcatagaacaga

SEQ ID NO: 74386 - DNA, 20 bp, Artificial Sequence
  Description of Artificial Sequence: Synthetic oligonucleotide
  Target: ATXN1; (-) strand; PAM type: NRG; PAM sequence: CAG
ttgatctggaaggcatagaa

SEQ ID NO: 74387 - DNA, 20 bp, Artificial Sequence
  Description of Artificial Sequence: Synthetic oligonucleotide
  Target: ATXN1; (-) strand; PAM type: NRG; PAM sequence: TAG
acctgttgatctggaaggca

SEQ ID NO: 74388 - DNA, 20 bp, Artificial Sequence
  Description of Artificial Sequence: Synthetic oligonucleotide
  Target: ATXN1; (-) strand; PAM type: NRG; PAM sequence: AGG
gacagacctgttgatctgga

SEQ ID NO: 74389 - DNA, 20 bp, Artificial Sequence
  Description of Artificial Sequence: Synthetic oligonucleotide
  Target: ATXN1; (-) strand; PAM type: NRG; PAM sequence: AAG
agacagacctgttgatctgg

SEQ ID NO: 74390 - DNA, 20 bp, Artificial Sequence
  Description of Artificial Sequence: Synthetic oligonucleotide
  Target: ATXN1; (-) strand; PAM type: NRG; PAM sequence: TGG
gggagacagacctgttgatc

SEQ ID NO: 74391 - DNA, 20 bp, Artificial Sequence
  Description of Artificial Sequence: Synthetic oligonucleotide
  Target: ATXN1; (-) strand; PAM type: NRG; PAM sequence: CAG
actggagaaaccaggggaga

SEQ ID NO: 74392 - DNA, 20 bp, Artificial Sequence
  Description of Artificial Sequence: Synthetic oligonucleotide
  Target: ATXN1; (-) strand; PAM type: NRG; PAM sequence: GAG
ggaaactggagaaaccaggg

SEQ ID NO: 74393 - DNA, 20 bp, Artificial Sequence
  Description of Artificial Sequence: Synthetic oligonucleotide
  Target: ATXN1; (-) strand; PAM type: NRG; PAM sequence: GGG
ttggaaactggagaaaccag

SEQ ID NO: 74394 - DNA, 20 bp, Artificial Sequence
  Description of Artificial Sequence: Synthetic oligonucleotide
  Target: ATXN1; (-) strand; PAM type: NRG; PAM sequence: GGG
attggaaactggagaaacca

SEQ ID NO: 74395 - DNA, 20 bp, Artificial Sequence
  Description of Artificial Sequence: Synthetic oligonucleotide
  Target: ATXN1; (-) strand; PAM type: NRG; PAM sequence: AGG
aattggaaactggagaaacc

SEQ ID NO: 74396 - DNA, 20 bp, Artificial Sequence
  Description of Artificial Sequence: Synthetic oligonucleotide
  Target: ATXN1; (-) strand; PAM type: NRG; PAM sequence: CAG
aaattggaaactggagaaac

SEQ ID NO: 74397 - DNA, 20 bp, Artificial Sequence
  Description of Artificial Sequence: Synthetic oligonucleotide
  Target: ATXN1; (-) strand; PAM type: NRG; PAM sequence: GAG
gcatctgaaattggaaactg

SEQ ID NO: 74398 - DNA, 20 bp, Artificial Sequence
  Description of Artificial Sequence: Synthetic oligonucleotide
  Target: ATXN1; (-) strand; PAM type: NRG; PAM sequence: TGG
gtgcatctgaaattggaaac

SEQ ID NO: 74399 - DNA, 20 bp, Artificial Sequence
  Description of Artificial Sequence: Synthetic oligonucleotide
  Target: ATXN1; (-) strand; PAM type: NRG; PAM sequence: TGG
gcaagaggtgcatctgaaat

SEQ ID NO: 74400 - DNA, 20 bp, Artificial Sequence
  Description of Artificial Sequence: Synthetic oligonucleotide
  Target: ATXN1; (-) strand; PAM type: NRG; PAM sequence: AGG
ccattctaaaaggaggcaag

SEQ ID NO: 74401 - DNA, 20 bp, Artificial Sequence
  Description of Artificial Sequence: Synthetic oligonucleotide
  Target: ATXN1; (-) strand; PAM type: NRG; PAM sequence: GAG
accattctaaaaggaggcaa

SEQ ID NO: 74402 - DNA, 20 bp, Artificial Sequence
  Description of Artificial Sequence: Synthetic oligonucleotide
  Target: ATXN1; (-) strand; PAM type: NRG; PAM sequence: AAG
ggaccattctaaaaggaggc

SEQ ID NO: 74403 - DNA, 20 bp, Artificial Sequence
  Description of Artificial Sequence: Synthetic oligonucleotide
  Target: ATXN1; (-) strand; PAM type: NRG; PAM sequence: AGG
aactggaccattctaaaagg

SEQ ID NO: 74404 - DNA, 20 bp, Artificial Sequence
  Description of Artificial Sequence: Synthetic oligonucleotide
  Target: ATXN1; (-) strand; PAM type: NRG; PAM sequence: GAG
gaactggaccattctaaaag

SEQ ID NO: 74405 - DNA, 20 bp, Artificial Sequence
  Description of Artificial Sequence: Synthetic oligonucleotide
  Target: ATXN1; (-) strand; PAM type: NRG; PAM sequence: AGG
atgaactggaccattctaaa

SEQ ID NO: 74406 - DNA, 20 bp, Artificial Sequence
  Description of Artificial Sequence: Synthetic oligonucleotide
  Target: ATXN1; (-) strand; PAM type: NRG; PAM sequence: AAG
gatgaactggaccattctaa

SEQ ID NO: 74407 - DNA, 20 bp, Artificial Sequence
  Description of Artificial Sequence: Synthetic oligonucleotide
  Target: ATXN1; (-) strand; PAM type: NRG; PAM sequence: TGG
ggggaacaggggagatgaac

SEQ ID NO: 74408 - DNA, 20 bp, Artificial Sequence
  Description of Artificial Sequence: Synthetic oligonucleotide
  Target: ATXN1; (-) strand; PAM type: NRG; PAM sequence: GAG
actggtttgggggaacaggg

SEQ ID NO: 74409 - DNA, 20 bp, Artificial Sequence
  Description of Artificial Sequence: Synthetic oligonucleotide
  Target: ATXN1; (-) strand; PAM type: NRG; PAM sequence: GGG
taactggtttgggggaacag

SEQ ID NO: 74410 - DNA, 20 bp, Artificial Sequence
  Description of Artificial Sequence: Synthetic oligonucleotide
  Target: ATXN1; (-) strand; PAM type: NRG; PAM sequence: GGG
ataactggtttgggggaaca

SEQ ID NO: 74411 - DNA, 20 bp, Artificial Sequence
  Description of Artificial Sequence: Synthetic oligonucleotide
  Target: ATXN1; (-) strand; PAM type: NRG; PAM sequence: AGG
cataactggtttgggggaac

SEQ ID NO: 74412 - DNA, 20 bp, Artificial Sequence
  Description of Artificial Sequence: Synthetic oligonucleotide
  Target: ATXN1; (-) strand; PAM type: NRG; PAM sequence: CAG
tcataactggtttgggggaa

SEQ ID NO: 74413 - DNA, 20 bp, Artificial Sequence
  Description of Artificial Sequence: Synthetic oligonucleotide
  Target: ATXN1; (-) strand; PAM type: NRG; PAM sequence: GGG
caccatcataactggtttgg

SEQ ID NO: 74414 - DNA, 20 bp, Artificial Sequence
  Description of Artificial Sequence: Synthetic oligonucleotide
  Target: ATXN1; (-) strand; PAM type: NRG; PAM sequence: GGG
acaccatcataactggtttg

SEQ ID NO: 74415 - DNA, 20 bp, Artificial Sequence
  Description of Artificial Sequence: Synthetic oligonucleotide
  Target: ATXN1; (-) strand; PAM type: NRG; PAM sequence: GGG
aacaccatcataactggttt

SEQ ID NO: 74416 - DNA, 20 bp, Artificial Sequence
  Description of Artificial Sequence: Synthetic oligonucleotide
  Target: ATXN1; (-) strand; PAM type: NRG; PAM sequence: TGG
caacaccatcataactggtt

SEQ ID NO: 74417 - DNA, 20 bp, Artificial Sequence
  Description of Artificial Sequence: Synthetic oligonucleotide
  Target: ATXN1; (-) strand; PAM type: NRG; PAM sequence: TGG
acagtcaacaccatcataac

SEQ ID NO: 74418 - DNA, 20 bp, Artificial Sequence
  Description of Artificial Sequence: Synthetic oligonucleotide
  Target: ATXN1; (-) strand; PAM type: NRG; PAM sequence: CAG
ttacagttctcagggagata

SEQ ID NO: 74419 - DNA, 20 bp, Artificial Sequence
  Description of Artificial Sequence: Synthetic oligonucleotide
  Target: ATXN1; (-) strand; PAM type: NRG; PAM sequence: GAG
tggagtttacagttctcagg

SEQ ID NO: 74420 - DNA, 20 bp, Artificial Sequence
  Description of Artificial Sequence: Synthetic oligonucleotide
  Target: ATXN1; (-) strand; PAM type: NRG; PAM sequence: GGG
aatggagtttacagttctca

SEQ ID NO: 74421 - DNA, 20 bp, Artificial Sequence
  Description of Artificial Sequence: Synthetic oligonucleotide
  Target: ATXN1; (-) strand; PAM type: NRG; PAM sequence: AGG
taatggagtttacagttctc

SEQ ID NO: 74422 - DNA, 20 bp, Artificial Sequence
  Description of Artificial Sequence: Synthetic oligonucleotide
  Target: ATXN1; (-) strand; PAM type: NRG; PAM sequence: CAG
ctaatggagtttacagttct

SEQ ID NO: 74423 - DNA, 20 bp, Artificial Sequence
  Description of Artificial Sequence: Synthetic oligonucleotide
  Target: ATXN1; (-) strand; PAM type: NRG; PAM sequence: CAG
actggccctaatggagttta

SEQ ID NO: 74424 - DNA, 20 bp, Artificial Sequence
  Description of Artificial Sequence: Synthetic oligonucleotide
  Target: ATXN1; (-) strand; PAM type: NRG; PAM sequence: GAG
acaaaagactggccctaatg

SEQ ID NO: 74425 - DNA, 20 bp, Artificial Sequence
  Description of Artificial Sequence: Synthetic oligonucleotide
  Target: ATXN1; (-) strand; PAM type: NRG; PAM sequence: TGG
tgacaaaagactggccctaa

SEQ ID NO: 74426 - DNA, 20 bp, Artificial Sequence
  Description of Artificial Sequence: Synthetic oligonucleotide
  Target: ATXN1; (-) strand; PAM type: NRG; PAM sequence: TGG
aaacaagattgacaaaagac

SEQ ID NO: 74427 - DNA, 20 bp, Artificial Sequence
  Description of Artificial Sequence: Synthetic oligonucleotide
  Target: ATXN1; (-) strand; PAM type: NRG; PAM sequence: AAG
gaggaaaacaagattgacaa

SEQ ID NO: 74428 - DNA, 20 bp, Artificial Sequence
  Description of Artificial Sequence: Synthetic oligonucleotide
  Target: ATXN1; (-) strand; PAM type: NRG; PAM sequence: AAG
tgaagataatggaggaaaac

SEQ ID NO: 74429 - DNA, 20 bp, Artificial Sequence
  Description of Artificial Sequence: Synthetic oligonucleotide
  Target: ATXN1; (-) strand; PAM type: NRG; PAM sequence: AGG
ctgggcattgaagataatgg

SEQ ID NO: 74430 - DNA, 20 bp, Artificial Sequence
  Description of Artificial Sequence: Synthetic oligonucleotide
  Target: ATXN1; (-) strand; PAM type: NRG; PAM sequence: GAG
gctgggcattgaagataatg

SEQ ID NO: 74431 - DNA, 20 bp, Artificial Sequence
  Description of Artificial Sequence: Synthetic oligonucleotide
  Target: ATXN1; (-) strand; PAM type: NRG; PAM sequence: TGG
gggctgggcattgaagataa

SEQ ID NO: 74432 - DNA, 20 bp, Artificial Sequence
  Description of Artificial Sequence: Synthetic oligonucleotide
  Target: ATXN1; (-) strand; PAM type: NRG; PAM sequence: AAG
cagtatagggctgggcattg

SEQ ID NO: 74433 - DNA, 20 bp, Artificial Sequence
  Description of Artificial Sequence: Synthetic oligonucleotide
  Target: ATXN1; (-) strand; PAM type: NRG; PAM sequence: GGG
ctatgtcccagtatagggct

SEQ ID NO: 74434 - DNA, 20 bp, Artificial Sequence
  Description of Artificial Sequence: Synthetic oligonucleotide
  Target: ATXN1; (-) strand; PAM type: NRG; PAM sequence: TGG
gctatgtcccagtatagggc

SEQ ID NO: 74435 - DNA, 20 bp, Artificial Sequence
  Description of Artificial Sequence: Synthetic oligonucleotide
  Target: ATXN1; (-) strand; PAM type: NRG; PAM sequence: GGG
ggcagctatgtcccagtata

SEQ ID NO: 74436 - DNA, 20 bp, Artificial Sequence
  Description of Artificial Sequence: Synthetic oligonucleotide
  Target: ATXN1; (-) strand; PAM type: NRG; PAM sequence: AGG
gggcagctatgtcccagtat

SEQ ID NO: 74437 - DNA, 20 bp, Artificial Sequence
  Description of Artificial Sequence: Synthetic oligonucleotide
  Target: ATXN1; (-) strand; PAM type: NRG; PAM sequence: TAG
ggggcagctatgtcccagta

SEQ ID NO: 74438 - DNA, 20 bp, Artificial Sequence
  Description of Artificial Sequence: Synthetic oligonucleotide
  Target: ATXN1; (-) strand; PAM type: NRG; PAM sequence: CAG
ttttaggggcagctatgtcc

SEQ ID NO: 74439 - DNA, 20 bp, Artificial Sequence
  Description of Artificial Sequence: Synthetic oligonucleotide
  Target: ATXN1; (-) strand; PAM type: NRG; PAM sequence: CAG
agcaaaggcctttttagggg

SEQ ID NO: 74440 - DNA, 20 bp, Artificial Sequence
  Description of Artificial Sequence: Synthetic oligonucleotide
  Target: ATXN1; (-) strand; PAM type: NRG; PAM sequence: GGG
tttagcaaaggcctttttag

SEQ ID NO: 74441 - DNA, 20 bp, Artificial Sequence
  Description of Artificial Sequence: Synthetic oligonucleotide
  Target: ATXN1; (-) strand; PAM type: NRG; PAM sequence: GGG
atttagcaaaggccttttta

SEQ ID NO: 74442 - DNA, 20 bp, Artificial Sequence
  Description of Artificial Sequence: Synthetic oligonucleotide
  Target: ATXN1; (-) strand; PAM type: NRG; PAM sequence: AGG
aatttagcaaaggccttttt

SEQ ID NO: 74443 - DNA, 20 bp, Artificial Sequence
  Description of Artificial Sequence: Synthetic oligonucleotide
  Target: ATXN1; (-) strand; PAM type: NRG; PAM sequence: TAG
taatttagcaaaggcctttt

SEQ ID NO: 74444 - DNA, 20 bp, Artificial Sequence
  Description of Artificial Sequence: Synthetic oligonucleotide
  Target: ATXN1; (-) strand; PAM type: NRG; PAM sequence: AGG
ctcatttattaatttagcaa

SEQ ID NO: 74445 - DNA, 20 bp, Artificial Sequence
  Description of Artificial Sequence: Synthetic oligonucleotide
  Target: ATXN1; (-) strand; PAM type: NRG; PAM sequence: AAG
actcatttattaatttagca

SEQ ID NO: 74446 - DNA, 20 bp, Artificial Sequence
  Description of Artificial Sequence: Synthetic oligonucleotide
  Target: ATXN1; (-) strand; PAM type: NRG; PAM sequence: TAG
tcctcactcatttattaatt

SEQ ID NO: 74447 - DNA, 20 bp, Artificial Sequence
  Description of Artificial Sequence: Synthetic oligonucleotide
  Target: ATXN1; (-) strand; PAM type: NRG; PAM sequence: CAG
tctttaattttaatcccatt

SEQ ID NO: 74448 - DNA, 20 bp, Artificial Sequence
  Description of Artificial Sequence: Synthetic oligonucleotide
  Target: ATXN1; (-) strand; PAM type: NRG; PAM sequence: AGG
aattgtgagaaactgagaca

SEQ ID NO: 74449 - DNA, 20 bp, Artificial Sequence
  Description of Artificial Sequence: Synthetic oligonucleotide
  Target: ATXN1; (-) strand; PAM type: NRG; PAM sequence: AAG
gaattgtgagaaactgagac

SEQ ID NO: 74450 - DNA, 20 bp, Artificial Sequence
  Description of Artificial Sequence: Synthetic oligonucleotide
  Target: ATXN1; (-) strand; PAM type: NRG; PAM sequence: GAG
cttttgaattgtgagaaact

SEQ ID NO: 74451 - DNA, 20 bp, Artificial Sequence
  Description of Artificial Sequence: Synthetic oligonucleotide
  Target: ATXN1; (-) strand; PAM type: NRG; PAM sequence: GAG
aagcacaacttttgaattgt

SEQ ID NO: 74452 - DNA, 20 bp, Artificial Sequence
  Description of Artificial Sequence: Synthetic oligonucleotide
  Target: ATXN1; (-) strand; PAM type: NRG; PAM sequence: AAG
attttgccagcacaaagtta

SEQ ID NO: 74453 - DNA, 20 bp, Artificial Sequence
  Description of Artificial Sequence: Synthetic oligonucleotide
  Target: ATXN1; (-) strand; PAM type: NRG; PAM sequence: AAG
cttaggattttgccagcaca

SEQ ID NO: 74454 - DNA, 20 bp, Artificial Sequence
  Description of Artificial Sequence: Synthetic oligonucleotide
  Target: ATXN1; (-) strand; PAM type: NRG; PAM sequence: CAG
ggggtgtcttaggattttgc

SEQ ID NO: 74455 - DNA, 20 bp, Artificial Sequence
  Description of Artificial Sequence: Synthetic oligonucleotide
  Target: ATXN1; (-) strand; PAM type: NRG; PAM sequence: AGG
tggggactttggggtgtctt

SEQ ID NO: 74456 - DNA, 20 bp, Artificial Sequence
  Description of Artificial Sequence: Synthetic oligonucleotide
  Target: ATXN1; (-) strand; PAM type: NRG; PAM sequence: TAG
atggggactttggggtgtct

SEQ ID NO: 74457 - DNA, 20 bp, Artificial Sequence
  Description of Artificial Sequence: Synthetic oligonucleotide
  Target: ATXN1; (-) strand; PAM type: NRG; PAM sequence: GGG
aaagtcccatggggactttg

SEQ ID NO: 74458 - DNA, 20 bp, Artificial Sequence
  Description of Artificial Sequence: Synthetic oligonucleotide
  Target: ATXN1; (-) strand; PAM type: NRG; PAM sequence: GGG
caaagtcccatggggacttt

SEQ ID NO: 74459 - DNA, 20 bp, Artificial Sequence
  Description of Artificial Sequence: Synthetic oligonucleotide
  Target: ATXN1; (-) strand; PAM type: NRG; PAM sequence: TGG
gcaaagtcccatggggactt

SEQ ID NO: 74460 - DNA, 20 bp, Artificial Sequence
  Description of Artificial Sequence: Synthetic oligonucleotide
  Target: ATXN1; (-) strand; PAM type: NRG; PAM sequence: GGG
ttagttcgcaaagtcccatg

SEQ ID NO: 74461 - DNA, 20 bp, Artificial Sequence
  Description of Artificial Sequence: Synthetic oligonucleotide
  Target: ATXN1; (-) strand; PAM type: NRG; PAM sequence: GGG
cttagttcgcaaagtcccat

SEQ ID NO: 74462 - DNA, 20 bp, Artificial Sequence
  Description of Artificial Sequence: Synthetic oligonucleotide
  Target: ATXN1; (-) strand; PAM type: NRG; PAM sequence: TGG
tcttagttcgcaaagtccca

SEQ ID NO: 74463 - DNA, 20 bp, Artificial Sequence
  Description of Artificial Sequence: Synthetic oligonucleotide
  Target: ATXN1; (-) strand; PAM type: NRG; PAM sequence: AAG
tgttgaaatcttagttcgca

SEQ ID NO: 74464 - DNA, 20 bp, Artificial Sequence
  Description of Artificial Sequence: Synthetic oligonucleotide
  Target: ATXN1; (-) strand; PAM type: NRG; PAM sequence: TAG
cagaatcattgttgaaatct

SEQ ID NO: 74465 - DNA, 20 bp, Artificial Sequence
  Description of Artificial Sequence: Synthetic oligonucleotide
  Target: ATXN1; (-) strand; PAM type: NRG; PAM sequence: CAG
gacctatctgcaagaccagg

SEQ ID NO: 74466 - DNA, 20 bp, Artificial Sequence
  Description of Artificial Sequence: Synthetic oligonucleotide
  Target: ATXN1; (-) strand; PAM type: NRG; PAM sequence: AGG
caagacctatctgcaagacc

SEQ ID NO: 74467 - DNA, 20 bp, Artificial Sequence
  Description of Artificial Sequence: Synthetic oligonucleotide
  Target: ATXN1; (-) strand; PAM type: NRG; PAM sequence: CAG
acaagacctatctgcaagac

SEQ ID NO: 74468 - DNA, 20 bp, Artificial Sequence
  Description of Artificial Sequence: Synthetic oligonucleotide
  Target: ATXN1; (-) strand; PAM type: NRG; PAM sequence: AAG
catgtacaagacctatctgc

SEQ ID NO: 74469 - DNA, 20 bp, Artificial Sequence
  Description of Artificial Sequence: Synthetic oligonucleotide
  Target: ATXN1; (-) strand; PAM type: NRG; PAM sequence: AAG
ccatttttgcattcatgtac

SEQ ID NO: 74470 - DNA, 20 bp, Artificial Sequence
  Description of Artificial Sequence: Synthetic oligonucleotide
  Target: ATXN1; (-) strand; PAM type: NRG; PAM sequence: TGG
ttgtttccatatactgcaca

SEQ ID NO: 74471 - DNA, 20 bp, Artificial Sequence
  Description of Artificial Sequence: Synthetic oligonucleotide
  Target: ATXN1; (-) strand; PAM type: NRG; PAM sequence: TGG
gatctgtggtcagcagtttt

SEQ ID NO: 74472 - DNA, 20 bp, Artificial Sequence
  Description of Artificial Sequence: Synthetic oligonucleotide
  Target: ATXN1; (-) strand; PAM type: NRG; PAM sequence: CAG
gacctcagatctgtggtcag

SEQ ID NO: 74473 - DNA, 20 bp, Artificial Sequence
  Description of Artificial Sequence: Synthetic oligonucleotide
  Target: ATXN1; (-) strand; PAM type: NRG; PAM sequence: CAG
tgtgacctcagatctgtggt

SEQ ID NO: 74474 - DNA, 20 bp, Artificial Sequence
  Description of Artificial Sequence: Synthetic oligonucleotide
  Target: ATXN1; (-) strand; PAM type: NRG; PAM sequence: TGG
gtgctgtgacctcagatctg

SEQ ID NO: 74475 - DNA, 20 bp, Artificial Sequence
  Description of Artificial Sequence: Synthetic oligonucleotide
  Target: ATXN1; (-) strand; PAM type: NRG; PAM sequence: CAG
tattaattgtgctgtgacct

SEQ ID NO: 74476 - DNA, 20 bp, Artificial Sequence
  Description of Artificial Sequence: Synthetic oligonucleotide
  Target: ATXN1; (-) strand; PAM type: NRG; PAM sequence: GGG
ctctagggagacaggagagt

SEQ ID NO: 74477 - DNA, 20 bp, Artificial Sequence
  Description of Artificial Sequence: Synthetic oligonucleotide
  Target: ATXN1; (-) strand; PAM type: NRG; PAM sequence: TGG
tctctagggagacaggagag

SEQ ID NO: 74478 - DNA, 20 bp, Artificial Sequence
  Description of Artificial Sequence: Synthetic oligonucleotide
  Target: ATXN1; (-) strand; PAM type: NRG; PAM sequence: GAG
atttctctagggagacagga

SEQ ID NO: 74479 - DNA, 20 bp, Artificial Sequence
  Description of Artificial Sequence: Synthetic oligonucleotide
  Target: ATXN1; (-) strand; PAM type: NRG; PAM sequence: GAG
aaatttctctagggagacag

SEQ ID NO: 74480 - DNA, 20 bp, Artificial Sequence
  Description of Artificial Sequence: Synthetic oligonucleotide
  Target: ATXN1; (-) strand; PAM type: NRG; PAM sequence: AGG
ataaatttctctagggagac

SEQ ID NO: 74481 - DNA, 20 bp, Artificial Sequence
  Description of Artificial Sequence: Synthetic oligonucleotide
  Target: ATXN1; (-) strand; PAM type: NRG; PAM sequence: CAG
aataaatttctctagggaga

SEQ ID NO: 74482 - DNA, 20 bp, Artificial Sequence
  Description of Artificial Sequence: Synthetic oligonucleotide
  Target: ATXN1; (-) strand; PAM type: NRG; PAM sequence: GAG
ccagaataaatttctctagg

SEQ ID NO: 74483 - DNA, 20 bp, Artificial Sequence
  Description of Artificial Sequence: Synthetic oligonucleotide
  Target: ATXN1; (-) strand; PAM type: NRG; PAM sequence: GGG
taccagaataaatttctcta

SEQ ID NO: 74484 - DNA, 20 bp, Artificial Sequence
  Description of Artificial Sequence: Synthetic oligonucleotide
  Target: ATXN1; (-) strand; PAM type: NRG; PAM sequence: AGG
ttaccagaataaatttctct

SEQ ID NO: 74485 - DNA, 20 bp, Artificial Sequence
  Description of Artificial Sequence: Synthetic oligonucleotide
  Target: ATXN1; (-) strand; PAM type: NRG; PAM sequence: TAG
cttaccagaataaatttctc

SEQ ID NO: 74486 - DNA, 20 bp, Artificial Sequence
  Description of Artificial Sequence: Synthetic oligonucleotide
  Target: ATXN1; (-) strand; PAM type: NRG; PAM sequence: CAG
gttggttgtcaagggcttac

SEQ ID NO: 74487 - DNA, 20 bp, Artificial Sequence
  Description of Artificial Sequence: Synthetic oligonucleotide
  Target: ATXN1; (-) strand; PAM type: NRG; PAM sequence: GGG
gcagacgtgttggttgtcaa

SEQ ID NO: 74488 - DNA, 20 bp, Artificial Sequence
  Description of Artificial Sequence: Synthetic oligonucleotide
  Target: ATXN1; (-) strand; PAM type: NRG; PAM sequence: AGG
tgcagacgtgttggttgtca

SEQ ID NO: 74489 - DNA, 20 bp, Artificial Sequence
  Description of Artificial Sequence: Synthetic oligonucleotide
  Target: ATXN1; (-) strand; PAM type: NRG; PAM sequence: AAG
atgcagacgtgttggttgtc

SEQ ID NO: 74490 - DNA, 20 bp, Artificial Sequence
  Description of Artificial Sequence: Synthetic oligonucleotide
  Target: ATXN1; (-) strand; PAM type: NRG; PAM sequence: TGG
gtgcagaaatgcagacgtgt

SEQ ID NO: 74491 - DNA, 20 bp, Artificial Sequence
  Description of Artificial Sequence: Synthetic oligonucleotide
  Target: ATXN1; (-) strand; PAM type: NRG; PAM sequence: CAG
ctggctggtgtgcagaaatg

SEQ ID NO: 74492 - DNA, 20 bp, Artificial Sequence
  Description of Artificial Sequence: Synthetic oligonucleotide
  Target: ATXN1; (-) strand; PAM type: NRG; PAM sequence: CAG
gtggatcactggctggtgtg

SEQ ID NO: 74493 - DNA, 20 bp, Artificial Sequence
  Description of Artificial Sequence: Synthetic oligonucleotide
  Target: ATXN1; (-) strand; PAM type: NRG; PAM sequence: TGG
tcttgctgtggatcactggc

SEQ ID NO: 74494 - DNA, 20 bp, Artificial Sequence
  Description of Artificial Sequence: Synthetic oligonucleotide
  Target: ATXN1; (-) strand; PAM type: NRG; PAM sequence: TGG
attctcttgctgtggatcac

SEQ ID NO: 74495 - DNA, 20 bp, Artificial Sequence
  Description of Artificial Sequence: Synthetic oligonucleotide
  Target: ATXN1; (-) strand; PAM type: NRG; PAM sequence: TGG
aagaaaggattctcttgctg

SEQ ID NO: 74496 - DNA, 20 bp, Artificial Sequence
  Description of Artificial Sequence: Synthetic oligonucleotide
  Target: ATXN1; (-) strand; PAM type: NRG; PAM sequence: AGG
aaagactcagagaggaagaa

SEQ ID NO: 74497 - DNA, 20 bp, Artificial Sequence
  Description of Artificial Sequence: Synthetic oligonucleotide
  Target: ATXN1; (-) strand; PAM type: NRG; PAM sequence: AAG
taaagactcagagaggaaga

SEQ ID NO: 74498 - DNA, 20 bp, Artificial Sequence
  Description of Artificial Sequence: Synthetic oligonucleotide
  Target: ATXN1; (-) strand; PAM type: NRG; PAM sequence: AAG
tcaataaagactcagagagg

SEQ ID NO: 74499 - DNA, 20 bp, Artificial Sequence
  Description of Artificial Sequence: Synthetic oligonucleotide
  Target: ATXN1; (-) strand; PAM type: NRG; PAM sequence: AGG
aaatcaataaagactcagag

SEQ ID NO: 74500 - DNA, 20 bp, Artificial Sequence
  Description of Artificial Sequence: Synthetic oligonucleotide
  Target: ATXN1; (-) strand; PAM type: NRG; PAM sequence: GAG
aaaatcaataaagactcaga

SEQ ID NO: 74501 - DNA, 20 bp, Artificial Sequence
  Description of Artificial Sequence: Synthetic oligonucleotide
  Target: ATXN1; (-) strand; PAM type: NRG; PAM sequence: GAG
acaaaatcaataaagactca

SEQ ID NO: 74502 - DNA, 20 bp, Artificial Sequence
  Description of Artificial Sequence: Synthetic oligonucleotide
  Target: ATXN1; (-) strand; PAM type: NRG; PAM sequence: CAG
ctacaaaatcaataaagact

SEQ ID NO: 74503 - DNA, 20 bp, Artificial Sequence
  Description of Artificial Sequence: Synthetic oligonucleotide
  Target: ATXN1; (-) strand; PAM type: NRG; PAM sequence: AAG
cccaaactacaaaatcaata

SEQ ID NO: 74504 - DNA, 20 bp, Artificial Sequence
  Description of Artificial Sequence: Synthetic oligonucleotide
  Target: ATXN1; (-) strand; PAM type: NRG; PAM sequence: TAG
tttggtatttgaatagcact

SEQ ID NO: 74505 - DNA, 20 bp, Artificial Sequence
  Description of Artificial Sequence: Synthetic oligonucleotide
  Target: ATXN1; (-) strand; PAM type: NRG; PAM sequence: TAG
tggaacatttggtatttgaa

SEQ ID NO: 74506 - DNA, 20 bp, Artificial Sequence
  Description of Artificial Sequence: Synthetic oligonucleotide
  Target: ATXN1; (-) strand; PAM type: NRG; PAM sequence: TGG
acactaccatatggaacatt

SEQ ID NO: 74507 - DNA, 20 bp, Artificial Sequence
  Description of Artificial Sequence: Synthetic oligonucleotide
  Target: ATXN1; (-) strand; PAM type: NRG; PAM sequence: TGG
atggtaataacactaccata

SEQ ID NO: 74508 - DNA, 20 bp, Artificial Sequence
  Description of Artificial Sequence: Synthetic oligonucleotide
  Target: ATXN1; (-) strand; PAM type: NRG; PAM sequence: TGG
tcaagtaacggtagtgggaa

SEQ ID NO: 74509 - DNA, 20 bp, Artificial Sequence
  Description of Artificial Sequence: Synthetic oligonucleotide
  Target: ATXN1; (-) strand; PAM type: NRG; PAM sequence: GGG
aggcctcaagtaacggtagt

SEQ ID NO: 74510 - DNA, 20 bp, Artificial Sequence
  Description of Artificial Sequence: Synthetic oligonucleotide
  Target: ATXN1; (-) strand; PAM type: NRG; PAM sequence: TGG
aaggcctcaagtaacggtag

SEQ ID NO: 74511 - DNA, 20 bp, Artificial Sequence
  Description of Artificial Sequence: Synthetic oligonucleotide
  Target: ATXN1; (-) strand; PAM type: NRG; PAM sequence: TAG
tagaaggcctcaagtaacgg

SEQ ID NO: 74512 - DNA, 20 bp, Artificial Sequence
  Description of Artificial Sequence: Synthetic oligonucleotide
  Target: ATXN1; (-) strand; PAM type: NRG; PAM sequence: CGG
aggtagaaggcctcaagtaa

SEQ ID NO: 74513 - DNA, 20 bp, Artificial Sequence
  Description of Artificial Sequence: Synthetic oligonucleotide
  Target: ATXN1; (-) strand; PAM type: NRG; PAM sequence: AAG
gagtgtaggtagaaggcctc

SEQ ID NO: 74514 - DNA, 20 bp, Artificial Sequence
  Description of Artificial Sequence: Synthetic oligonucleotide
  Target: ATXN1; (-) strand; PAM type: NRG; PAM sequence: AGG
acctcatgagtgtaggtaga

SEQ ID NO: 74515 - DNA, 20 bp, Artificial Sequence
  Description of Artificial Sequence: Synthetic oligonucleotide
  Target: ATXN1; (-) strand; PAM type: NRG; PAM sequence: AAG
cacctcatgagtgtaggtag

SEQ ID NO: 74516 - DNA, 20 bp, Artificial Sequence
  Description of Artificial Sequence: Synthetic oligonucleotide
  Target: ATXN1; (-) strand; PAM type: NRG; PAM sequence: TAG
aggcacctcatgagtgtagg

SEQ ID NO: 74517 - DNA, 20 bp, Artificial Sequence
  Description of Artificial Sequence: Synthetic oligonucleotide
  Target: ATXN1; (-) strand; PAM type: NRG; PAM sequence: AGG
atgaggcacctcatgagtgt

SEQ ID NO: 74518 - DNA, 20 bp, Artificial Sequence
  Description of Artificial Sequence: Synthetic oligonucleotide
  Target: ATXN1; (-) strand; PAM type: NRG; PAM sequence: TAG
gatgaggcacctcatgagtg

SEQ ID NO: 74519 - DNA, 20 bp, Artificial Sequence
  Description of Artificial Sequence: Synthetic oligonucleotide
  Target: ATXN1; (-) strand; PAM type: NRG; PAM sequence: GAG
attctgatgaggcacctcat

SEQ ID NO: 74520 - DNA, 20 bp, Artificial Sequence
  Description of Artificial Sequence: Synthetic oligonucleotide
  Target: ATXN1; (-) strand; PAM type: NRG; PAM sequence: AGG
tgttctgccagattctgatg

SEQ ID NO: 74521 - DNA, 20 bp, Artificial Sequence
  Description of Artificial Sequence: Synthetic oligonucleotide
  Target: ATXN1; (-) strand; PAM type: NRG; PAM sequence: GAG
atgttctgccagattctgat

SEQ ID NO: 74522 - DNA, 20 bp, Artificial Sequence
  Description of Artificial Sequence: Synthetic oligonucleotide
  Target: ATXN1; (-) strand; PAM type: NRG; PAM sequence: CAG
aagagttcataatgttctgc

SEQ ID NO: 74523 - DNA, 20 bp, Artificial Sequence
  Description of Artificial Sequence: Synthetic oligonucleotide
  Target: ATXN1; (-) strand; PAM type: NRG; PAM sequence: GAG
gcaaatataggtcaggaaaa

SEQ ID NO: 74524 - DNA, 20 bp, Artificial Sequence
  Description of Artificial Sequence: Synthetic oligonucleotide
  Target: ATXN1; (-) strand; PAM type: NRG; PAM sequence: AAG
tagcaaatataggtcaggaa

SEQ ID NO: 74525 - DNA, 20 bp, Artificial Sequence
  Description of Artificial Sequence: Synthetic oligonucleotide
  Target: ATXN1; (-) strand; PAM type: NRG; PAM sequence: AGG
tgtgttagcaaatataggtc

SEQ ID NO: 74526 - DNA, 20 bp, Artificial Sequence
  Description of Artificial Sequence: Synthetic oligonucleotide
  Target: ATXN1; (-) strand; PAM type: NRG; PAM sequence: CAG
atgtgttagcaaatataggt

SEQ ID NO: 74527 - DNA, 20 bp, Artificial Sequence
  Description of Artificial Sequence: Synthetic oligonucleotide
  Target: ATXN1; (-) strand; PAM type: NRG; PAM sequence: AGG
acaaatgtgttagcaaatat

SEQ ID NO: 74528 - DNA, 20 bp, Artificial Sequence
  Description of Artificial Sequence: Synthetic oligonucleotide
  Target: ATXN1; (-) strand; PAM type: NRG; PAM sequence: TAG
aacaaatgtgttagcaaata

SEQ ID NO: 74529 - DNA, 20 bp, Artificial Sequence
  Description of Artificial Sequence: Synthetic oligonucleotide
  Target: ATXN1; (-) strand; PAM type: NRG; PAM sequence: TAG
agagaggacaacaaatgtgt

SEQ ID NO: 74530 - DNA, 20 bp, Artificial Sequence
  Description of Artificial Sequence: Synthetic oligonucleotide
  Target: ATXN1; (-) strand; PAM type: NRG; PAM sequence: AGG
ataagttcatagagggagag

SEQ ID NO: 74531 - DNA, 20 bp, Artificial Sequence
  Description of Artificial Sequence: Synthetic oligonucleotide
  Target: ATXN1; (-) strand; PAM type: NRG; PAM sequence: GAG
aataagttcatagagggaga

SEQ ID NO: 74532 - DNA, 20 bp, Artificial Sequence
  Description of Artificial Sequence: Synthetic oligonucleotide
  Target: ATXN1; (-) strand; PAM type: NRG; PAM sequence: GAG
ttaataagttcatagaggga

SEQ ID NO: 74533 - DNA, 20 bp, Artificial Sequence
  Description of Artificial Sequence: Synthetic oligonucleotide
  Target: ATXN1; (-) strand; PAM type: NRG; PAM sequence: GAG
aattaataagttcatagagg

SEQ ID NO: 74534 - DNA, 20 bp, Artificial Sequence
  Description of Artificial Sequence: Synthetic oligonucleotide
  Target: ATXN1; (-) strand; PAM type: NRG; PAM sequence: GGG
aaaattaataagttcataga

SEQ ID NO: 74535 - DNA, 20 bp, Artificial Sequence
  Description of Artificial Sequence: Synthetic oligonucleotide
  Target: ATXN1; (-) strand; PAM type: NRG; PAM sequence: AGG
caaaattaataagttcatag

SEQ ID NO: 74536 - DNA, 20 bp, Artificial Sequence
  Description of Artificial Sequence: Synthetic oligonucleotide
  Target: ATXN1; (-) strand; PAM type: NRG; PAM sequence: GAG
acaaaattaataagttcata

SEQ ID NO: 74537 - DNA, 20 bp, Artificial Sequence
  Description of Artificial Sequence: Synthetic oligonucleotide
  Target: ATXN1; (-) strand; PAM type: NRG; PAM sequence: TAG
caacaaaattaataagttca

SEQ ID NO: 74538 - DNA, 20 bp, Artificial Sequence
  Description of Artificial Sequence: Synthetic oligonucleotide
  Target: ATXN1; (-) strand; PAM type: NRG; PAM sequence: AAG
attatttcaacaaaattaat

SEQ ID NO: 74539 - DNA, 20 bp, Artificial Sequence
  Description of Artificial Sequence: Synthetic oligonucleotide
  Target: ATXN1; (-) strand; PAM type: NRG; PAM sequence: TGG
atgaataagaaaacaaaact

SEQ ID NO: 74540 - DNA, 20 bp, Artificial Sequence
  Description of Artificial Sequence: Synthetic oligonucleotide
  Target: ATXN1; (-) strand; PAM type: NRG; PAM sequence: AAG
ctgtgactatgaggatgaat

SEQ ID NO: 74541 - DNA, 20 bp, Artificial Sequence
  Description of Artificial Sequence: Synthetic oligonucleotide
  Target: ATXN1; (-) strand; PAM type: NRG; PAM sequence: AGG
atcattcccctgtgactatg

SEQ ID NO: 74542 - DNA, 20 bp, Artificial Sequence
  Description of Artificial Sequence: Synthetic oligonucleotide
  Target: ATXN1; (-) strand; PAM type: NRG; PAM sequence: GAG
aatcattcccctgtgactat

SEQ ID NO: 74543 - DNA, 20 bp, Artificial Sequence
  Description of Artificial Sequence: Synthetic oligonucleotide
  Target: ATXN1; (-) strand; PAM type: NRG; PAM sequence: AAG
taattaagacatgttagctt

SEQ ID NO: 74544 - DNA, 20 bp, Artificial Sequence
  Description of Artificial Sequence: Synthetic oligonucleotide
  Target: ATXN1; (-) strand; PAM type: NRG; PAM sequence: TAG
aattcctaattaagacatgt

SEQ ID NO: 74545 - DNA, 20 bp, Artificial Sequence
  Description of Artificial Sequence: Synthetic oligonucleotide
  Target: ATXN1; (-) strand; PAM type: NRG; PAM sequence: AAG
gaatatctgaattcctaatt

SEQ ID NO: 74546 - DNA, 20 bp, Artificial Sequence
  Description of Artificial Sequence: Synthetic oligonucleotide
  Target: ATXN1; (-) strand; PAM type: NRG; PAM sequence: AGG
tctgtatttctcagcagaag

SEQ ID NO: 74547 - DNA, 20 bp, Artificial Sequence
  Description of Artificial Sequence: Synthetic oligonucleotide
  Target: ATXN1; (-) strand; PAM type: NRG; PAM sequence: GAG
ctctgtatttctcagcagaa

SEQ ID NO: 74548 - DNA, 20 bp, Artificial Sequence
  Description of Artificial Sequence: Synthetic oligonucleotide
  Target: ATXN1; (-) strand; PAM type: NRG; PAM sequence: AAG
agctctgtatttctcagcag

SEQ ID NO: 74549 - DNA, 20 bp, Artificial Sequence
  Description of Artificial Sequence: Synthetic oligonucleotide
  Target: ATXN1; (-) strand; PAM type: NRG; PAM sequence: CAG
aacagctctgtatttctcag

SEQ ID NO: 74550 - DNA, 20 bp, Artificial Sequence
  Description of Artificial Sequence: Synthetic oligonucleotide
  Target: ATXN1; (-) strand; PAM type: NRG; PAM sequence: CAG
ttgaacagctctgtatttct

SEQ ID NO: 74551 - DNA, 20 bp, Artificial Sequence
  Description of Artificial Sequence: Synthetic oligonucleotide
  Target: ATXN1; (-) strand; PAM type: NRG; PAM sequence: CAG
aatttctggtctaatttgaa

SEQ ID NO: 74552 - DNA, 20 bp, Artificial Sequence
  Description of Artificial Sequence: Synthetic oligonucleotide
  Target: ATXN1; (-) strand; PAM type: NRG; PAM sequence: TGG
ttcgttttggccctaatttc

SEQ ID NO: 74553 - DNA, 20 bp, Artificial Sequence
  Description of Artificial Sequence: Synthetic oligonucleotide
  Target: ATXN1; (-) strand; PAM type: NRG; PAM sequence: TGG
tgtagacgctgcattcgttt

SEQ ID NO: 74554 - DNA, 20 bp, Artificial Sequence
  Description of Artificial Sequence: Synthetic oligonucleotide
  Target: ATXN1; (-) strand; PAM type: NRG; PAM sequence: TAG
ctgctatgagcttgtgtatg

SEQ ID NO: 74555 - DNA, 20 bp, Artificial Sequence
  Description of Artificial Sequence: Synthetic oligonucleotide
  Target: ATXN1; (-) strand; PAM type: NRG; PAM sequence: GAG
ttcactggttaccctgctat

SEQ ID NO: 74556 - DNA, 20 bp, Artificial Sequence
  Description of Artificial Sequence: Synthetic oligonucleotide
  Target: ATXN1; (-) strand; PAM type: NRG; PAM sequence: TGG
cttcagcctctgcctttcac

SEQ ID NO: 74557 - DNA, 20 bp, Artificial Sequence
  Description of Artificial Sequence: Synthetic oligonucleotide
  Target: ATXN1; (-) strand; PAM type: NRG; PAM sequence: CAG
cagaacgacgtgtacggctt

SEQ ID NO: 74558 - DNA, 20 bp, Artificial Sequence
  Description of Artificial Sequence: Synthetic oligonucleotide
  Target: ATXN1; (-) strand; PAM type: NRG; PAM sequence: CGG
caaacacagaacgacgtgta

SEQ ID NO: 74559 - DNA, 20 bp, Artificial Sequence
  Description of Artificial Sequence: Synthetic oligonucleotide
  Target: ATXN1; (-) strand; PAM type: NRG; PAM sequence: CAG
tggcatgaaggagacaaaca

SEQ ID NO: 74560 - DNA, 20 bp, Artificial Sequence
  Description of Artificial Sequence: Synthetic oligonucleotide
  Target: ATXN1; (-) strand; PAM type: NRG; PAM sequence: GAG
aagaatcatttggcatgaag

SEQ ID NO: 74561 - DNA, 20 bp, Artificial Sequence
  Description of Artificial Sequence: Synthetic oligonucleotide
  Target: ATXN1; (-) strand; PAM type: NRG; PAM sequence: AGG
caaagaatcatttggcatga

SEQ ID NO: 74562 - DNA, 20 bp, Artificial Sequence
  Description of Artificial Sequence: Synthetic oligonucleotide
  Target: ATXN1; (-) strand; PAM type: NRG; PAM sequence: AAG
tcaaagaatcatttggcatg

SEQ ID NO: 74563 - DNA, 20 bp, Artificial Sequence
  Description of Artificial Sequence: Synthetic oligonucleotide
  Target: ATXN1; (-) strand; PAM type: NRG; PAM sequence: TGG
aaagtggtcaaagaatcatt

SEQ ID NO: 74564 - DNA, 20 bp, Artificial Sequence
  Description of Artificial Sequence: Synthetic oligonucleotide
  Target: ATXN1; (-) strand; PAM type: NRG; PAM sequence: AAG
agtgaaaggaaaagtggtca

SEQ ID NO: 74565 - DNA, 20 bp, Artificial Sequence
  Description of Artificial Sequence: Synthetic oligonucleotide
  Target: ATXN1; (-) strand; PAM type: NRG; PAM sequence: TGG
ttgaaaagtgaaaggaaaag

SEQ ID NO: 74566 - DNA, 20 bp, Artificial Sequence
  Description of Artificial Sequence: Synthetic oligonucleotide
  Target: ATXN1; (-) strand; PAM type: NRG; PAM sequence: AAG
acgttgaaaagtgaaaggaa

SEQ ID NO: 74567 - DNA, 20 bp, Artificial Sequence
  Description of Artificial Sequence: Synthetic oligonucleotide
  Target: ATXN1; (-) strand; PAM type: NRG; PAM sequence: AGG
tcgtaacgttgaaaagtgaa

SEQ ID NO: 74568 - DNA, 20 bp, Artificial Sequence
  Description of Artificial Sequence: Synthetic oligonucleotide
  Target: ATXN1; (-) strand; PAM type: NRG; PAM sequence: AAG
atcgtaacgttgaaaagtga

SEQ ID NO: 74569 - DNA, 20 bp, Artificial Sequence
  Description of Artificial Sequence: Synthetic oligonucleotide
  Target: ATXN1; (-) strand; PAM type: NRG; PAM sequence: AAG
ggctccatcgtaacgttgaa

SEQ ID NO: 74570 - DNA, 20 bp, Artificial Sequence
  Description of Artificial Sequence: Synthetic oligonucleotide
  Target: ATXN1; (-) strand; PAM type: NRG; PAM sequence: TGG
ttgtgaatctcttgaccctt

SEQ ID NO: 74571 - DNA, 20 bp, Artificial Sequence
  Description of Artificial Sequence: Synthetic oligonucleotide
  Target: ATXN1; (-) strand; PAM type: NRG; PAM sequence: AGG
tgcatgaaggggaaggctgt

SEQ ID NO: 74572 - DNA, 20 bp, Artificial Sequence
  Description of Artificial Sequence: Synthetic oligonucleotide
  Target: ATXN1; (-) strand; PAM type: NRG; PAM sequence: TAG
atgcatgaaggggaaggctg

SEQ ID NO: 74573 - DNA, 20 bp, Artificial Sequence
  Description of Artificial Sequence: Synthetic oligonucleotide
  Target: ATXN1; (-) strand; PAM type: NRG; PAM sequence: AGG
ctacagatgcatgaagggga

SEQ ID NO: 74574 - DNA, 20 bp, Artificial Sequence
  Description of Artificial Sequence: Synthetic oligonucleotide
  Target: ATXN1; (-) strand; PAM type: NRG; PAM sequence: AAG
cctacagatgcatgaagggg

SEQ ID NO: 74575 - DNA, 20 bp, Artificial Sequence
  Description of Artificial Sequence: Synthetic oligonucleotide
  Target: ATXN1; (-) strand; PAM type: NRG; PAM sequence: GGG
tatcctacagatgcatgaag

SEQ ID NO: 74576 - DNA, 20 bp, Artificial Sequence
  Description of Artificial Sequence: Synthetic oligonucleotide
  Target: ATXN1; (-) strand; PAM type: NRG; PAM sequence: GGG
ttatcctacagatgcatgaa

SEQ ID NO: 74577 - DNA, 20 bp, Artificial Sequence
  Description of Artificial Sequence: Synthetic oligonucleotide
  Target: ATXN1; (-) strand; PAM type: NRG; PAM sequence: AGG
tttatcctacagatgcatga

SEQ ID NO: 74578 - DNA, 20 bp, Artificial Sequence
  Description of Artificial Sequence: Synthetic oligonucleotide
  Target: ATXN1; (-) strand; PAM type: NRG; PAM sequence: AAG
ctttatcctacagatgcatg

SEQ ID NO: 74579 - DNA, 20 bp, Artificial Sequence
  Description of Artificial Sequence: Synthetic oligonucleotide
  Target: ATXN1; (-) strand; PAM type: NRG; PAM sequence: CAG
gaaacgcatgctttatccta

SEQ ID NO: 74580 - DNA, 20 bp, Artificial Sequence
  Description of Artificial Sequence: Synthetic oligonucleotide
  Target: ATXN1; (-) strand; PAM type: NRG; PAM sequence: AGG
ccccgccacacccagctctt

SEQ ID NO: 74581 - DNA, 20 bp, Artificial Sequence
  Description of Artificial Sequence: Synthetic oligonucleotide
  Target: ATXN1; (-) strand; PAM type: NRG; PAM sequence: TAG
cccccgccacacccagctct

SEQ ID NO: 74582 - DNA, 20 bp, Artificial Sequence
  Description of Artificial Sequence: Synthetic oligonucleotide
  Target: ATXN1; (-) strand; PAM type: NRG; PAM sequence: CAG
agagacccccccgccacacc

SEQ ID NO: 74583 - DNA, 20 bp, Artificial Sequence
  Description of Artificial Sequence: Synthetic oligonucleotide
  Target: ATXN1; (-) strand; PAM type: NRG; PAM sequence: GAG
tgaaagagaaggtagatgaa

SEQ ID NO: 74584 - DNA, 20 bp, Artificial Sequence
  Description of Artificial Sequence: Synthetic oligonucleotide
  Target: ATXN1; (-) strand; PAM type: NRG; PAM sequence: AAG
aatgaaagagaaggtagatg

SEQ ID NO: 74585 - DNA, 20 bp, Artificial Sequence
  Description of Artificial Sequence: Synthetic oligonucleotide
  Target: ATXN1; (-) strand; PAM type: NRG; PAM sequence: TAG
taaataaatgaaagagaagg

SEQ ID NO: 74586 - DNA, 20 bp, Artificial Sequence
  Description of Artificial Sequence: Synthetic oligonucleotide
  Target: ATXN1; (-) strand; PAM type: NRG; PAM sequence: AGG
cactaaataaatgaaagaga

SEQ ID NO: 74587 - DNA, 20 bp, Artificial Sequence
  Description of Artificial Sequence: Synthetic oligonucleotide
  Target: ATXN1; (-) strand; PAM type: NRG; PAM sequence: AAG
tcactaaataaatgaaagag

SEQ ID NO: 74588 - DNA, 20 bp, Artificial Sequence
  Description of Artificial Sequence: Synthetic oligonucleotide
  Target: ATXN1; (-) strand; PAM type: NRG; PAM sequence: GAG
atttcactaaataaatgaaa

SEQ ID NO: 74589 - DNA, 20 bp, Artificial Sequence
  Description of Artificial Sequence: Synthetic oligonucleotide
  Target: ATXN1; (-) strand; PAM type: NRG; PAM sequence: AAG
tcatttcactaaataaatga

SEQ ID NO: 74590 - DNA, 20 bp, Artificial Sequence
  Description of Artificial Sequence: Synthetic oligonucleotide
  Target: ATXN1; (-) strand; PAM type: NRG; PAM sequence: AAG
tcttcccgtcattactaaat

SEQ ID NO: 74591 - DNA, 20 bp, Artificial Sequence
  Description of Artificial Sequence: Synthetic oligonucleotide
  Target: ATXN1; (-) strand; PAM type: NRG; PAM sequence: TGG
catatgtgagctgccctagt

SEQ ID NO: 74592 - DNA, 20 bp, Artificial Sequence
  Description of Artificial Sequence: Synthetic oligonucleotide
  Target: ATXN1; (-) strand; PAM type: NRG; PAM sequence: TAG
gcaccatatgtgagctgccc

SEQ ID NO: 74593 - DNA, 20 bp, Artificial Sequence
  Description of Artificial Sequence: Synthetic oligonucleotide
  Target: ATXN1; (-) strand; PAM type: NRG; PAM sequence: GAG
caccgtctggcaccatatgt

SEQ ID NO: 74594 - DNA, 20 bp, Artificial Sequence
  Description of Artificial Sequence: Synthetic oligonucleotide
  Target: ATXN1; (-) strand; PAM type: NRG; PAM sequence: TGG
gcacagagtccctcaccgtc

SEQ ID NO: 74595 - DNA, 20 bp, Artificial Sequence
  Description of Artificial Sequence: Synthetic oligonucleotide
  Target: ATXN1; (-) strand; PAM type: NRG; PAM sequence: GAG
cagcaagtgccttgggcaca

SEQ ID NO: 74596 - DNA, 20 bp, Artificial Sequence
  Description of Artificial Sequence: Synthetic oligonucleotide
  Target: ATXN1; (-) strand; PAM type: NRG; PAM sequence: CAG
tacagcaagtgccttgggca

SEQ ID NO: 74597 - DNA, 20 bp, Artificial Sequence
  Description of Artificial Sequence: Synthetic oligonucleotide
  Target: ATXN1; (-) strand; PAM type: NRG; PAM sequence: GGG
tgtggtacagcaagtgcctt

SEQ ID NO: 74598 - DNA, 20 bp, Artificial Sequence
  Description of Artificial Sequence: Synthetic oligonucleotide
  Target: ATXN1; (-) strand; PAM type: NRG; PAM sequence: TGG
ctgtggtacagcaagtgcct

SEQ ID NO: 74599 - DNA, 20 bp, Artificial Sequence
  Description of Artificial Sequence: Synthetic oligonucleotide
  Target: ATXN1; (-) strand; PAM type: NRG; PAM sequence: AAG
cctagctcctgtggtacagc

SEQ ID NO: 74600 - DNA, 20 bp, Artificial Sequence
  Description of Artificial Sequence: Synthetic oligonucleotide
  Target: ATXN1; (-) strand; PAM type: NRG; PAM sequence: CAG
gctgcctagctcctgtggta

SEQ ID NO: 74601 - DNA, 20 bp, Artificial Sequence
  Description of Artificial Sequence: Synthetic oligonucleotide
  Target: ATXN1; (-) strand; PAM type: NRG; PAM sequence: TGG
ccagggctgcctagctcctg

SEQ ID NO: 74602 - DNA, 20 bp, Artificial Sequence
  Description of Artificial Sequence: Synthetic oligonucleotide
  Target: ATXN1; (-) strand; PAM type: NRG; PAM sequence: TAG
ccttcccagccagggctgcc

SEQ ID NO: 74603 - DNA, 20 bp, Artificial Sequence
  Description of Artificial Sequence: Synthetic oligonucleotide
  Target: ATXN1; (-) strand; PAM type: NRG; PAM sequence: GGG
cagagcttccttcccagcca

SEQ ID NO: 74604 - DNA, 20 bp, Artificial Sequence
  Description of Artificial Sequence: Synthetic oligonucleotide
  Target: ATXN1; (-) strand; PAM type: NRG; PAM sequence: AGG
gcagagcttccttcccagcc

SEQ ID NO: 74605 - DNA, 20 bp, Artificial Sequence
  Description of Artificial Sequence: Synthetic oligonucleotide
  Target: ATXN1; (-) strand; PAM type: NRG; PAM sequence: CAG
agcagagcttccttcccagc

SEQ ID NO: 74606 - DNA, 20 bp, Artificial Sequence
  Description of Artificial Sequence: Synthetic oligonucleotide
  Target: ATXN1; (-) strand; PAM type: NRG; PAM sequence: CAG
tgagagcagagcttccttcc

SEQ ID NO: 74607 - DNA, 20 bp, Artificial Sequence
  Description of Artificial Sequence: Synthetic oligonucleotide
  Target: ATXN1; (-) strand; PAM type: NRG; PAM sequence: GAG
gcagccgttgggtgagagca

SEQ ID NO: 74608 - DNA, 20 bp, Artificial Sequence
  Description of Artificial Sequence: Synthetic oligonucleotide
  Target: ATXN1; (-) strand; PAM type: NRG; PAM sequence: CAG
gagcagccgttgggtgagag

SEQ ID NO: 74609 - DNA, 20 bp, Artificial Sequence
  Description of Artificial Sequence: Synthetic oligonucleotide
  Target: ATXN1; (-) strand; PAM type: NRG; PAM sequence: GAG
ttggagcagccgttgggtga

SEQ ID NO: 74610 - DNA, 20 bp, Artificial Sequence
  Description of Artificial Sequence: Synthetic oligonucleotide
  Target: ATXN1; (-) strand; PAM type: NRG; PAM sequence: GAG
ccttggagcagccgttgggt

SEQ ID NO: 74611 - DNA, 20 bp, Artificial Sequence
  Description of Artificial Sequence: Synthetic oligonucleotide
  Target: ATXN1; (-) strand; PAM type: NRG; PAM sequence: GGG
gcacccttggagcagccgtt

SEQ ID NO: 74612 - DNA, 20 bp, Artificial Sequence
  Description of Artificial Sequence: Synthetic oligonucleotide
  Target: ATXN1; (-) strand; PAM type: NRG; PAM sequence: TGG
ggcacccttggagcagccgt

SEQ ID NO: 74613 - DNA, 20 bp, Artificial Sequence
  Description of Artificial Sequence: Synthetic oligonucleotide
  Target: ATXN1; (-) strand; PAM type: NRG; PAM sequence: CAG
ggctgggggcacccttggag

SEQ ID NO: 74614 - DNA, 20 bp, Artificial Sequence
  Description of Artificial Sequence: Synthetic oligonucleotide
  Target: ATXN1; (-) strand; PAM type: NRG; PAM sequence: GAG
cctggctgggggcacccttg

SEQ ID NO: 74615 - DNA, 20 bp, Artificial Sequence
  Description of Artificial Sequence: Synthetic oligonucleotide
  Target: ATXN1; (-) strand; PAM type: NRG; PAM sequence: TGG
cacctggctgggggcaccct

SEQ ID NO: 74616 - DNA, 20 bp, Artificial Sequence
  Description of Artificial Sequence: Synthetic oligonucleotide
  Target: ATXN1; (-) strand; PAM type: NRG; PAM sequence: GGG
tgtctggatcacctggctgg

SEQ ID NO: 74617 - DNA, 20 bp, Artificial Sequence
  Description of Artificial Sequence: Synthetic oligonucleotide
  Target: ATXN1; (-) strand; PAM type: NRG; PAM sequence: GGG
ctgtctggatcacctggctg

SEQ ID NO: 74618 - DNA, 20 bp, Artificial Sequence
  Description of Artificial Sequence: Synthetic oligonucleotide
  Target: ATXN1; (-) strand; PAM type: NRG; PAM sequence: GGG
gctgtctggatcacctggct

SEQ ID NO: 74619 - DNA, 20 bp, Artificial Sequence
  Description of Artificial Sequence: Synthetic oligonucleotide
  Target: ATXN1; (-) strand; PAM type: NRG; PAM sequence: TGG
ggctgtctggatcacctggc

SEQ ID NO: 74620 - DNA, 20 bp, Artificial Sequence
  Description of Artificial Sequence: Synthetic oligonucleotide
  Target: ATXN1; (-) strand; PAM type: NRG; PAM sequence: TGG
ccatggctgtctggatcacc

SEQ ID NO: 74621 - DNA, 20 bp, Artificial Sequence
  Description of Artificial Sequence: Synthetic oligonucleotide
  Target: ATXN1; (-) strand; PAM type: NRG; PAM sequence: TGG
gctttgaaaccatggctgtc

SEQ ID NO: 74622 - DNA, 20 bp, Artificial Sequence
  Description of Artificial Sequence: Synthetic oligonucleotide
  Target: ATXN1; (-) strand; PAM type: NRG; PAM sequence: TGG
ttcacagagctttgaaacca

SEQ ID NO: 74623 - DNA, 20 bp, Artificial Sequence
  Description of Artificial Sequence: Synthetic oligonucleotide
  Target: ATXN1; (-) strand; PAM type: NRG; PAM sequence: GAG
tcagagacccatttttcaca

SEQ ID NO: 74624 - DNA, 20 bp, Artificial Sequence
  Description of Artificial Sequence: Synthetic oligonucleotide
  Target: ATXN1; (-) strand; PAM type: NRG; PAM sequence: CAG
agtcagagacccatttttca

SEQ ID NO: 74625 - DNA, 20 bp, Artificial Sequence
  Description of Artificial Sequence: Synthetic oligonucleotide
  Target: ATXN1; (-) strand; PAM type: NRG; PAM sequence: GAG
tgattcaagttttcaagtca

SEQ ID NO: 74626 - DNA, 20 bp, Artificial Sequence
  Description of Artificial Sequence: Synthetic oligonucleotide
  Target: ATXN1; (-) strand; PAM type: NRG; PAM sequence: CAG
cctgattcaagttttcaagt

SEQ ID NO: 74627 - DNA, 20 bp, Artificial Sequence
  Description of Artificial Sequence: Synthetic oligonucleotide
  Target: ATXN1; (-) strand; PAM type: NRG; PAM sequence: AAG
acttcctgattcaagttttc

SEQ ID NO: 74628 - DNA, 20 bp, Artificial Sequence
  Description of Artificial Sequence: Synthetic oligonucleotide
  Target: ATXN1; (-) strand; PAM type: NRG; PAM sequence: AAG
ctggagagacttcctgattc

SEQ ID NO: 74629 - DNA, 20 bp, Artificial Sequence
  Description of Artificial Sequence: Synthetic oligonucleotide
  Target: ATXN1; (-) strand; PAM type: NRG; PAM sequence: GAG
ggagtaatcccagtcctgga

SEQ ID NO: 74630 - DNA, 20 bp, Artificial Sequence
  Description of Artificial Sequence: Synthetic oligonucleotide
  Target: ATXN1; (-) strand; PAM type: NRG; PAM sequence: GAG
gtggagtaatcccagtcctg

SEQ ID NO: 74631 - DNA, 20 bp, Artificial Sequence
  Description of Artificial Sequence: Synthetic oligonucleotide
  Target: ATXN1; (-) strand; PAM type: NRG; PAM sequence: TGG
tagtggagtaatcccagtcc

SEQ ID NO: 74632 - DNA, 20 bp, Artificial Sequence
  Description of Artificial Sequence: Synthetic oligonucleotide
  Target: ATXN1; (-) strand; PAM type: NRG; PAM sequence: CAG
ttgtattagtggagtaatcc

SEQ ID NO: 74633 - DNA, 20 bp, Artificial Sequence
  Description of Artificial Sequence: Synthetic oligonucleotide
  Target: ATXN1; (-) strand; PAM type: NRG; PAM sequence: GAG
ggatttaatttgtattagtg

SEQ ID NO: 74634 - DNA, 20 bp, Artificial Sequence
  Description of Artificial Sequence: Synthetic oligonucleotide
  Target: ATXN1; (-) strand; PAM type: NRG; PAM sequence: TGG
atggatttaatttgtattag

SEQ ID NO: 74635 - DNA, 20 bp, Artificial Sequence
  Description of Artificial Sequence: Synthetic oligonucleotide
  Target: ATXN1; (-) strand; PAM type: NRG; PAM sequence: TAG
tgaatggatttaatttgtat

SEQ ID NO: 74636 - DNA, 20 bp, Artificial Sequence
  Description of Artificial Sequence: Synthetic oligonucleotide
  Target: ATXN1; (-) strand; PAM type: NRG; PAM sequence: TGG
gggtttagcatacttctgaa

SEQ ID NO: 74637 - DNA, 20 bp, Artificial Sequence
  Description of Artificial Sequence: Synthetic oligonucleotide
  Target: ATXN1; (-) strand; PAM type: NRG; PAM sequence: TAG
tagtatctacaaaaagggtt

SEQ ID NO: 74638 - DNA, 20 bp, Artificial Sequence
  Description of Artificial Sequence: Synthetic oligonucleotide
  Target: ATXN1; (-) strand; PAM type: NRG; PAM sequence: GGG
tcctctagtatctacaaaaa

SEQ ID NO: 74639 - DNA, 20 bp, Artificial Sequence
  Description of Artificial Sequence: Synthetic oligonucleotide
  Target: ATXN1; (-) strand; PAM type: NRG; PAM sequence: AGG
ctcctctagtatctacaaaa

SEQ ID NO: 74640 - DNA, 20 bp, Artificial Sequence
  Description of Artificial Sequence: Synthetic oligonucleotide
  Target: ATXN1; (-) strand; PAM type: NRG; PAM sequence: AAG
cctcctctagtatctacaaa

SEQ ID NO: 74641 - DNA, 20 bp, Artificial Sequence
  Description of Artificial Sequence: Synthetic oligonucleotide
  Target: ATXN1; (-) strand; PAM type: NRG; PAM sequence: TAG
tccctcttttcatcctcctc

SEQ ID NO: 74642 - DNA, 20 bp, Artificial Sequence
  Description of Artificial Sequence: Synthetic oligonucleotide
  Target: ATXN1; (-) strand; PAM type: NRG; PAM sequence: TAG
tagggtattggcatgaacca

SEQ ID NO: 74643 - DNA, 20 bp, Artificial Sequence
  Description of Artificial Sequence: Synthetic oligonucleotide
  Target: ATXN1; (-) strand; PAM type: NRG; PAM sequence: TGG
agtaaacaaatgtagggtat

SEQ ID NO: 74644 - DNA, 20 bp, Artificial Sequence
  Description of Artificial Sequence: Synthetic oligonucleotide
  Target: ATXN1; (-) strand; PAM type: NRG; PAM sequence: GGG
tatagaagtaaacaaatgta

SEQ ID NO: 74645 - DNA, 20 bp, Artificial Sequence
  Description of Artificial Sequence: Synthetic oligonucleotide
  Target: ATXN1; (-) strand; PAM type: NRG; PAM sequence: AGG
atatagaagtaaacaaatgt

SEQ ID NO: 74646 - DNA, 20 bp, Artificial Sequence
  Description of Artificial Sequence: Synthetic oligonucleotide
  Target: ATXN1; (-) strand; PAM type: NRG; PAM sequence: TAG
aatatagaagtaaacaaatg

SEQ ID NO: 74647 - DNA, 20 bp, Artificial Sequence
  Description of Artificial Sequence: Synthetic oligonucleotide
  Target: ATXN1; (-) strand; PAM type: NRG; PAM sequence: AAG
tgagaaaatgatcaatatag

SEQ ID NO: 74648 - DNA, 20 bp, Artificial Sequence
  Description of Artificial Sequence: Synthetic oligonucleotide
  Target: ATXN1; (-) strand; PAM type: NRG; PAM sequence: TAG
atttgagaaaatgatcaata

SEQ ID NO: 74649 - DNA, 20 bp, Artificial Sequence
  Description of Artificial Sequence: Synthetic oligonucleotide
  Target: ATXN1; (-) strand; PAM type: NRG; PAM sequence: GAG
tcaggagtatttaatcattt

SEQ ID NO: 74650 - DNA, 20 bp, Artificial Sequence
  Description of Artificial Sequence: Synthetic oligonucleotide
  Target: ATXN1; (-) strand; PAM type: NRG; PAM sequence: GAG
cgttaaaactcctatttcag

SEQ ID NO: 74651 - DNA, 20 bp, Artificial Sequence
  Description of Artificial Sequence: Synthetic oligonucleotide
  Target: ATXN1; (-) strand; PAM type: NRG; PAM sequence: AGG
atcgttaaaactcctatttc

SEQ ID NO: 74652 - DNA, 20 bp, Artificial Sequence
  Description of Artificial Sequence: Synthetic oligonucleotide
  Target: ATXN1; (-) strand; PAM type: NRG; PAM sequence: CAG
aatcgttaaaactcctattt

SEQ ID NO: 74653 - DNA, 20 bp, Artificial Sequence
  Description of Artificial Sequence: Synthetic oligonucleotide
  Target: ATXN1; (-) strand; PAM type: NRG; PAM sequence: GGG
taatagtacccttctccctt

SEQ ID NO: 74654 - DNA, 20 bp, Artificial Sequence
  Description of Artificial Sequence: Synthetic oligonucleotide
  Target: ATXN1; (-) strand; PAM type: NRG; PAM sequence: TGG
ataatagtacccttctccct

SEQ ID NO: 74655 - DNA, 20 bp, Artificial Sequence
  Description of Artificial Sequence: Synthetic oligonucleotide
  Target: ATXN1; (-) strand; PAM type: NRG; PAM sequence: TAG
atgtaaaattcggataataa

SEQ ID NO: 74656 - DNA, 20 bp, Artificial Sequence
  Description of Artificial Sequence: Synthetic oligonucleotide
  Target: ATXN1; (-) strand; PAM type: NRG; PAM sequence: CGG
gttactttgcatgtaaaatt

SEQ ID NO: 74657 - DNA, 20 bp, Artificial Sequence
  Description of Artificial Sequence: Synthetic oligonucleotide
  Target: ATXN1; (-) strand; PAM type: NRG; PAM sequence: AAG
cttgaagtgtgacattgggc

SEQ ID NO: 74658 - DNA, 20 bp, Artificial Sequence
  Description of Artificial Sequence: Synthetic oligonucleotide
  Target: ATXN1; (-) strand; PAM type: NRG; PAM sequence: GGG
ttttcttgaagtgtgacatt

SEQ ID NO: 74659 - DNA, 20 bp, Artificial Sequence
  Description of Artificial Sequence: Synthetic oligonucleotide
  Target: ATXN1; (-) strand; PAM type: NRG; PAM sequence: TGG
gttttcttgaagtgtgacat

SEQ ID NO: 74660 - DNA, 20 bp, Artificial Sequence
  Description of Artificial Sequence: Synthetic oligonucleotide
  Target: ATXN1; (-) strand; PAM type: NRG; PAM sequence: AAG
ccagctctgctgttttcttg

SEQ ID NO: 74661 - DNA, 20 bp, Artificial Sequence
  Description of Artificial Sequence: Synthetic oligonucleotide
  Target: ATXN1; (-) strand; PAM type: NRG; PAM sequence: CAG
ggctgcctgggctcaaattc

SEQ ID NO: 74662 - DNA, 20 bp, Artificial Sequence
  Description of Artificial Sequence: Synthetic oligonucleotide
  Target: ATXN1; (-) strand; PAM type: NRG; PAM sequence: GGG
ttgcaagcttcaggctgcct

SEQ ID NO: 74663 - DNA, 20 bp, Artificial Sequence
  Description of Artificial Sequence: Synthetic oligonucleotide
  Target: ATXN1; (-) strand; PAM type: NRG; PAM sequence: TGG
attgcaagcttcaggctgcc

SEQ ID NO: 74664 - DNA, 20 bp, Artificial Sequence
  Description of Artificial Sequence: Synthetic oligonucleotide
  Target: ATXN1; (-) strand; PAM type: NRG; PAM sequence: AGG
tagataagattgcaagcttc

SEQ ID NO: 74665 - DNA, 20 bp, Artificial Sequence
  Description of Artificial Sequence: Synthetic oligonucleotide
  Target: ATXN1; (-) strand; PAM type: NRG; PAM sequence: CAG
gtagataagattgcaagctt

SEQ ID NO: 74666 - DNA, 20 bp, Artificial Sequence
  Description of Artificial Sequence: Synthetic oligonucleotide
  Target: ATXN1; (-) strand; PAM type: NRG; PAM sequence: AAG
aaagctgtagataagattgc

SEQ ID NO: 74667 - DNA, 20 bp, Artificial Sequence
  Description of Artificial Sequence: Synthetic oligonucleotide
  Target: ATXN1; (-) strand; PAM type: NRG; PAM sequence: AAG
atgatggaaaagctgtagat

SEQ ID NO: 74668 - DNA, 20 bp, Artificial Sequence
  Description of Artificial Sequence: Synthetic oligonucleotide
  Target: ATXN1; (-) strand; PAM type: NRG; PAM sequence: TAG
gccatatgatggaaaagctg

SEQ ID NO: 74669 - DNA, 20 bp, Artificial Sequence
  Description of Artificial Sequence: Synthetic oligonucleotide
  Target: ATXN1; (-) strand; PAM type: NRG; PAM sequence: AAG
gttagtgccatatgatggaa

SEQ ID NO: 74670 - DNA, 20 bp, Artificial Sequence
  Description of Artificial Sequence: Synthetic oligonucleotide
  Target: ATXN1; (-) strand; PAM type: NRG; PAM sequence: TGG
actatgttagtgccatatga

SEQ ID NO: 74671 - DNA, 20 bp, Artificial Sequence
  Description of Artificial Sequence: Synthetic oligonucleotide
  Target: ATXN1; (-) strand; PAM type: NRG; PAM sequence: TAG
atgattaaatataactatgt

SEQ ID NO: 74672 - DNA, 20 bp, Artificial Sequence
  Description of Artificial Sequence: Synthetic oligonucleotide
  Target: ATXN1; (-) strand; PAM type: NRG; PAM sequence: GGG
atatatatatgtccaatatc

SEQ ID NO: 74673 - DNA, 20 bp, Artificial Sequence
  Description of Artificial Sequence: Synthetic oligonucleotide
  Target: ATXN1; (-) strand; PAM type: NRG; PAM sequence: CGG
tatatatatatgtccaatat

SEQ ID NO: 74674 - DNA, 20 bp, Artificial Sequence
  Description of Artificial Sequence: Synthetic oligonucleotide
  Target: ATXN1; (-) strand; PAM type: NRG; PAM sequence: TAG
tctgaagttatactgctcat

SEQ ID NO: 74675 - DNA, 20 bp, Artificial Sequence
  Description of Artificial Sequence: Synthetic oligonucleotide
  Target: ATXN1; (-) strand; PAM type: NRG; PAM sequence: AAG
ttttattagatatgtatctg

SEQ ID NO: 74676 - DNA, 20 bp, Artificial Sequence
  Description of Artificial Sequence: Synthetic oligonucleotide
  Target: ATXN1; (-) strand; PAM type: NRG; PAM sequence: TAG
atttaataaaaaaattttat

SEQ ID NO: 74677 - DNA, 20 bp, Artificial Sequence
  Description of Artificial Sequence: Synthetic oligonucleotide
  Target: ATXN1; (-) strand; PAM type: NRG; PAM sequence: AGG
atttcttaaaaagagcaaaa

SEQ ID NO: 74678 - DNA, 20 bp, Artificial Sequence
  Description of Artificial Sequence: Synthetic oligonucleotide
  Target: ATXN1; (-) strand; PAM type: NRG; PAM sequence: AAG
catttcttaaaaagagcaaa

SEQ ID NO: 74679 - DNA, 20 bp, Artificial Sequence
  Description of Artificial Sequence: Synthetic oligonucleotide
  Target: ATXN1; (-) strand; PAM type: NRG; PAM sequence: GAG
aatttttcatttcttaaaaa

SEQ ID NO: 74680 - DNA, 20 bp, Artificial Sequence
  Description of Artificial Sequence: Synthetic oligonucleotide
  Target: ATXN1; (-) strand; PAM type: NRG; PAM sequence: AAG
ataatttttcatttcttaaa

SEQ ID NO: 74681 - DNA, 20 bp, Artificial Sequence
  Description of Artificial Sequence: Synthetic oligonucleotide
  Target: ATXN1; (-) strand; PAM type: NRG; PAM sequence: AAG
tacaatcatttttcagtgga

SEQ ID NO: 74682 - DNA, 20 bp, Artificial Sequence
  Description of Artificial Sequence: Synthetic oligonucleotide
  Target: ATXN1; (-) strand; PAM type: NRG; PAM sequence: TGG
tagatacaatcatttttcag

SEQ ID NO: 74683 - DNA, 20 bp, Artificial Sequence
  Description of Artificial Sequence: Synthetic oligonucleotide
  Target: ATXN1; (-) strand; PAM type: NRG; PAM sequence: CAG
cactagatacaatcattttt

SEQ ID NO: 74684 - DNA, 20 bp, Artificial Sequence
  Description of Artificial Sequence: Synthetic oligonucleotide
  Target: ATXN1; (-) strand; PAM type: NRG; PAM sequence: TAG
ttagacaactatgaaatcac

SEQ ID NO: 74685 - DNA, 20 bp, Artificial Sequence
  Description of Artificial Sequence: Synthetic oligonucleotide
  Target: ATXN1; (-) strand; PAM type: NRG; PAM sequence: TAG
cctttctggccaagtatttt

SEQ ID NO: 74686 - DNA, 20 bp, Artificial Sequence
  Description of Artificial Sequence: Synthetic oligonucleotide
  Target: ATXN1; (-) strand; PAM type: NRG; PAM sequence: AAG
taagttcttcctttctggcc

SEQ ID NO: 74687 - DNA, 20 bp, Artificial Sequence
  Description of Artificial Sequence: Synthetic oligonucleotide
  Target: ATXN1; (-) strand; PAM type: NRG; PAM sequence: TGG
aattttaagttcttcctttc

SEQ ID NO: 74688 - DNA, 20 bp, Artificial Sequence
  Description of Artificial Sequence: Synthetic oligonucleotide
  Target: ATXN1; (-) strand; PAM type: NRG; PAM sequence: AAG
gaagggtcctagggaatttt

SEQ ID NO: 74689 - DNA, 20 bp, Artificial Sequence
  Description of Artificial Sequence: Synthetic oligonucleotide
  Target: ATXN1; (-) strand; PAM type: NRG; PAM sequence: GGG
gaaggagtagaagggtccta

SEQ ID NO: 74690 - DNA, 20 bp, Artificial Sequence
  Description of Artificial Sequence: Synthetic oligonucleotide
  Target: ATXN1; (-) strand; PAM type: NRG; PAM sequence: AGG
agaaggagtagaagggtcct

SEQ ID NO: 74691 - DNA, 20 bp, Artificial Sequence
  Description of Artificial Sequence: Synthetic oligonucleotide
  Target: ATXN1; (-) strand; PAM type: NRG; PAM sequence: TAG
cagaaggagtagaagggtcc

SEQ ID NO: 74692 - DNA, 20 bp, Artificial Sequence
  Description of Artificial Sequence: Synthetic oligonucleotide
  Target: ATXN1; (-) strand; PAM type: NRG; PAM sequence: GGG
taaatccagaaggagtagaa

SEQ ID NO: 74693 - DNA, 20 bp, Artificial Sequence
  Description of Artificial Sequence: Synthetic oligonucleotide
  Target: ATXN1; (-) strand; PAM type: NRG; PAM sequence: AGG
ttaaatccagaaggagtaga

SEQ ID NO: 74694 - DNA, 20 bp, Artificial Sequence
  Description of Artificial Sequence: Synthetic oligonucleotide
  Target: ATXN1; (-) strand; PAM type: NRG; PAM sequence: AAG
attaaatccagaaggagtag

SEQ ID NO: 74695 - DNA, 20 bp, Artificial Sequence
  Description of Artificial Sequence: Synthetic oligonucleotide
  Target: ATXN1; (-) strand; PAM type: NRG; PAM sequence: TAG
aatattaaatccagaaggag

SEQ ID NO: 74696 - DNA, 20 bp, Artificial Sequence
  Description of Artificial Sequence: Synthetic oligonucleotide
  Target: ATXN1; (-) strand; PAM type: NRG; PAM sequence: GAG
aataatattaaatccagaag

SEQ ID NO: 74697 - DNA, 20 bp, Artificial Sequence
  Description of Artificial Sequence: Synthetic oligonucleotide
  Target: ATXN1; (-) strand; PAM type: NRG; PAM sequence: AGG
gaaataatattaaatccaga

SEQ ID NO: 74698 - DNA, 20 bp, Artificial Sequence
  Description of Artificial Sequence: Synthetic oligonucleotide
  Target: ATXN1; (-) strand; PAM type: NRG; PAM sequence: AAG
agaaataatattaaatccag

SEQ ID NO: 74699 - DNA, 20 bp, Artificial Sequence
  Description of Artificial Sequence: Synthetic oligonucleotide
  Target: ATXN1; (-) strand; PAM type: NRG; PAM sequence: CAG
ttcagaaataatattaaatc

SEQ ID NO: 74700 - DNA, 20 bp, Artificial Sequence
  Description of Artificial Sequence: Synthetic oligonucleotide
  Target: ATXN1; (-) strand; PAM type: NRG; PAM sequence: CAG
cttaccagatttcgacattt

SEQ ID NO: 74701 - DNA, 20 bp, Artificial Sequence
  Description of Artificial Sequence: Synthetic oligonucleotide
  Target: ATXN1; (-) strand; PAM type: NRG; PAM sequence: CAG
gcagcatccttgaaacttac

SEQ ID NO: 74702 - DNA, 20 bp, Artificial Sequence
  Description of Artificial Sequence: Synthetic oligonucleotide
  Target: ATXN1; (-) strand; PAM type: NRG; PAM sequence: CAG
aaccttcctccattagacag

SEQ ID NO: 74703 - DNA, 20 bp, Artificial Sequence
  Description of Artificial Sequence: Synthetic oligonucleotide
  Target: ATXN1; (-) strand; PAM type: NRG; PAM sequence: CAG
tagaaccttcctccattaga

SEQ ID NO: 74704 - DNA, 20 bp, Artificial Sequence
  Description of Artificial Sequence: Synthetic oligonucleotide
  Target: ATXN1; (-) strand; PAM type: NRG; PAM sequence: TAG
tttgtagaaccttcctccat

SEQ ID NO: 74705 - DNA, 20 bp, Artificial Sequence
  Description of Artificial Sequence: Synthetic oligonucleotide
  Target: ATXN1; (-) strand; PAM type: NRG; PAM sequence: TAG
aagtaaattgtactgttttg

SEQ ID NO: 74706 - DNA, 20 bp, Artificial Sequence
  Description of Artificial Sequence: Synthetic oligonucleotide
  Target: ATXN1; (-) strand; PAM type: NRG; PAM sequence: AAG
gggggggtcatttgtaagtc

SEQ ID NO: 74707 - DNA, 20 bp, Artificial Sequence
  Description of Artificial Sequence: Synthetic oligonucleotide
  Target: ATXN1; (-) strand; PAM type: NRG; PAM sequence: AAG
gggtggggggggtcatttgt

SEQ ID NO: 74708 - DNA, 20 bp, Artificial Sequence
  Description of Artificial Sequence: Synthetic oligonucleotide
  Target: ATXN1; (-) strand; PAM type: NRG; PAM sequence: GGG
ttgggttttgggggtggggg

SEQ ID NO: 74709 - DNA, 20 bp, Artificial Sequence
  Description of Artificial Sequence: Synthetic oligonucleotide
  Target: ATXN1; (-) strand; PAM type: NRG; PAM sequence: GGG
tttgggttttgggggtgggg

SEQ ID NO: 74710 - DNA, 20 bp, Artificial Sequence
  Description of Artificial Sequence: Synthetic oligonucleotide
  Target: ATXN1; (-) strand; PAM type: NRG; PAM sequence: GGG
ttttgggttttgggggtggg

SEQ ID NO: 74711 - DNA, 20 bp, Artificial Sequence
  Description of Artificial Sequence: Synthetic oligonucleotide
  Target: ATXN1; (-) strand; PAM type: NRG; PAM sequence: GGG
attttgggttttgggggtgg

SEQ ID NO: 74712 - DNA, 20 bp, Artificial Sequence
  Description of Artificial Sequence: Synthetic oligonucleotide
  Target: ATXN1; (-) strand; PAM type: NRG; PAM sequence: GGG
tattttgggttttgggggtg

SEQ ID NO: 74713 - DNA, 20 bp, Artificial Sequence
  Description of Artificial Sequence: Synthetic oligonucleotide
  Target: ATXN1; (-) strand; PAM type: NRG; PAM sequence: GGG
gtattttgggttttgggggt

SEQ ID NO: 74714 - DNA, 20 bp, Artificial Sequence
  Description of Artificial Sequence: Synthetic oligonucleotide
  Target: ATXN1; (-) strand; PAM type: NRG; PAM sequence: TGG
tgtattttgggttttggggg

SEQ ID NO: 74715 - DNA, 20 bp, Artificial Sequence
  Description of Artificial Sequence: Synthetic oligonucleotide
  Target: ATXN1; (-) strand; PAM type: NRG; PAM sequence: GGG
ccatgtattttgggttttgg

SEQ ID NO: 74716 - DNA, 20 bp, Artificial Sequence
  Description of Artificial Sequence: Synthetic oligonucleotide
  Target: ATXN1; (-) strand; PAM type: NRG; PAM sequence: GGG
tccatgtattttgggttttg

SEQ ID NO: 74717 - DNA, 20 bp, Artificial Sequence
  Description of Artificial Sequence: Synthetic oligonucleotide
  Target: ATXN1; (-) strand; PAM type: NRG; PAM sequence: GGG
ttccatgtattttgggtttt

SEQ ID NO: 74718 - DNA, 20 bp, Artificial Sequence
  Description of Artificial Sequence: Synthetic oligonucleotide
  Target: ATXN1; (-) strand; PAM type: NRG; PAM sequence: TGG
tttccatgtattttgggttt

SEQ ID NO: 74719 - DNA, 20 bp, Artificial Sequence
  Description of Artificial Sequence: Synthetic oligonucleotide
  Target: ATXN1; (-) strand; PAM type: NRG; PAM sequence: GGG
atggtgtttccatgtatttt

SEQ ID NO: 74720 - DNA, 20 bp, Artificial Sequence
  Description of Artificial Sequence: Synthetic oligonucleotide
  Target: ATXN1; (-) strand; PAM type: NRG; PAM sequence: TGG
aatggtgtttccatgtattt

SEQ ID NO: 74721 - DNA, 20 bp, Artificial Sequence
  Description of Artificial Sequence: Synthetic oligonucleotide
  Target: ATXN1; (-) strand; PAM type: NRG; PAM sequence: TGG
tgctgactgattatgcaaaa

SEQ ID NO: 74722 - DNA, 20 bp, Artificial Sequence
  Description of Artificial Sequence: Synthetic oligonucleotide
  Target: ATXN1; (-) strand; PAM type: NRG; PAM sequence: GAG
gagaattttgaaaacaaaaa

SEQ ID NO: 74723 - DNA, 20 bp, Artificial Sequence
  Description of Artificial Sequence: Synthetic oligonucleotide
  Target: ATXN1; (-) strand; PAM type: NRG; PAM sequence: AAG
ctgagaattttgaaaacaaa

SEQ ID NO: 74724 - DNA, 20 bp, Artificial Sequence
  Description of Artificial Sequence: Synthetic oligonucleotide
  Target: ATXN1; (-) strand; PAM type: NRG; PAM sequence: GAG
taatacagttttccaatgct

SEQ ID NO: 74725 - DNA, 20 bp, Artificial Sequence
  Description of Artificial Sequence: Synthetic oligonucleotide
  Target: ATXN1; (-) strand; PAM type: NRG; PAM sequence: CAG
atgagagcgtctacttaata

SEQ ID NO: 74726 - DNA, 20 bp, Artificial Sequence
  Description of Artificial Sequence: Synthetic oligonucleotide
  Target: ATXN1; (-) strand; PAM type: NRG; PAM sequence: GAG
tttccagaggcagtttatga

SEQ ID NO: 74727 - DNA, 20 bp, Artificial Sequence
  Description of Artificial Sequence: Synthetic oligonucleotide
  Target: ATXN1; (-) strand; PAM type: NRG; PAM sequence: GAG
tatttccagaggcagtttat

SEQ ID NO: 74728 - DNA, 20 bp, Artificial Sequence
  Description of Artificial Sequence: Synthetic oligonucleotide
  Target: ATXN1; (-) strand; PAM type: NRG; PAM sequence: CAG
ccagtttgtatttccagagg

SEQ ID NO: 74729 - DNA, 20 bp, Artificial Sequence
  Description of Artificial Sequence: Synthetic oligonucleotide
  Target: ATXN1; (-) strand; PAM type: NRG; PAM sequence: AGG
ataccagtttgtatttccag

SEQ ID NO: 74730 - DNA, 20 bp, Artificial Sequence
  Description of Artificial Sequence: Synthetic oligonucleotide
  Target: ATXN1; (-) strand; PAM type: NRG; PAM sequence: GAG
cataccagtttgtatttcca

SEQ ID NO: 74731 - DNA, 20 bp, Artificial Sequence
  Description of Artificial Sequence: Synthetic oligonucleotide
  Target: ATXN1; (-) strand; PAM type: NRG; PAM sequence: CAG
gtcataccagtttgtatttc

SEQ ID NO: 74732 - DNA, 20 bp, Artificial Sequence
  Description of Artificial Sequence: Synthetic oligonucleotide
  Target: ATXN1; (-) strand; PAM type: NRG; PAM sequence: CAG
tactttcagtaaagtcatac

SEQ ID NO: 74733 - DNA, 20 bp, Artificial Sequence
  Description of Artificial Sequence: Synthetic oligonucleotide
  Target: ATXN1; (-) strand; PAM type: NRG; PAM sequence: AAG
ttgccaaattactttcagta

SEQ ID NO: 74734 - DNA, 20 bp, Artificial Sequence
  Description of Artificial Sequence: Synthetic oligonucleotide
  Target: ATXN1; (-) strand; PAM type: NRG; PAM sequence: CAG
acttgttgccaaattacttt

SEQ ID NO: 74735 - DNA, 20 bp, Artificial Sequence
  Description of Artificial Sequence: Synthetic oligonucleotide
  Target: ATXN1; (-) strand; PAM type: NRG; PAM sequence: TGG
ttttcaagttttacggcttt

SEQ ID NO: 74736 - DNA, 20 bp, Artificial Sequence
  Description of Artificial Sequence: Synthetic oligonucleotide
  Target: ATXN1; (-) strand; PAM type: NRG; PAM sequence: CGG
gtaagagttttcaagtttta

SEQ ID NO: 74737 - DNA, 20 bp, Artificial Sequence
  Description of Artificial Sequence: Synthetic oligonucleotide
  Target: ATXN1; (-) strand; PAM type: NRG; PAM sequence: AAG
tggtaaatgtaagagttttc

SEQ ID NO: 74738 - DNA, 20 bp, Artificial Sequence
  Description of Artificial Sequence: Synthetic oligonucleotide
  Target: ATXN1; (-) strand; PAM type: NRG; PAM sequence: GAG
cagcatactggtaaatgtaa

SEQ ID NO: 74739 - DNA, 20 bp, Artificial Sequence
  Description of Artificial Sequence: Synthetic oligonucleotide
  Target: ATXN1; (-) strand; PAM type: NRG; PAM sequence: AAG
agcagcatactggtaaatgt

SEQ ID NO: 74740 - DNA, 20 bp, Artificial Sequence
  Description of Artificial Sequence: Synthetic oligonucleotide
  Target: ATXN1; (-) strand; PAM type: NRG; PAM sequence: TGG
ctaatttcttagcagcatac

SEQ ID NO: 74741 - DNA, 20 bp, Artificial Sequence
  Description of Artificial Sequence: Synthetic oligonucleotide
  Target: ATXN1; (-) strand; PAM type: NRG; PAM sequence: CAG
tccttaggctaatttcttag

SEQ ID NO: 74742 - DNA, 20 bp, Artificial Sequence
  Description of Artificial Sequence: Synthetic oligonucleotide
  Target: ATXN1; (-) strand; PAM type: NRG; PAM sequence: TAG
atttccttaggctaatttct

SEQ ID NO: 74743 - DNA, 20 bp, Artificial Sequence
  Description of Artificial Sequence: Synthetic oligonucleotide
  Target: ATXN1; (-) strand; PAM type: NRG; PAM sequence: AGG
ccattacaaattatttcctt

SEQ ID NO: 74744 - DNA, 20 bp, Artificial Sequence
  Description of Artificial Sequence: Synthetic oligonucleotide
  Target: ATXN1; (-) strand; PAM type: NRG; PAM sequence: TAG
cccattacaaattatttcct

SEQ ID NO: 74745 - DNA, 20 bp, Artificial Sequence
  Description of Artificial Sequence: Synthetic oligonucleotide
  Target: ATXN1; (-) strand; PAM type: NRG; PAM sequence: TAG
atattcttatagctctgtat

SEQ ID NO: 74746 - DNA, 20 bp, Artificial Sequence
  Description of Artificial Sequence: Synthetic oligonucleotide
  Target: ATXN1; (-) strand; PAM type: NRG; PAM sequence: TAG
tgatgccaaaaatattctta

SEQ ID NO: 74747 - DNA, 20 bp, Artificial Sequence
  Description of Artificial Sequence: Synthetic oligonucleotide
  Target: ATXN1; (-) strand; PAM type: NRG; PAM sequence: CAG
caggcgtgatccaccacacc

SEQ ID NO: 74748 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgttgggattac

SEQ ID NO: 74749 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgttgggatta

SEQ ID NO: 74750 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgtt

SEQ ID NO: 74751 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaaagtgt

SEQ ID NO: 74752 - DNA, 20 bp, Artificial Sequence
  Description of Artificial Sequence: Synthetic oligonucleotide
  Target: ATXN1; (-) strand; PAM type: NRG; PAM sequence: AAG
cttcccacctcagcctccca

SEQ ID NO: 74753 - DNA, 20 bp, Artificial Sequence
  Description of Artificial Sequence: Synthetic oligonucleotide
  Target: ATXN1; (-) strand; PAM type: NRG; PAM sequence: CAG
ctcaagcagtcttcccacct

SEQ ID NO: 74754 - DNA, 20 bp, Artificial Sequence
  Description of Artificial Sequence: Synthetic oligonucleotide
  Target: ATXN1; (-) strand; PAM type: NRG; PAM sequence: CAG
ctcaaactcgtgacctcaag

SEQ ID NO: 74755 - DNA, 20 bp, Artificial Sequence
  Description of Artificial Sequence: Synthetic oligonucleotide
  Target: ATXN1; (-) strand; PAM type: NRG; PAM sequence: AAG
ggtctcaaactcgtgacctc

SEQ ID NO: 74756 - DNA, 20 bp, Artificial Sequence
  Description of Artificial Sequence: Synthetic oligonucleotide
  Target: ATXN1; (-) strand; PAM type: NRG; PAM sequence: TGG
ttttgccatgttgcccaggc

SEQ ID NO: 74757 - DNA, 20 bp, Artificial Sequence
  Description of Artificial Sequence: Synthetic oligonucleotide
  Target: ATXN1; (-) strand; PAM type: NRG; PAM sequence: AGG
gaggttttgccatgttgccc

SEQ ID NO: 74758 - DNA, 20 bp, Artificial Sequence
  Description of Artificial Sequence: Synthetic oligonucleotide
  Target: ATXN1; (-) strand; PAM type: NRG; PAM sequence: CAG
tgaggttttgccatgttgcc

SEQ ID NO: 74759 - DNA, 20 bp, Artificial Sequence
  Description of Artificial Sequence: Synthetic oligonucleotide
  Target: ATXN1; (-) strand; PAM type: NRG; PAM sequence: AGG
tttttttttatatagtgatg

SEQ ID NO: 74760 - DNA, 20 bp, Artificial Sequence
  Description of Artificial Sequence: Synthetic oligonucleotide
  Target: ATXN1; (-) strand; PAM type: NRG; PAM sequence: GAG
ttttttttttatatagtgat

SEQ ID NO: 74761 - DNA, 20 bp, Artificial Sequence
  Description of Artificial Sequence: Synthetic oligonucleotide
  Target: ATXN1; (-) strand; PAM type: NRG; PAM sequence: TAG
ttgtattttttttttttata

SEQ ID NO: 74762 - DNA, 20 bp, Artificial Sequence
  Description of Artificial Sequence: Synthetic oligonucleotide
  Target: ATXN1; (-) strand; PAM type: NRG; PAM sequence: TGG
caggtgcacatcaccatgcc

SEQ ID NO: 74763 - DNA, 20 bp, Artificial Sequence
  Description of Artificial Sequence: Synthetic oligonucleotide
  Target: ATXN1; (-) strand; PAM type: NRG; PAM sequence: AGG
gtattaatagctgggactac

SEQ ID NO: 74764 - DNA, 20 bp, Artificial Sequence
  Description of Artificial Sequence: Synthetic oligonucleotide
  Target: ATXN1; (-) strand; PAM type: NRG; PAM sequence: CAG
agtattaatagctgggacta

SEQ ID NO: 74765 - DNA, 20 bp, Artificial Sequence
  Description of Artificial Sequence: Synthetic oligonucleotide
  Target: ATXN1; (-) strand; PAM type: NRG; PAM sequence: GGG
cctcccaagtattaatagct

SEQ ID NO: 74766 - DNA, 20 bp, Artificial Sequence
  Description of Artificial Sequence: Synthetic oligonucleotide
  Target: ATXN1; (-) strand; PAM type: NRG; PAM sequence: TGG
gcctcccaagtattaatagc

SEQ ID NO: 74767 - DNA, 20 bp, Artificial Sequence
  Description of Artificial Sequence: Synthetic oligonucleotide
  Target: ATXN1; (-) strand; PAM type: NRG; PAM sequence: TAG
ctcagcctcccaagtattaa

SEQ ID NO: 74768 - DNA, 20 bp, Artificial Sequence
  Description of Artificial Sequence: Synthetic oligonucleotide
  Target: ATXN1; (-) strand; PAM type: NRG; PAM sequence: AAG
tcctcccacctcagcctccc

SEQ ID NO: 74769 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatcctcccacct

SEQ ID NO: 74770 - DNA, 20 bp, Artificial Sequence
  Description of Artificial Sequence: Synthetic oligonucleotide
  Target: ATXN1; (-) strand; PAM type: NRG; PAM sequence: AAG
agcttccacctccaaggctc

SEQ ID NO: 74771 - DNA, 20 bp, Artificial Sequence
  Description of Artificial Sequence: Synthetic oligonucleotide
  Target: ATXN1; (-) strand; PAM type: NRG; PAM sequence: AGG
cattgcagcttccacctcca

SEQ ID NO: 74772 - DNA, 20 bp, Artificial Sequence
  Description of Artificial Sequence: Synthetic oligonucleotide
  Target: ATXN1; (-) strand; PAM type: NRG; PAM sequence: AAG
tcattgcagcttccacctcc

SEQ ID NO: 74773 - DNA, 20 bp, Artificial Sequence
  Description of Artificial Sequence: Synthetic oligonucleotide
  Target: ATXN1; (-) strand; PAM type: NRG; PAM sequence: CAG
ggcatgattttggctcattg

SEQ ID NO: 74774 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggcatgattt

SEQ ID NO: 74775 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 74776 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 74777 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcacccaggctg

SEQ ID NO: 74778 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtcacccaggc

SEQ ID NO: 74779 - DNA, 20 bp, Artificial Sequence
  Description of Artificial Sequence: Synthetic oligonucleotide
  Target: ATXN1; (-) strand; PAM type: NRG; PAM sequence: AGG
agggtctcactctgtcaccc

SEQ ID NO: 74780 - DNA, 20 bp, Artificial Sequence
  Description of Artificial Sequence: Synthetic oligonucleotide
  Target: ATXN1; (-) strand; PAM type: NRG; PAM sequence: CAG
tagggtctcactctgtcacc

SEQ ID NO: 74781 - DNA, 20 bp, Artificial Sequence
  Description of Artificial Sequence: Synthetic oligonucleotide
  Target: ATXN1; (-) strand; PAM type: NRG; PAM sequence: GGG
ctttttattttcttgagata

SEQ ID NO: 74782 - DNA, 20 bp, Artificial Sequence
  Description of Artificial Sequence: Synthetic oligonucleotide
  Target: ATXN1; (-) strand; PAM type: NRG; PAM sequence: AGG
cctttttattttcttgagat

SEQ ID NO: 74783 - DNA, 20 bp, Artificial Sequence
  Description of Artificial Sequence: Synthetic oligonucleotide
  Target: ATXN1; (-) strand; PAM type: NRG; PAM sequence: TAG
gcctttttattttcttgaga

SEQ ID NO: 74784 - DNA, 20 bp, Artificial Sequence
  Description of Artificial Sequence: Synthetic oligonucleotide
  Target: ATXN1; (-) strand; PAM type: NRG; PAM sequence: GAG
ttttgcctttttattttctt

SEQ ID NO: 74785 - DNA, 20 bp, Artificial Sequence
  Description of Artificial Sequence: Synthetic oligonucleotide
  Target: ATXN1; (-) strand; PAM type: NRG; PAM sequence: TAG
atcccttctaactggacagt

SEQ ID NO: 74786 - DNA, 20 bp, Artificial Sequence
  Description of Artificial Sequence: Synthetic oligonucleotide
  Target: ATXN1; (-) strand; PAM type: NRG; PAM sequence: CAG
ttatatcccttctaactgga

SEQ ID NO: 74787 - DNA, 20 bp, Artificial Sequence
  Description of Artificial Sequence: Synthetic oligonucleotide
  Target: ATXN1; (-) strand; PAM type: NRG; PAM sequence: TGG
taatttatatcccttctaac

SEQ ID NO: 74788 - DNA, 20 bp, Artificial Sequence
  Description of Artificial Sequence: Synthetic oligonucleotide
  Target: ATXN1; (-) strand; PAM type: NRG; PAM sequence: GAG
ttaatgattagtataccatt

SEQ ID NO: 74789 - DNA, 20 bp, Artificial Sequence
  Description of Artificial Sequence: Synthetic oligonucleotide
  Target: ATXN1; (-) strand; PAM type: NRG; PAM sequence: TAG
accgtatagttattaatgat

SEQ ID NO: 74790 - DNA, 20 bp, Artificial Sequence
  Description of Artificial Sequence: Synthetic oligonucleotide
  Target: ATXN1; (-) strand; PAM type: NRG; PAM sequence: TAG
acagatatttttctaccgta

SEQ ID NO: 74791 - DNA, 20 bp, Artificial Sequence
  Description of Artificial Sequence: Synthetic oligonucleotide
  Target: ATXN1; (-) strand; PAM type: NRG; PAM sequence: CAG
ctgaacatctttcatagcaa

SEQ ID NO: 74792 - DNA, 20 bp, Artificial Sequence
  Description of Artificial Sequence: Synthetic oligonucleotide
  Target: ATXN1; (-) strand; PAM type: NRG; PAM sequence: TAG
ataattctgaacatctttca

SEQ ID NO: 74793 - DNA, 20 bp, Artificial Sequence
  Description of Artificial Sequence: Synthetic oligonucleotide
  Target: ATXN1; (-) strand; PAM type: NRG; PAM sequence: GAG
gaagtagtagagattattaa

SEQ ID NO: 74794 - DNA, 20 bp, Artificial Sequence
  Description of Artificial Sequence: Synthetic oligonucleotide
  Target: ATXN1; (-) strand; PAM type: NRG; PAM sequence: AAG
tagaagtagtagagattatt

SEQ ID NO: 74795 - DNA, 20 bp, Artificial Sequence
  Description of Artificial Sequence: Synthetic oligonucleotide
  Target: ATXN1; (-) strand; PAM type: NRG; PAM sequence: GAG
tagagattgtagaagtagta

SEQ ID NO: 74796 - DNA, 20 bp, Artificial Sequence
  Description of Artificial Sequence: Synthetic oligonucleotide
  Target: ATXN1; (-) strand; PAM type: NRG; PAM sequence: TAG
agtagagattgtagaagtag

SEQ ID NO: 74797 - DNA, 20 bp, Artificial Sequence
  Description of Artificial Sequence: Synthetic oligonucleotide
  Target: ATXN1; (-) strand; PAM type: NRG; PAM sequence: TAG
ggtagtagagattgtagaag

SEQ ID NO: 74798 - DNA, 20 bp, Artificial Sequence
  Description of Artificial Sequence: Synthetic oligonucleotide
  Target: ATXN1; (-) strand; PAM type: NRG; PAM sequence: AAG
aatggtagtagagattgtag

SEQ ID NO: 74799 - DNA, 20 bp, Artificial Sequence
  Description of Artificial Sequence: Synthetic oligonucleotide
  Target: ATXN1; (-) strand; PAM type: NRG; PAM sequence: TAG
tcaaatggtagtagagattg

SEQ ID NO: 74800 - DNA, 20 bp, Artificial Sequence
  Description of Artificial Sequence: Synthetic oligonucleotide
  Target: ATXN1; (-) strand; PAM type: NRG; PAM sequence: GAG
acaaacatcaaatggtagta

SEQ ID NO: 74801 - DNA, 20 bp, Artificial Sequence
  Description of Artificial Sequence: Synthetic oligonucleotide
  Target: ATXN1; (-) strand; PAM type: NRG; PAM sequence: TAG
agacaaacatcaaatggtag

SEQ ID NO: 74802 - DNA, 20 bp, Artificial Sequence
  Description of Artificial Sequence: Synthetic oligonucleotide
  Target: ATXN1; (-) strand; PAM type: NRG; PAM sequence: TAG
gagagacaaacatcaaatgg

SEQ ID NO: 74803 - DNA, 20 bp, Artificial Sequence
  Description of Artificial Sequence: Synthetic oligonucleotide
  Target: ATXN1; (-) strand; PAM type: NRG; PAM sequence: TGG
ttagagagacaaacatcaaa

SEQ ID NO: 74804 - DNA, 20 bp, Artificial Sequence
  Description of Artificial Sequence: Synthetic oligonucleotide
  Target: ATXN1; (-) strand; PAM type: NRG; PAM sequence: GAG
gatttataaattcacttaga

SEQ ID NO: 74805 - DNA, 20 bp, Artificial Sequence
  Description of Artificial Sequence: Synthetic oligonucleotide
  Target: ATXN1; (-) strand; PAM type: NRG; PAM sequence: GAG
tagatttataaattcactta

SEQ ID NO: 74806 - DNA, 20 bp, Artificial Sequence
  Description of Artificial Sequence: Synthetic oligonucleotide
  Target: ATXN1; (-) strand; PAM type: NRG; PAM sequence: TAG
tatagatttataaattcact

SEQ ID NO: 74807 - DNA, 20 bp, Artificial Sequence
  Description of Artificial Sequence: Synthetic oligonucleotide
  Target: ATXN1; (-) strand; PAM type: NRG; PAM sequence: TAG
tgaaggcatttataaattta

SEQ ID NO: 74808 - DNA, 20 bp, Artificial Sequence
  Description of Artificial Sequence: Synthetic oligonucleotide
  Target: ATXN1; (-) strand; PAM type: NRG; PAM sequence: AGG
ggcattgctgataattctga

SEQ ID NO: 74809 - DNA, 20 bp, Artificial Sequence
  Description of Artificial Sequence: Synthetic oligonucleotide
  Target: ATXN1; (-) strand; PAM type: NRG; PAM sequence: AAG
aggcattgctgataattctg

SEQ ID NO: 74810 - DNA, 20 bp, Artificial Sequence
  Description of Artificial Sequence: Synthetic oligonucleotide
  Target: ATXN1; (-) strand; PAM type: NRG; PAM sequence: AGG
actagttaggatagatgaca

SEQ ID NO: 74811 - DNA, 20 bp, Artificial Sequence
  Description of Artificial Sequence: Synthetic oligonucleotide
  Target: ATXN1; (-) strand; PAM type: NRG; PAM sequence: AAG
cactagttaggatagatgac

SEQ ID NO: 74812 - DNA, 20 bp, Artificial Sequence
  Description of Artificial Sequence: Synthetic oligonucleotide
  Target: ATXN1; (-) strand; PAM type: NRG; PAM sequence: TAG
tttgaggtcactagttagga

SEQ ID NO: 74813 - DNA, 20 bp, Artificial Sequence
  Description of Artificial Sequence: Synthetic oligonucleotide
  Target: ATXN1; (-) strand; PAM type: NRG; PAM sequence: AGG
ttattttgaggtcactagtt

SEQ ID NO: 74814 - DNA, 20 bp, Artificial Sequence
  Description of Artificial Sequence: Synthetic oligonucleotide
  Target: ATXN1; (-) strand; PAM type: NRG; PAM sequence: TAG
cttattttgaggtcactagt

SEQ ID NO: 74815 - DNA, 20 bp, Artificial Sequence
  Description of Artificial Sequence: Synthetic oligonucleotide
  Target: ATXN1; (-) strand; PAM type: NRG; PAM sequence: TAG
tctacttattttgaggtcac

SEQ ID NO: 74816 - DNA, 20 bp, Artificial Sequence
  Description of Artificial Sequence: Synthetic oligonucleotide
  Target: ATXN1; (-) strand; PAM type: NRG; PAM sequence: AGG
aataacttctacttattttg

SEQ ID NO: 74817 - DNA, 20 bp, Artificial Sequence
  Description of Artificial Sequence: Synthetic oligonucleotide
  Target: ATXN1; (-) strand; PAM type: NRG; PAM sequence: GAG
aaataacttctacttatttt

SEQ ID NO: 74818 - DNA, 20 bp, Artificial Sequence
  Description of Artificial Sequence: Synthetic oligonucleotide
  Target: ATXN1; (-) strand; PAM type: NRG; PAM sequence: AGG
cccttgcttttttatgggaa

SEQ ID NO: 74819 - DNA, 20 bp, Artificial Sequence
  Description of Artificial Sequence: Synthetic oligonucleotide
  Target: ATXN1; (-) strand; PAM type: NRG; PAM sequence: AAG
acccttgcttttttatggga

SEQ ID NO: 74820 - DNA, 20 bp, Artificial Sequence
  Description of Artificial Sequence: Synthetic oligonucleotide
  Target: ATXN1; (-) strand; PAM type: NRG; PAM sequence: GGG
tggaacccttgcttttttat

SEQ ID NO: 74821 - DNA, 20 bp, Artificial Sequence
  Description of Artificial Sequence: Synthetic oligonucleotide
  Target: ATXN1; (-) strand; PAM type: NRG; PAM sequence: TGG
atggaacccttgctttttta

SEQ ID NO: 74822 - DNA, 20 bp, Artificial Sequence
  Description of Artificial Sequence: Synthetic oligonucleotide
  Target: ATXN1; (-) strand; PAM type: NRG; PAM sequence: TGG
tactgtctcttttataaaaa

SEQ ID NO: 74823 - DNA, 20 bp, Artificial Sequence
  Description of Artificial Sequence: Synthetic oligonucleotide
  Target: ATXN1; (-) strand; PAM type: NRG; PAM sequence: TAG
catacacatgtctattcatg

SEQ ID NO: 74824 - DNA, 20 bp, Artificial Sequence
  Description of Artificial Sequence: Synthetic oligonucleotide
  Target: ATXN1; (-) strand; PAM type: NRG; PAM sequence: TGG
ggtgggggtgtatacatatc

SEQ ID NO: 74825 - DNA, 20 bp, Artificial Sequence
  Description of Artificial Sequence: Synthetic oligonucleotide
  Target: ATXN1; (-) strand; PAM type: NRG; PAM sequence: GGG
agtccccaagatagtggtgg

SEQ ID NO: 74826 - DNA, 20 bp, Artificial Sequence
  Description of Artificial Sequence: Synthetic oligonucleotide
  Target: ATXN1; (-) strand; PAM type: NRG; PAM sequence: GGG
aagtccccaagatagtggtg

SEQ ID NO: 74827 - DNA, 20 bp, Artificial Sequence
  Description of Artificial Sequence: Synthetic oligonucleotide
  Target: ATXN1; (-) strand; PAM type: NRG; PAM sequence: GGG
aaagtccccaagatagtggt

SEQ ID NO: 74828 - DNA, 20 bp, Artificial Sequence
  Description of Artificial Sequence: Synthetic oligonucleotide
  Target: ATXN1; (-) strand; PAM type: NRG; PAM sequence: TGG
taaagtccccaagatagtgg

SEQ ID NO: 74829 - DNA, 20 bp, Artificial Sequence
  Description of Artificial Sequence: Synthetic oligonucleotide
  Target: ATXN1; (-) strand; PAM type: NRG; PAM sequence: TGG
ttgtaaagtccccaagatag

SEQ ID NO: 74830 - DNA, 20 bp, Artificial Sequence
  Description of Artificial Sequence: Synthetic oligonucleotide
  Target: ATXN1; (-) strand; PAM type: NRG; PAM sequence: TAG
gagttgtaaagtccccaaga

SEQ ID NO: 74831 - DNA, 20 bp, Artificial Sequence
  Description of Artificial Sequence: Synthetic oligonucleotide
  Target: ATXN1; (-) strand; PAM type: NRG; PAM sequence: AAG
cattgagttgtaaagtcccc

SEQ ID NO: 74832 - DNA, 20 bp, Artificial Sequence
  Description of Artificial Sequence: Synthetic oligonucleotide
  Target: ATXN1; (-) strand; PAM type: NRG; PAM sequence: AAG
ataattatcattgagttgta

SEQ ID NO: 74833 - DNA, 20 bp, Artificial Sequence
  Description of Artificial Sequence: Synthetic oligonucleotide
  Target: ATXN1; (-) strand; PAM type: NRG; PAM sequence: GAG
aaaggaaaataattatcatt

SEQ ID NO: 74834 - DNA, 20 bp, Artificial Sequence
  Description of Artificial Sequence: Synthetic oligonucleotide
  Target: ATXN1; (-) strand; PAM type: NRG; PAM sequence: AGG
aacatctccaaaagctttaa

SEQ ID NO: 74835 - DNA, 20 bp, Artificial Sequence
  Description of Artificial Sequence: Synthetic oligonucleotide
  Target: ATXN1; (-) strand; PAM type: NRG; PAM sequence: AAG
aaacatctccaaaagcttta

SEQ ID NO: 74836 - DNA, 20 bp, Artificial Sequence
  Description of Artificial Sequence: Synthetic oligonucleotide
  Target: ATXN1; (-) strand; PAM type: NRG; PAM sequence: AAG
gtacaggtaaacatctccaa

SEQ ID NO: 74837 - DNA, 20 bp, Artificial Sequence
  Description of Artificial Sequence: Synthetic oligonucleotide
  Target: ATXN1; (-) strand; PAM type: NRG; PAM sequence: AGG
gtgatgaaagcacatggtac

SEQ ID NO: 74838 - DNA, 20 bp, Artificial Sequence
  Description of Artificial Sequence: Synthetic oligonucleotide
  Target: ATXN1; (-) strand; PAM type: NRG; PAM sequence: CAG
tgtgatgaaagcacatggta

SEQ ID NO: 74839 - DNA, 20 bp, Artificial Sequence
  Description of Artificial Sequence: Synthetic oligonucleotide
  Target: ATXN1; (-) strand; PAM type: NRG; PAM sequence: TGG
tccattgtgatgaaagcaca

SEQ ID NO: 74840 - DNA, 20 bp, Artificial Sequence
  Description of Artificial Sequence: Synthetic oligonucleotide
  Target: ATXN1; (-) strand; PAM type: NRG; PAM sequence: AAG
atggttctccattgtgatga

SEQ ID NO: 74841 - DNA, 20 bp, Artificial Sequence
  Description of Artificial Sequence: Synthetic oligonucleotide
  Target: ATXN1; (-) strand; PAM type: NRG; PAM sequence: TGG
tgcaaggaactgatagctta

SEQ ID NO: 74842 - DNA, 20 bp, Artificial Sequence
  Description of Artificial Sequence: Synthetic oligonucleotide
  Target: ATXN1; (-) strand; PAM type: NRG; PAM sequence: TAG
gatctgctgcaaggaactga

SEQ ID NO: 74843 - DNA, 20 bp, Artificial Sequence
  Description of Artificial Sequence: Synthetic oligonucleotide
  Target: ATXN1; (-) strand; PAM type: NRG; PAM sequence: AGG
tcgtgaaaagatctgctgca

SEQ ID NO: 74844 - DNA, 20 bp, Artificial Sequence
  Description of Artificial Sequence: Synthetic oligonucleotide
  Target: ATXN1; (-) strand; PAM type: NRG; PAM sequence: AAG
ttcgtgaaaagatctgctgc

SEQ ID NO: 74845 - DNA, 20 bp, Artificial Sequence
  Description of Artificial Sequence: Synthetic oligonucleotide
  Target: ATXN1; (-) strand; PAM type: NRG; PAM sequence: AAG
tcaagcaaaatcttcgtgaa

SEQ ID NO: 74846 - DNA, 20 bp, Artificial Sequence
  Description of Artificial Sequence: Synthetic oligonucleotide
  Target: ATXN1; (-) strand; PAM type: NRG; PAM sequence: AAG
cactgccaccctttctactc

SEQ ID NO: 74847 - DNA, 20 bp, Artificial Sequence
  Description of Artificial Sequence: Synthetic oligonucleotide
  Target: ATXN1; (-) strand; PAM type: NRG; PAM sequence: GAG
aggtctaggcgttttacact

SEQ ID NO: 74848 - DNA, 20 bp, Artificial Sequence
  Description of Artificial Sequence: Synthetic oligonucleotide
  Target: ATXN1; (-) strand; PAM type: NRG; PAM sequence: AGG
gtttttataattacaggtct

SEQ ID NO: 74849 - DNA, 20 bp, Artificial Sequence
  Description of Artificial Sequence: Synthetic oligonucleotide
  Target: ATXN1; (-) strand; PAM type: NRG; PAM sequence: TAG
tgtttttataattacaggtc

SEQ ID NO: 74850 - DNA, 20 bp, Artificial Sequence
  Description of Artificial Sequence: Synthetic oligonucleotide
  Target: ATXN1; (-) strand; PAM type: NRG; PAM sequence: AGG
aatattgtttttataattac

SEQ ID NO: 74851 - DNA, 20 bp, Artificial Sequence
  Description of Artificial Sequence: Synthetic oligonucleotide
  Target: ATXN1; (-) strand; PAM type: NRG; PAM sequence: CAG
gaatattgtttttataatta

SEQ ID NO: 74852 - DNA, 20 bp, Artificial Sequence
  Description of Artificial Sequence: Synthetic oligonucleotide
  Target: ATXN1; (-) strand; PAM type: NRG; PAM sequence: GAG
cagaagcagcctaactcagt

SEQ ID NO: 74853 - DNA, 20 bp, Artificial Sequence
  Description of Artificial Sequence: Synthetic oligonucleotide
  Target: ATXN1; (-) strand; PAM type: NRG; PAM sequence: CAG
accacagaagcagcctaact

SEQ ID NO: 74854 - DNA, 20 bp, Artificial Sequence
  Description of Artificial Sequence: Synthetic oligonucleotide
  Target: ATXN1; (-) strand; PAM type: NRG; PAM sequence: CAG
gtgaatgaagaccacagaag

SEQ ID NO: 74855 - DNA, 20 bp, Artificial Sequence
  Description of Artificial Sequence: Synthetic oligonucleotide
  Target: ATXN1; (-) strand; PAM type: NRG; PAM sequence: AAG
aatgtgaatgaagaccacag

SEQ ID NO: 74856 - DNA, 20 bp, Artificial Sequence
  Description of Artificial Sequence: Synthetic oligonucleotide
  Target: ATXN1; (-) strand; PAM type: NRG; PAM sequence: CAG
gcgaatgtgaatgaagacca

SEQ ID NO: 74857 - DNA, 20 bp, Artificial Sequence
  Description of Artificial Sequence: Synthetic oligonucleotide
  Target: ATXN1; (-) strand; PAM type: NRG; PAM sequence: AAG
gacttcagcgaatgtgaatg

SEQ ID NO: 74858 - DNA, 20 bp, Artificial Sequence
  Description of Artificial Sequence: Synthetic oligonucleotide
  Target: ATXN1; (-) strand; PAM type: NRG; PAM sequence: CAG
gtttcccgtttctgtgactt

SEQ ID NO: 74859 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgcatgtgtgtgtga

SEQ ID NO: 74860 - DNA, 20 bp, Artificial Sequence
  Description of Artificial Sequence: Synthetic oligonucleotide
  Target: ATXN1; (-) strand; PAM type: NRG; PAM sequence: GAG
gcgtgtgtgcatgtgtgtgt

SEQ ID NO: 74861 - DNA, 20 bp, Artificial Sequence
  Description of Artificial Sequence: Synthetic oligonucleotide
  Target: ATXN1; (-) strand; PAM type: NRG; PAM sequence: GAG
ctgctgtgtctctgcctgct

SEQ ID NO: 74862 - DNA, 20 bp, Artificial Sequence
  Description of Artificial Sequence: Synthetic oligonucleotide
  Target: ATXN1; (-) strand; PAM type: NRG; PAM sequence: GGG
cccactcatccctggggata

SEQ ID NO: 74863 - DNA, 20 bp, Artificial Sequence
  Description of Artificial Sequence: Synthetic oligonucleotide
  Target: ATXN1; (-) strand; PAM type: NRG; PAM sequence: AGG
acccactcatccctggggat

SEQ ID NO: 74864 - DNA, 20 bp, Artificial Sequence
  Description of Artificial Sequence: Synthetic oligonucleotide
  Target: ATXN1; (-) strand; PAM type: NRG; PAM sequence: TAG
aacccactcatccctgggga

SEQ ID NO: 74865 - DNA, 20 bp, Artificial Sequence
  Description of Artificial Sequence: Synthetic oligonucleotide
  Target: ATXN1; (-) strand; PAM type: NRG; PAM sequence: GGG
ccagaacccactcatccctg

SEQ ID NO: 74866 - DNA, 20 bp, Artificial Sequence
  Description of Artificial Sequence: Synthetic oligonucleotide
  Target: ATXN1; (-) strand; PAM type: NRG; PAM sequence: GGG
gccagaacccactcatccct

SEQ ID NO: 74867 - DNA, 20 bp, Artificial Sequence
  Description of Artificial Sequence: Synthetic oligonucleotide
  Target: ATXN1; (-) strand; PAM type: NRG; PAM sequence: TGG
ggccagaacccactcatccc

SEQ ID NO: 74868 - DNA, 20 bp, Artificial Sequence
  Description of Artificial Sequence: Synthetic oligonucleotide
  Target: ATXN1; (-) strand; PAM type: NRG; PAM sequence: CAG
ggtgggaagcaacccctggc

SEQ ID NO: 74869 - DNA, 20 bp, Artificial Sequence
  Description of Artificial Sequence: Synthetic oligonucleotide
  Target: ATXN1; (-) strand; PAM type: NRG; PAM sequence: TGG
atggggtgggaagcaacccc

SEQ ID NO: 74870 - DNA, 20 bp, Artificial Sequence
  Description of Artificial Sequence: Synthetic oligonucleotide
  Target: ATXN1; (-) strand; PAM type: NRG; PAM sequence: AAG
aggggaggagatggggtggg

SEQ ID NO: 74871 - DNA, 20 bp, Artificial Sequence
  Description of Artificial Sequence: Synthetic oligonucleotide
  Target: ATXN1; (-) strand; PAM type: NRG; PAM sequence: GGG
tcaaggggaggagatggggt

SEQ ID NO: 74872 - DNA, 20 bp, Artificial Sequence
  Description of Artificial Sequence: Synthetic oligonucleotide
  Target: ATXN1; (-) strand; PAM type: NRG; PAM sequence: TGG
ctcaaggggaggagatgggg

SEQ ID NO: 74873 - DNA, 20 bp, Artificial Sequence
  Description of Artificial Sequence: Synthetic oligonucleotide
  Target: ATXN1; (-) strand; PAM type: NRG; PAM sequence: GGG
gtcctcaaggggaggagatg

SEQ ID NO: 74874 - DNA, 20 bp, Artificial Sequence
  Description of Artificial Sequence: Synthetic oligonucleotide
  Target: ATXN1; (-) strand; PAM type: NRG; PAM sequence: GGG
tgtcctcaaggggaggagat

SEQ ID NO: 74875 - DNA, 20 bp, Artificial Sequence
  Description of Artificial Sequence: Synthetic oligonucleotide
  Target: ATXN1; (-) strand; PAM type: NRG; PAM sequence: TGG
gtgtcctcaaggggaggaga

SEQ ID NO: 74876 - DNA, 20 bp, Artificial Sequence
  Description of Artificial Sequence: Synthetic oligonucleotide
  Target: ATXN1; (-) strand; PAM type: NRG; PAM sequence: GAG
agtggtgtcctcaaggggag

SEQ ID NO: 74877 - DNA, 20 bp, Artificial Sequence
  Description of Artificial Sequence: Synthetic oligonucleotide
  Target: ATXN1; (-) strand; PAM type: NRG; PAM sequence: AGG
atagtggtgtcctcaagggg

SEQ ID NO: 74878 - DNA, 20 bp, Artificial Sequence
  Description of Artificial Sequence: Synthetic oligonucleotide
  Target: ATXN1; (-) strand; PAM type: NRG; PAM sequence: GAG
gatagtggtgtcctcaaggg

SEQ ID NO: 74879 - DNA, 20 bp, Artificial Sequence
  Description of Artificial Sequence: Synthetic oligonucleotide
  Target: ATXN1; (-) strand; PAM type: NRG; PAM sequence: GGG
ttgatagtggtgtcctcaag

SEQ ID NO: 74880 - DNA, 20 bp, Artificial Sequence
  Description of Artificial Sequence: Synthetic oligonucleotide
  Target: ATXN1; (-) strand; PAM type: NRG; PAM sequence: GGG
tttgatagtggtgtcctcaa

SEQ ID NO: 74881 - DNA, 20 bp, Artificial Sequence
  Description of Artificial Sequence: Synthetic oligonucleotide
  Target: ATXN1; (-) strand; PAM type: NRG; PAM sequence: AGG
ttttgatagtggtgtcctca

SEQ ID NO: 74882 - DNA, 20 bp, Artificial Sequence
  Description of Artificial Sequence: Synthetic oligonucleotide
  Target: ATXN1; (-) strand; PAM type: NRG; PAM sequence: AAG
attttgatagtggtgtcctc

SEQ ID NO: 74883 - DNA, 20 bp, Artificial Sequence
  Description of Artificial Sequence: Synthetic oligonucleotide
  Target: ATXN1; (-) strand; PAM type: NRG; PAM sequence: TGG
gaacgggattattttgatag

SEQ ID NO: 74884 - DNA, 20 bp, Artificial Sequence
  Description of Artificial Sequence: Synthetic oligonucleotide
  Target: ATXN1; (-) strand; PAM type: NRG; PAM sequence: TAG
caggaacgggattattttga

SEQ ID NO: 74885 - DNA, 20 bp, Artificial Sequence
  Description of Artificial Sequence: Synthetic oligonucleotide
  Target: ATXN1; (-) strand; PAM type: NRG; PAM sequence: GGG
agggaaggaggggcaggaac

SEQ ID NO: 74886 - DNA, 20 bp, Artificial Sequence
  Description of Artificial Sequence: Synthetic oligonucleotide
  Target: ATXN1; (-) strand; PAM type: NRG; PAM sequence: CGG
cagggaaggaggggcaggaa

SEQ ID NO: 74887 - DNA, 20 bp, Artificial Sequence
  Description of Artificial Sequence: Synthetic oligonucleotide
  Target: ATXN1; (-) strand; PAM type: NRG; PAM sequence: AGG
ttgagcagggaaggaggggc

SEQ ID NO: 74888 - DNA, 20 bp, Artificial Sequence
  Description of Artificial Sequence: Synthetic oligonucleotide
  Target: ATXN1; (-) strand; PAM type: NRG; PAM sequence: CAG
attgagcagggaaggagggg

SEQ ID NO: 74889 - DNA, 20 bp, Artificial Sequence
  Description of Artificial Sequence: Synthetic oligonucleotide
  Target: ATXN1; (-) strand; PAM type: NRG; PAM sequence: GGG
atcattgagcagggaaggag

SEQ ID NO: 74890 - DNA, 20 bp, Artificial Sequence
  Description of Artificial Sequence: Synthetic oligonucleotide
  Target: ATXN1; (-) strand; PAM type: NRG; PAM sequence: GGG
aatcattgagcagggaagga

SEQ ID NO: 74891 - DNA, 20 bp, Artificial Sequence
  Description of Artificial Sequence: Synthetic oligonucleotide
  Target: ATXN1; (-) strand; PAM type: NRG; PAM sequence: AGG
gaatcattgagcagggaagg

SEQ ID NO: 74892 - DNA, 20 bp, Artificial Sequence
  Description of Artificial Sequence: Synthetic oligonucleotide
  Target: ATXN1; (-) strand; PAM type: NRG; PAM sequence: GAG
agaatcattgagcagggaag

SEQ ID NO: 74893 - DNA, 20 bp, Artificial Sequence
  Description of Artificial Sequence: Synthetic oligonucleotide
  Target: ATXN1; (-) strand; PAM type: NRG; PAM sequence: AGG
ttagaatcattgagcaggga

SEQ ID NO: 74894 - DNA, 20 bp, Artificial Sequence
  Description of Artificial Sequence: Synthetic oligonucleotide
  Target: ATXN1; (-) strand; PAM type: NRG; PAM sequence: AAG
cttagaatcattgagcaggg

SEQ ID NO: 74895 - DNA, 20 bp, Artificial Sequence
  Description of Artificial Sequence: Synthetic oligonucleotide
  Target: ATXN1; (-) strand; PAM type: NRG; PAM sequence: GGG
aatcttagaatcattgagca

SEQ ID NO: 74896 - DNA, 20 bp, Artificial Sequence
  Description of Artificial Sequence: Synthetic oligonucleotide
  Target: ATXN1; (-) strand; PAM type: NRG; PAM sequence: AGG
aaatcttagaatcattgagc

SEQ ID NO: 74897 - DNA, 20 bp, Artificial Sequence
  Description of Artificial Sequence: Synthetic oligonucleotide
  Target: ATXN1; (-) strand; PAM type: NRG; PAM sequence: CAG
gaaatcttagaatcattgag

SEQ ID NO: 74898 - DNA, 20 bp, Artificial Sequence
  Description of Artificial Sequence: Synthetic oligonucleotide
  Target: ATXN1; (-) strand; PAM type: NRG; PAM sequence: GAG
ttagaaatcttagaatcatt

SEQ ID NO: 74899 - DNA, 20 bp, Artificial Sequence
  Description of Artificial Sequence: Synthetic oligonucleotide
  Target: ATXN1; (-) strand; PAM type: NRG; PAM sequence: TAG
ttgttatttcttagaaatct

SEQ ID NO: 74900 - DNA, 20 bp, Artificial Sequence
  Description of Artificial Sequence: Synthetic oligonucleotide
  Target: ATXN1; (-) strand; PAM type: NRG; PAM sequence: TAG
actgactgcttgttatttct

SEQ ID NO: 74901 - DNA, 20 bp, Artificial Sequence
  Description of Artificial Sequence: Synthetic oligonucleotide
  Target: ATXN1; (-) strand; PAM type: NRG; PAM sequence: AAG
tgtttctgacattttctatg

SEQ ID NO: 74902 - DNA, 20 bp, Artificial Sequence
  Description of Artificial Sequence: Synthetic oligonucleotide
  Target: ATXN1; (-) strand; PAM type: NRG; PAM sequence: CAG
gagaaagagagcatcaaatt

SEQ ID NO: 74903 - DNA, 20 bp, Artificial Sequence
  Description of Artificial Sequence: Synthetic oligonucleotide
  Target: ATXN1; (-) strand; PAM type: NRG; PAM sequence: GAG
gaaggagtcttagagaaaga

SEQ ID NO: 74904 - DNA, 20 bp, Artificial Sequence
  Description of Artificial Sequence: Synthetic oligonucleotide
  Target: ATXN1; (-) strand; PAM type: NRG; PAM sequence: GAG
tagaaggagtcttagagaaa

SEQ ID NO: 74905 - DNA, 20 bp, Artificial Sequence
  Description of Artificial Sequence: Synthetic oligonucleotide
  Target: ATXN1; (-) strand; PAM type: NRG; PAM sequence: AAG
gctagaaggagtcttagaga

SEQ ID NO: 74906 - DNA, 20 bp, Artificial Sequence
  Description of Artificial Sequence: Synthetic oligonucleotide
  Target: ATXN1; (-) strand; PAM type: NRG; PAM sequence: GAG
tgtggctagaaggagtctta

SEQ ID NO: 74907 - DNA, 20 bp, Artificial Sequence
  Description of Artificial Sequence: Synthetic oligonucleotide
  Target: ATXN1; (-) strand; PAM type: NRG; PAM sequence: TAG
tttgtggctagaaggagtct

SEQ ID NO: 74908 - DNA, 20 bp, Artificial Sequence
  Description of Artificial Sequence: Synthetic oligonucleotide
  Target: ATXN1; (-) strand; PAM type: NRG; PAM sequence: GAG
cataattttgtggctagaag

SEQ ID NO: 74909 - DNA, 20 bp, Artificial Sequence
  Description of Artificial Sequence: Synthetic oligonucleotide
  Target: ATXN1; (-) strand; PAM type: NRG; PAM sequence: AGG
tgcataattttgtggctaga

SEQ ID NO: 74910 - DNA, 20 bp, Artificial Sequence
  Description of Artificial Sequence: Synthetic oligonucleotide
  Target: ATXN1; (-) strand; PAM type: NRG; PAM sequence: AAG
ttgcataattttgtggctag

SEQ ID NO: 74911 - DNA, 20 bp, Artificial Sequence
  Description of Artificial Sequence: Synthetic oligonucleotide
  Target: ATXN1; (-) strand; PAM type: NRG; PAM sequence: TAG
aatttgcataattttgtggc

SEQ ID NO: 74912 - DNA, 20 bp, Artificial Sequence
  Description of Artificial Sequence: Synthetic oligonucleotide
  Target: ATXN1; (-) strand; PAM type: NRG; PAM sequence: TGG
actgaatttgcataattttg

SEQ ID NO: 74913 - DNA, 20 bp, Artificial Sequence
  Description of Artificial Sequence: Synthetic oligonucleotide
  Target: ATXN1; (-) strand; PAM type: NRG; PAM sequence: TGG
aagtgaaagtgaggccggaa

SEQ ID NO: 74914 - DNA, 20 bp, Artificial Sequence
  Description of Artificial Sequence: Synthetic oligonucleotide
  Target: ATXN1; (-) strand; PAM type: NRG; PAM sequence: CGG
ttcaaaagtgaaagtgaggc

SEQ ID NO: 74915 - DNA, 20 bp, Artificial Sequence
  Description of Artificial Sequence: Synthetic oligonucleotide
  Target: ATXN1; (-) strand; PAM type: NRG; PAM sequence: AGG
tagtttcaaaagtgaaagtg

SEQ ID NO: 74916 - DNA, 20 bp, Artificial Sequence
  Description of Artificial Sequence: Synthetic oligonucleotide
  Target: ATXN1; (-) strand; PAM type: NRG; PAM sequence: GAG
gtagtttcaaaagtgaaagt

SEQ ID NO: 74917 - DNA, 20 bp, Artificial Sequence
  Description of Artificial Sequence: Synthetic oligonucleotide
  Target: ATXN1; (-) strand; PAM type: NRG; PAM sequence: AAG
atgtgtagtttcaaaagtga

SEQ ID NO: 74918 - DNA, 20 bp, Artificial Sequence
  Description of Artificial Sequence: Synthetic oligonucleotide
  Target: ATXN1; (-) strand; PAM type: NRG; PAM sequence: AAG
agaggcatgtgtagtttcaa

SEQ ID NO: 74919 - DNA, 20 bp, Artificial Sequence
  Description of Artificial Sequence: Synthetic oligonucleotide
  Target: ATXN1; (-) strand; PAM type: NRG; PAM sequence: TAG
tattaacaaagaggcatgtg

SEQ ID NO: 74920 - DNA, 20 bp, Artificial Sequence
  Description of Artificial Sequence: Synthetic oligonucleotide
  Target: ATXN1; (-) strand; PAM type: NRG; PAM sequence: AGG
taactgagttattaacaaag

SEQ ID NO: 74921 - DNA, 20 bp, Artificial Sequence
  Description of Artificial Sequence: Synthetic oligonucleotide
  Target: ATXN1; (-) strand; PAM type: NRG; PAM sequence: GAG
ttaactgagttattaacaaa

SEQ ID NO: 74922 - DNA, 20 bp, Artificial Sequence
  Description of Artificial Sequence: Synthetic oligonucleotide
  Target: ATXN1; (-) strand; PAM type: NRG; PAM sequence: AAG
tcttaactgagttattaaca

SEQ ID NO: 74923 - DNA, 20 bp, Artificial Sequence
  Description of Artificial Sequence: Synthetic oligonucleotide
  Target: ATXN1; (-) strand; PAM type: NRG; PAM sequence: GAG
actgacatcatgtcttaact

SEQ ID NO: 74924 - DNA, 20 bp, Artificial Sequence
  Description of Artificial Sequence: Synthetic oligonucleotide
  Target: ATXN1; (-) strand; PAM type: NRG; PAM sequence: TGG
atcaatgttcgtgatgacct

SEQ ID NO: 74925 - DNA, 20 bp, Artificial Sequence
  Description of Artificial Sequence: Synthetic oligonucleotide
  Target: ATXN1; (-) strand; PAM type: NRG; PAM sequence: TAG
ttagcacatggcccagaaca

SEQ ID NO: 74926 - DNA, 20 bp, Artificial Sequence
  Description of Artificial Sequence: Synthetic oligonucleotide
  Target: ATXN1; (-) strand; PAM type: NRG; PAM sequence: CAG
aaagcccttagcacatggcc

SEQ ID NO: 74927 - DNA, 20 bp, Artificial Sequence
  Description of Artificial Sequence: Synthetic oligonucleotide
  Target: ATXN1; (-) strand; PAM type: NRG; PAM sequence: TGG
tgtgtaaagcccttagcaca

SEQ ID NO: 74928 - DNA, 20 bp, Artificial Sequence
  Description of Artificial Sequence: Synthetic oligonucleotide
  Target: ATXN1; (-) strand; PAM type: NRG; PAM sequence: TAG
ggcaatgtgtgtaaagccct

SEQ ID NO: 74929 - DNA, 20 bp, Artificial Sequence
  Description of Artificial Sequence: Synthetic oligonucleotide
  Target: ATXN1; (-) strand; PAM type: NRG; PAM sequence: AAG
ggagtggggcaatgtgtgta

SEQ ID NO: 74930 - DNA, 20 bp, Artificial Sequence
  Description of Artificial Sequence: Synthetic oligonucleotide
  Target: ATXN1; (-) strand; PAM type: NRG; PAM sequence: GGG
tcacagactgcagtggagtg

SEQ ID NO: 74931 - DNA, 20 bp, Artificial Sequence
  Description of Artificial Sequence: Synthetic oligonucleotide
  Target: ATXN1; (-) strand; PAM type: NRG; PAM sequence: GGG
ctcacagactgcagtggagt

SEQ ID NO: 74932 - DNA, 20 bp, Artificial Sequence
  Description of Artificial Sequence: Synthetic oligonucleotide
  Target: ATXN1; (-) strand; PAM type: NRG; PAM sequence: TGG
cctcacagactgcagtggag

SEQ ID NO: 74933 - DNA, 20 bp, Artificial Sequence
  Description of Artificial Sequence: Synthetic oligonucleotide
  Target: ATXN1; (-) strand; PAM type: NRG; PAM sequence: GAG
ccacctcacagactgcagtg

SEQ ID NO: 74934 - DNA, 20 bp, Artificial Sequence
  Description of Artificial Sequence: Synthetic oligonucleotide
  Target: ATXN1; (-) strand; PAM type: NRG; PAM sequence: TGG
ggccacctcacagactgcag

SEQ ID NO: 74935 - DNA, 20 bp, Artificial Sequence
  Description of Artificial Sequence: Synthetic oligonucleotide
  Target: ATXN1; (-) strand; PAM type: NRG; PAM sequence: CAG
cctggccacctcacagactg

SEQ ID NO: 74936 - DNA, 20 bp, Artificial Sequence
  Description of Artificial Sequence: Synthetic oligonucleotide
  Target: ATXN1; (-) strand; PAM type: NRG; PAM sequence: CAG
catgattcctggccacctca

SEQ ID NO: 74937 - DNA, 20 bp, Artificial Sequence
  Description of Artificial Sequence: Synthetic oligonucleotide
  Target: ATXN1; (-) strand; PAM type: NRG; PAM sequence: TGG
gcagaggtaaacatgattcc

SEQ ID NO: 74938 - DNA, 20 bp, Artificial Sequence
  Description of Artificial Sequence: Synthetic oligonucleotide
  Target: ATXN1; (-) strand; PAM type: NRG; PAM sequence: AGG
ttttcttgtcaataatgcag

SEQ ID NO: 74939 - DNA, 20 bp, Artificial Sequence
  Description of Artificial Sequence: Synthetic oligonucleotide
  Target: ATXN1; (-) strand; PAM type: NRG; PAM sequence: GAG
gttttcttgtcaataatgca

SEQ ID NO: 74940 - DNA, 20 bp, Artificial Sequence
  Description of Artificial Sequence: Synthetic oligonucleotide
  Target: ATXN1; (-) strand; PAM type: NRG; PAM sequence: CAG
cagttttcttgtcaataatg

SEQ ID NO: 74941 - DNA, 20 bp, Artificial Sequence
  Description of Artificial Sequence: Synthetic oligonucleotide
  Target: ATXN1; (-) strand; PAM type: NRG; PAM sequence: CAG
ccgttggctgtatttactgt

SEQ ID NO: 74942 - DNA, 20 bp, Artificial Sequence
  Description of Artificial Sequence: Synthetic oligonucleotide
  Target: ATXN1; (-) strand; PAM type: NRG; PAM sequence: TGG
gtactggctttaacatccgt

SEQ ID NO: 74943 - DNA, 20 bp, Artificial Sequence
  Description of Artificial Sequence: Synthetic oligonucleotide
  Target: ATXN1; (-) strand; PAM type: NRG; PAM sequence: TGG
tgaactgttggcttaagtac

SEQ ID NO: 74944 - DNA, 20 bp, Artificial Sequence
  Description of Artificial Sequence: Synthetic oligonucleotide
  Target: ATXN1; (-) strand; PAM type: NRG; PAM sequence: AAG
cctctgtgaactgttggctt

SEQ ID NO: 74945 - DNA, 20 bp, Artificial Sequence
  Description of Artificial Sequence: Synthetic oligonucleotide
  Target: ATXN1; (-) strand; PAM type: NRG; PAM sequence: TGG
gcatgacctctgtgaactgt

SEQ ID NO: 74946 - DNA, 20 bp, Artificial Sequence
  Description of Artificial Sequence: Synthetic oligonucleotide
  Target: ATXN1; (-) strand; PAM type: NRG; PAM sequence: AAG
tggtatagtactagaatcct

SEQ ID NO: 74947 - DNA, 20 bp, Artificial Sequence
  Description of Artificial Sequence: Synthetic oligonucleotide
  Target: ATXN1; (-) strand; PAM type: NRG; PAM sequence: TAG
ttgaagagatggtatagtac

SEQ ID NO: 74948 - DNA, 20 bp, Artificial Sequence
  Description of Artificial Sequence: Synthetic oligonucleotide
  Target: ATXN1; (-) strand; PAM type: NRG; PAM sequence: TAG
tcagccttgaagagatggta

SEQ ID NO: 74949 - DNA, 20 bp, Artificial Sequence
  Description of Artificial Sequence: Synthetic oligonucleotide
  Target: ATXN1; (-) strand; PAM type: NRG; PAM sequence: TGG
aaagatcagccttgaagaga

SEQ ID NO: 74950 - DNA, 20 bp, Artificial Sequence
  Description of Artificial Sequence: Synthetic oligonucleotide
  Target: ATXN1; (-) strand; PAM type: NRG; PAM sequence: GAG
gtagaaagatcagccttgaa

SEQ ID NO: 74951 - DNA, 20 bp, Artificial Sequence
  Description of Artificial Sequence: Synthetic oligonucleotide
  Target: ATXN1; (-) strand; PAM type: NRG; PAM sequence: AAG
tggtagaaagatcagccttg

SEQ ID NO: 74952 - DNA, 20 bp, Artificial Sequence
  Description of Artificial Sequence: Synthetic oligonucleotide
  Target: ATXN1; (-) strand; PAM type: NRG; PAM sequence: CAG
agaagtgttggtagaaagat

SEQ ID NO: 74953 - DNA, 20 bp, Artificial Sequence
  Description of Artificial Sequence: Synthetic oligonucleotide
  Target: ATXN1; (-) strand; PAM type: NRG; PAM sequence: AAG
actacagaagtgttggtaga

SEQ ID NO: 74954 - DNA, 20 bp, Artificial Sequence
  Description of Artificial Sequence: Synthetic oligonucleotide
  Target: ATXN1; (-) strand; PAM type: NRG; PAM sequence: TAG
actaactacagaagtgttgg

SEQ ID NO: 74955 - DNA, 20 bp, Artificial Sequence
  Description of Artificial Sequence: Synthetic oligonucleotide
  Target: ATXN1; (-) strand; PAM type: NRG; PAM sequence: TGG
aatactaactacagaagtgt

SEQ ID NO: 74956 - DNA, 20 bp, Artificial Sequence
  Description of Artificial Sequence: Synthetic oligonucleotide
  Target: ATXN1; (-) strand; PAM type: NRG; PAM sequence: AAG
tgttttaatactaactacag

SEQ ID NO: 74957 - DNA, 20 bp, Artificial Sequence
  Description of Artificial Sequence: Synthetic oligonucleotide
  Target: ATXN1; (-) strand; PAM type: NRG; PAM sequence: CAG
atatgttttaatactaacta

SEQ ID NO: 74958 - DNA, 20 bp, Artificial Sequence
  Description of Artificial Sequence: Synthetic oligonucleotide
  Target: ATXN1; (-) strand; PAM type: NRG; PAM sequence: CAG
aggcatgagccaccatgccc

SEQ ID NO: 74959 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 74960 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 74961 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 74962 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 74963 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaaagtgc

SEQ ID NO: 74964 - DNA, 20 bp, Artificial Sequence
  Description of Artificial Sequence: Synthetic oligonucleotide
  Target: ATXN1; (-) strand; PAM type: NRG; PAM sequence: AAG
ccgcccacctcagcctccca

SEQ ID NO: 74965 - DNA, 20 bp, Artificial Sequence
  Description of Artificial Sequence: Synthetic oligonucleotide
  Target: ATXN1; (-) strand; PAM type: NRG; PAM sequence: CAG
acctcatgatccgcccacct

SEQ ID NO: 74966 - DNA, 20 bp, Artificial Sequence
  Description of Artificial Sequence: Synthetic oligonucleotide
  Target: ATXN1; (-) strand; PAM type: NRG; PAM sequence: TGG
ttacaccatgttggccagga

SEQ ID NO: 74967 - DNA, 20 bp, Artificial Sequence
  Description of Artificial Sequence: Synthetic oligonucleotide
  Target: ATXN1; (-) strand; PAM type: NRG; PAM sequence: AGG
ggggttacaccatgttggcc

SEQ ID NO: 74968 - DNA, 20 bp, Artificial Sequence
  Description of Artificial Sequence: Synthetic oligonucleotide
  Target: ATXN1; (-) strand; PAM type: NRG; PAM sequence: CAG
tggggttacaccatgttggc

SEQ ID NO: 74969 - DNA, 20 bp, Artificial Sequence
  Description of Artificial Sequence: Synthetic oligonucleotide
  Target: ATXN1; (-) strand; PAM type: NRG; PAM sequence: TGG
gagatggggttacaccatgt

SEQ ID NO: 74970 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 74971 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 74972 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 74973 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 74974 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 74975 - DNA, 20 bp, Artificial Sequence
  Description of Artificial Sequence: Synthetic oligonucleotide
  Target: ATXN1; (-) strand; PAM type: NRG; PAM sequence: TAG
gtggctaatttttgtatttt

SEQ ID NO: 74976 - DNA, 20 bp, Artificial Sequence
  Description of Artificial Sequence: Synthetic oligonucleotide
  Target: ATXN1; (-) strand; PAM type: NRG; PAM sequence: TGG
cgggcacgcaccaccatgcg

SEQ ID NO: 74977 - DNA, 20 bp, Artificial Sequence
  Description of Artificial Sequence: Synthetic oligonucleotide
  Target: ATXN1; (-) strand; PAM type: NRG; PAM sequence: GGG
tcctgagtagctgggattac

SEQ ID NO: 74978 - DNA, 20 bp, Artificial Sequence
  Description of Artificial Sequence: Synthetic oligonucleotide
  Target: ATXN1; (-) strand; PAM type: NRG; PAM sequence: CGG
ttcctgagtagctgggatta

SEQ ID NO: 74979 - DNA, 20 bp, Artificial Sequence
  Description of Artificial Sequence: Synthetic oligonucleotide
  Target: ATXN1; (-) strand; PAM type: NRG; PAM sequence: GGG
cctcagcttcctgagtagct

SEQ ID NO: 74980 - DNA, 20 bp, Artificial Sequence
  Description of Artificial Sequence: Synthetic oligonucleotide
  Target: ATXN1; (-) strand; PAM type: NRG; PAM sequence: TGG
gcctcagcttcctgagtagc

SEQ ID NO: 74981 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcttcctgag

SEQ ID NO: 74982 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcttcct

SEQ ID NO: 74983 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 74984 - DNA, 20 bp, Artificial Sequence
  Description of Artificial Sequence: Synthetic oligonucleotide
  Target: ATXN1; (-) strand; PAM type: NRG; PAM sequence: AAG
caaactctgccttccggttc

SEQ ID NO: 74985 - DNA, 20 bp, Artificial Sequence
  Description of Artificial Sequence: Synthetic oligonucleotide
  Target: ATXN1; (-) strand; PAM type: NRG; PAM sequence: CGG
tcactgcaaactctgccttc

SEQ ID NO: 74986 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcatgatct

SEQ ID NO: 74987 - DNA, 20 bp, Artificial Sequence
  Description of Artificial Sequence: Synthetic oligonucleotide
  Target: ATXN1; (-) strand; PAM type: NRG; PAM sequence: TGG
gtcaccaggctggagtgcag

SEQ ID NO: 74988 - DNA, 20 bp, Artificial Sequence
  Description of Artificial Sequence: Synthetic oligonucleotide
  Target: ATXN1; (-) strand; PAM type: NRG; PAM sequence: CAG
tttgtcaccaggctggagtg

SEQ ID NO: 74989 - DNA, 20 bp, Artificial Sequence
  Description of Artificial Sequence: Synthetic oligonucleotide
  Target: ATXN1; (-) strand; PAM type: NRG; PAM sequence: GAG
cttgctttgtcaccaggctg

SEQ ID NO: 74990 - DNA, 20 bp, Artificial Sequence
  Description of Artificial Sequence: Synthetic oligonucleotide
  Target: ATXN1; (-) strand; PAM type: NRG; PAM sequence: TGG
gtcttgctttgtcaccaggc

SEQ ID NO: 74991 - DNA, 20 bp, Artificial Sequence
  Description of Artificial Sequence: Synthetic oligonucleotide
  Target: ATXN1; (-) strand; PAM type: NRG; PAM sequence: AGG
cagagtcttgctttgtcacc

SEQ ID NO: 74992 - DNA, 20 bp, Artificial Sequence
  Description of Artificial Sequence: Synthetic oligonucleotide
  Target: ATXN1; (-) strand; PAM type: NRG; PAM sequence: CAG
acagagtcttgctttgtcac

SEQ ID NO: 74993 - DNA, 20 bp, Artificial Sequence
  Description of Artificial Sequence: Synthetic oligonucleotide
  Target: ATXN1; (-) strand; PAM type: NRG; PAM sequence: GAG
ctttttttttttttgagaca

SEQ ID NO: 74994 - DNA, 20 bp, Artificial Sequence
  Description of Artificial Sequence: Synthetic oligonucleotide
  Target: ATXN1; (-) strand; PAM type: NRG; PAM sequence: CAG
tactttttttttttttgaga

SEQ ID NO: 74995 - DNA, 20 bp, Artificial Sequence
  Description of Artificial Sequence: Synthetic oligonucleotide
  Target: ATXN1; (-) strand; PAM type: NRG; PAM sequence: GAG
ttgatacttttttttttttt

SEQ ID NO: 74996 - DNA, 20 bp, Artificial Sequence
  Description of Artificial Sequence: Synthetic oligonucleotide
  Target: ATXN1; (-) strand; PAM type: NRG; PAM sequence: TAG
ctctgggaaaaatgaggtga

SEQ ID NO: 74997 - DNA, 20 bp, Artificial Sequence
  Description of Artificial Sequence: Synthetic oligonucleotide
  Target: ATXN1; (-) strand; PAM type: NRG; PAM sequence: AGG
ataaccctctgggaaaaatg

SEQ ID NO: 74998 - DNA, 20 bp, Artificial Sequence
  Description of Artificial Sequence: Synthetic oligonucleotide
  Target: ATXN1; (-) strand; PAM type: NRG; PAM sequence: GAG
cataaccctctgggaaaaat

SEQ ID NO: 74999 - DNA, 20 bp, Artificial Sequence
  Description of Artificial Sequence: Synthetic oligonucleotide
  Target: ATXN1; (-) strand; PAM type: NRG; PAM sequence: GGG
actaggtgacataaccctct

SEQ ID NO: 75000 - DNA, 20 bp, Artificial Sequence
  Description of Artificial Sequence: Synthetic oligonucleotide
  Target: ATXN1; (-) strand; PAM type: NRG; PAM sequence: TGG
gactaggtgacataaccctc

SEQ ID NO: 75001 - DNA, 20 bp, Artificial Sequence
  Description of Artificial Sequence: Synthetic oligonucleotide
  Target: ATXN1; (-) strand; PAM type: NRG; PAM sequence: AGG
ataatagtaattttaagact

SEQ ID NO: 75002 - DNA, 20 bp, Artificial Sequence
  Description of Artificial Sequence: Synthetic oligonucleotide
  Target: ATXN1; (-) strand; PAM type: NRG; PAM sequence: TAG
aataatagtaattttaagac

SEQ ID NO: 75003 - DNA, 20 bp, Artificial Sequence
  Description of Artificial Sequence: Synthetic oligonucleotide
  Target: ATXN1; (-) strand; PAM type: NRG; PAM sequence: AAG
aaacaaataatagtaatttt

SEQ ID NO: 75004 - DNA, 20 bp, Artificial Sequence
  Description of Artificial Sequence: Synthetic oligonucleotide
  Target: ATXN1; (-) strand; PAM type: NRG; PAM sequence: TAG
gtcaaatccaaaacaaataa

SEQ ID NO: 75005 - DNA, 20 bp, Artificial Sequence
  Description of Artificial Sequence: Synthetic oligonucleotide
  Target: ATXN1; (-) strand; PAM type: NRG; PAM sequence: CAG
tgggaattaaaatcaaagta

SEQ ID NO: 75006 - DNA, 20 bp, Artificial Sequence
  Description of Artificial Sequence: Synthetic oligonucleotide
  Target: ATXN1; (-) strand; PAM type: NRG; PAM sequence: AAG
gagcttgggaattaaaatca

SEQ ID NO: 75007 - DNA, 20 bp, Artificial Sequence
  Description of Artificial Sequence: Synthetic oligonucleotide
  Target: ATXN1; (-) strand; PAM type: NRG; PAM sequence: GGG
tgtcggtttcacttgagctt

SEQ ID NO: 75008 - DNA, 20 bp, Artificial Sequence
  Description of Artificial Sequence: Synthetic oligonucleotide
  Target: ATXN1; (-) strand; PAM type: NRG; PAM sequence: TGG
atgtcggtttcacttgagct

SEQ ID NO: 75009 - DNA, 20 bp, Artificial Sequence
  Description of Artificial Sequence: Synthetic oligonucleotide
  Target: ATXN1; (-) strand; PAM type: NRG; PAM sequence: GAG
tgaacatgtcggtttcactt

SEQ ID NO: 75010 - DNA, 20 bp, Artificial Sequence
  Description of Artificial Sequence: Synthetic oligonucleotide
  Target: ATXN1; (-) strand; PAM type: NRG; PAM sequence: CGG
cagttgaaatatgaacatgt

SEQ ID NO: 75011 - DNA, 20 bp, Artificial Sequence
  Description of Artificial Sequence: Synthetic oligonucleotide
  Target: ATXN1; (-) strand; PAM type: NRG; PAM sequence: CAG
aataaccaccaacttacact

SEQ ID NO: 75012 - DNA, 20 bp, Artificial Sequence
  Description of Artificial Sequence: Synthetic oligonucleotide
  Target: ATXN1; (-) strand; PAM type: NRG; PAM sequence: TAG
catctggatttgggattact

SEQ ID NO: 75013 - DNA, 20 bp, Artificial Sequence
  Description of Artificial Sequence: Synthetic oligonucleotide
  Target: ATXN1; (-) strand; PAM type: NRG; PAM sequence: GGG
gtgttttggcatctggattt

SEQ ID NO: 75014 - DNA, 20 bp, Artificial Sequence
  Description of Artificial Sequence: Synthetic oligonucleotide
  Target: ATXN1; (-) strand; PAM type: NRG; PAM sequence: TGG
agtgttttggcatctggatt

SEQ ID NO: 75015 - DNA, 20 bp, Artificial Sequence
  Description of Artificial Sequence: Synthetic oligonucleotide
  Target: ATXN1; (-) strand; PAM type: NRG; PAM sequence: TGG
ctgcttagtgttttggcatc

SEQ ID NO: 75016 - DNA, 20 bp, Artificial Sequence
  Description of Artificial Sequence: Synthetic oligonucleotide
  Target: ATXN1; (-) strand; PAM type: NRG; PAM sequence: TGG
taggtttctgcttagtgttt

SEQ ID NO: 75017 - DNA, 20 bp, Artificial Sequence
  Description of Artificial Sequence: Synthetic oligonucleotide
  Target: ATXN1; (-) strand; PAM type: NRG; PAM sequence: TAG
gtggattttaggtttctgct

SEQ ID NO: 75018 - DNA, 20 bp, Artificial Sequence
  Description of Artificial Sequence: Synthetic oligonucleotide
  Target: ATXN1; (-) strand; PAM type: NRG; PAM sequence: AGG
ttaggcaggacgtggatttt

SEQ ID NO: 75019 - DNA, 20 bp, Artificial Sequence
  Description of Artificial Sequence: Synthetic oligonucleotide
  Target: ATXN1; (-) strand; PAM type: NRG; PAM sequence: TAG
cttaggcaggacgtggattt

SEQ ID NO: 75020 - DNA, 20 bp, Artificial Sequence
  Description of Artificial Sequence: Synthetic oligonucleotide
  Target: ATXN1; (-) strand; PAM type: NRG; PAM sequence: TGG
ttagccgcttaggcaggacg

SEQ ID NO: 75021 - DNA, 20 bp, Artificial Sequence
  Description of Artificial Sequence: Synthetic oligonucleotide
  Target: ATXN1; (-) strand; PAM type: NRG; PAM sequence: AGG
tgaaatttagccgcttaggc

SEQ ID NO: 75022 - DNA, 20 bp, Artificial Sequence
  Description of Artificial Sequence: Synthetic oligonucleotide
  Target: ATXN1; (-) strand; PAM type: NRG; PAM sequence: CAG
atgaaatttagccgcttagg

SEQ ID NO: 75023 - DNA, 20 bp, Artificial Sequence
  Description of Artificial Sequence: Synthetic oligonucleotide
  Target: ATXN1; (-) strand; PAM type: NRG; PAM sequence: AGG
ctaatgaaatttagccgctt

SEQ ID NO: 75024 - DNA, 20 bp, Artificial Sequence
  Description of Artificial Sequence: Synthetic oligonucleotide
  Target: ATXN1; (-) strand; PAM type: NRG; PAM sequence: TAG
tctaatgaaatttagccgct

SEQ ID NO: 75025 - DNA, 20 bp, Artificial Sequence
  Description of Artificial Sequence: Synthetic oligonucleotide
  Target: ATXN1; (-) strand; PAM type: NRG; PAM sequence: TAG
gacttgtttctaatgaaatt

SEQ ID NO: 75026 - DNA, 20 bp, Artificial Sequence
  Description of Artificial Sequence: Synthetic oligonucleotide
  Target: ATXN1; (-) strand; PAM type: NRG; PAM sequence: TGG
tcattttcatatctttactt

SEQ ID NO: 75027 - DNA, 20 bp, Artificial Sequence
  Description of Artificial Sequence: Synthetic oligonucleotide
  Target: ATXN1; (-) strand; PAM type: NRG; PAM sequence: TAG
tttttaagacatggctgtat

SEQ ID NO: 75028 - DNA, 20 bp, Artificial Sequence
  Description of Artificial Sequence: Synthetic oligonucleotide
  Target: ATXN1; (-) strand; PAM type: NRG; PAM sequence: TGG
tttaagaattttttaagaca

SEQ ID NO: 75029 - DNA, 20 bp, Artificial Sequence
  Description of Artificial Sequence: Synthetic oligonucleotide
  Target: ATXN1; (-) strand; PAM type: NRG; PAM sequence: AAG
aacatgtttaagaatttttt

SEQ ID NO: 75030 - DNA, 20 bp, Artificial Sequence
  Description of Artificial Sequence: Synthetic oligonucleotide
  Target: ATXN1; (-) strand; PAM type: NRG; PAM sequence: AAG
gtgaacaggtaaacatgttt

SEQ ID NO: 75031 - DNA, 20 bp, Artificial Sequence
  Description of Artificial Sequence: Synthetic oligonucleotide
  Target: ATXN1; (-) strand; PAM type: NRG; PAM sequence: AGG
agtatgtagactttgtgaac

SEQ ID NO: 75032 - DNA, 20 bp, Artificial Sequence
  Description of Artificial Sequence: Synthetic oligonucleotide
  Target: ATXN1; (-) strand; PAM type: NRG; PAM sequence: CAG
tagtatgtagactttgtgaa

SEQ ID NO: 75033 - DNA, 20 bp, Artificial Sequence
  Description of Artificial Sequence: Synthetic oligonucleotide
  Target: ATXN1; (-) strand; PAM type: NRG; PAM sequence: TAG
ctaagatctgtattagtatg

SEQ ID NO: 75034 - DNA, 20 bp, Artificial Sequence
  Description of Artificial Sequence: Synthetic oligonucleotide
  Target: ATXN1; (-) strand; PAM type: NRG; PAM sequence: TAG
agtgattctaagatctgtat

SEQ ID NO: 75035 - DNA, 20 bp, Artificial Sequence
  Description of Artificial Sequence: Synthetic oligonucleotide
  Target: ATXN1; (-) strand; PAM type: NRG; PAM sequence: AAG
ttttgtgttgcagtgattct

SEQ ID NO: 75036 - DNA, 20 bp, Artificial Sequence
  Description of Artificial Sequence: Synthetic oligonucleotide
  Target: ATXN1; (-) strand; PAM type: NRG; PAM sequence: CAG
ctcatatccattttgtgttg

SEQ ID NO: 75037 - DNA, 20 bp, Artificial Sequence
  Description of Artificial Sequence: Synthetic oligonucleotide
  Target: ATXN1; (-) strand; PAM type: NRG; PAM sequence: GGG
tacaaaaggagagttattgt

SEQ ID NO: 75038 - DNA, 20 bp, Artificial Sequence
  Description of Artificial Sequence: Synthetic oligonucleotide
  Target: ATXN1; (-) strand; PAM type: NRG; PAM sequence: TGG
atacaaaaggagagttattg

SEQ ID NO: 75039 - DNA, 20 bp, Artificial Sequence
  Description of Artificial Sequence: Synthetic oligonucleotide
  Target: ATXN1; (-) strand; PAM type: NRG; PAM sequence: GAG
cctacacatatacaaaagga

SEQ ID NO: 75040 - DNA, 20 bp, Artificial Sequence
  Description of Artificial Sequence: Synthetic oligonucleotide
  Target: ATXN1; (-) strand; PAM type: NRG; PAM sequence: GAG
tgcctacacatatacaaaag

SEQ ID NO: 75041 - DNA, 20 bp, Artificial Sequence
  Description of Artificial Sequence: Synthetic oligonucleotide
  Target: ATXN1; (-) strand; PAM type: NRG; PAM sequence: AGG
aatgcctacacatatacaaa

SEQ ID NO: 75042 - DNA, 20 bp, Artificial Sequence
  Description of Artificial Sequence: Synthetic oligonucleotide
  Target: ATXN1; (-) strand; PAM type: NRG; PAM sequence: AAG
aaatgcctacacatatacaa

SEQ ID NO: 75043 - DNA, 20 bp, Artificial Sequence
  Description of Artificial Sequence: Synthetic oligonucleotide
  Target: ATXN1; (-) strand; PAM type: NRG; PAM sequence: TAG
aggcagaggcataacaaaaa

SEQ ID NO: 75044 - DNA, 20 bp, Artificial Sequence
  Description of Artificial Sequence: Synthetic oligonucleotide
  Target: ATXN1; (-) strand; PAM type: NRG; PAM sequence: AGG
agtgtcatatgcaaaggcag

SEQ ID NO: 75045 - DNA, 20 bp, Artificial Sequence
  Description of Artificial Sequence: Synthetic oligonucleotide
  Target: ATXN1; (-) strand; PAM type: NRG; PAM sequence: GAG
gagtgtcatatgcaaaggca

SEQ ID NO: 75046 - DNA, 20 bp, Artificial Sequence
  Description of Artificial Sequence: Synthetic oligonucleotide
  Target: ATXN1; (-) strand; PAM type: NRG; PAM sequence: CAG
gggagtgtcatatgcaaagg

SEQ ID NO: 75047 - DNA, 20 bp, Artificial Sequence
  Description of Artificial Sequence: Synthetic oligonucleotide
  Target: ATXN1; (-) strand; PAM type: NRG; PAM sequence: AGG
aaagggagtgtcatatgcaa

SEQ ID NO: 75048 - DNA, 20 bp, Artificial Sequence
  Description of Artificial Sequence: Synthetic oligonucleotide
  Target: ATXN1; (-) strand; PAM type: NRG; PAM sequence: AAG
caaagggagtgtcatatgca

SEQ ID NO: 75049 - DNA, 20 bp, Artificial Sequence
  Description of Artificial Sequence: Synthetic oligonucleotide
  Target: ATXN1; (-) strand; PAM type: NRG; PAM sequence: GAG
caaagcatgttaatcaaagg

SEQ ID NO: 75050 - DNA, 20 bp, Artificial Sequence
  Description of Artificial Sequence: Synthetic oligonucleotide
  Target: ATXN1; (-) strand; PAM type: NRG; PAM sequence: GGG
ggcaaagcatgttaatcaaa

SEQ ID NO: 75051 - DNA, 20 bp, Artificial Sequence
  Description of Artificial Sequence: Synthetic oligonucleotide
  Target: ATXN1; (-) strand; PAM type: NRG; PAM sequence: AGG
aggcaaagcatgttaatcaa

SEQ ID NO: 75052 - DNA, 20 bp, Artificial Sequence
  Description of Artificial Sequence: Synthetic oligonucleotide
  Target: ATXN1; (-) strand; PAM type: NRG; PAM sequence: AAG
gaggcaaagcatgttaatca

SEQ ID NO: 75053 - DNA, 20 bp, Artificial Sequence
  Description of Artificial Sequence: Synthetic oligonucleotide
  Target: ATXN1; (-) strand; PAM type: NRG; PAM sequence: AAG
ctaaatggcaaggagaggca

SEQ ID NO: 75054 - DNA, 20 bp, Artificial Sequence
  Description of Artificial Sequence: Synthetic oligonucleotide
  Target: ATXN1; (-) strand; PAM type: NRG; PAM sequence: AGG
attttctaaatggcaaggag

SEQ ID NO: 75055 - DNA, 20 bp, Artificial Sequence
  Description of Artificial Sequence: Synthetic oligonucleotide
  Target: ATXN1; (-) strand; PAM type: NRG; PAM sequence: GAG
aattttctaaatggcaagga

SEQ ID NO: 75056 - DNA, 20 bp, Artificial Sequence
  Description of Artificial Sequence: Synthetic oligonucleotide
  Target: ATXN1; (-) strand; PAM type: NRG; PAM sequence: GAG
ggaattttctaaatggcaag

SEQ ID NO: 75057 - DNA, 20 bp, Artificial Sequence
  Description of Artificial Sequence: Synthetic oligonucleotide
  Target: ATXN1; (-) strand; PAM type: NRG; PAM sequence: AGG
taggaattttctaaatggca

SEQ ID NO: 75058 - DNA, 20 bp, Artificial Sequence
  Description of Artificial Sequence: Synthetic oligonucleotide
  Target: ATXN1; (-) strand; PAM type: NRG; PAM sequence: AAG
gtaggaattttctaaatggc

SEQ ID NO: 75059 - DNA, 20 bp, Artificial Sequence
  Description of Artificial Sequence: Synthetic oligonucleotide
  Target: ATXN1; (-) strand; PAM type: NRG; PAM sequence: TGG
atgagtaggaattttctaaa

SEQ ID NO: 75060 - DNA, 20 bp, Artificial Sequence
  Description of Artificial Sequence: Synthetic oligonucleotide
  Target: ATXN1; (-) strand; PAM type: NRG; PAM sequence: AGG
tgtccagctgaaaaatgagt

SEQ ID NO: 75061 - DNA, 20 bp, Artificial Sequence
  Description of Artificial Sequence: Synthetic oligonucleotide
  Target: ATXN1; (-) strand; PAM type: NRG; PAM sequence: TAG
gtgtccagctgaaaaatgag

SEQ ID NO: 75062 - DNA, 20 bp, Artificial Sequence
  Description of Artificial Sequence: Synthetic oligonucleotide
  Target: ATXN1; (-) strand; PAM type: NRG; PAM sequence: GAG
actgtgtccagctgaaaaat

SEQ ID NO: 75063 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccactgtgtc

SEQ ID NO: 75064 - DNA, 20 bp, Artificial Sequence
  Description of Artificial Sequence: Synthetic oligonucleotide
  Target: ATXN1; (-) strand; PAM type: NRG; PAM sequence: GAG
agtgctggatttacaggcat

SEQ ID NO: 75065 - DNA, 20 bp, Artificial Sequence
  Description of Artificial Sequence: Synthetic oligonucleotide
  Target: ATXN1; (-) strand; PAM type: NRG; PAM sequence: AGG
ccccaaagtgctggatttac

SEQ ID NO: 75066 - DNA, 20 bp, Artificial Sequence
  Description of Artificial Sequence: Synthetic oligonucleotide
  Target: ATXN1; (-) strand; PAM type: NRG; PAM sequence: CAG
cccccaaagtgctggattta

SEQ ID NO: 75067 - DNA, 20 bp, Artificial Sequence
  Description of Artificial Sequence: Synthetic oligonucleotide
  Target: ATXN1; (-) strand; PAM type: NRG; PAM sequence: TGG
gccttggccccccaaagtgc

SEQ ID NO: 75068 - DNA, 20 bp, Artificial Sequence
  Description of Artificial Sequence: Synthetic oligonucleotide
  Target: ATXN1; (-) strand; PAM type: NRG; PAM sequence: AAG
cctcccgccttggcccccca

SEQ ID NO: 75069 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgatcctcccgcct

SEQ ID NO: 75070 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacctc

SEQ ID NO: 75071 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgacct

SEQ ID NO: 75072 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 75073 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 75074 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggc

SEQ ID NO: 75075 - DNA, 20 bp, Artificial Sequence
  Description of Artificial Sequence: Synthetic oligonucleotide
  Target: ATXN1; (-) strand; PAM type: NRG; PAM sequence: TGG
tagatggggtttcaccatgt

SEQ ID NO: 75076 - DNA, 20 bp, Artificial Sequence
  Description of Artificial Sequence: Synthetic oligonucleotide
  Target: ATXN1; (-) strand; PAM type: NRG; PAM sequence: GGG
ttttttttttagtatagatg

SEQ ID NO: 75077 - DNA, 20 bp, Artificial Sequence
  Description of Artificial Sequence: Synthetic oligonucleotide
  Target: ATXN1; (-) strand; PAM type: NRG; PAM sequence: GGG
tttttttttttagtatagat

SEQ ID NO: 75078 - DNA, 20 bp, Artificial Sequence
  Description of Artificial Sequence: Synthetic oligonucleotide
  Target: ATXN1; (-) strand; PAM type: NRG; PAM sequence: TGG
gtttttttttttagtataga

SEQ ID NO: 75079 - DNA, 20 bp, Artificial Sequence
  Description of Artificial Sequence: Synthetic oligonucleotide
  Target: ATXN1; (-) strand; PAM type: NRG; PAM sequence: TAG
gctagtttttttttttagta

SEQ ID NO: 75080 - DNA, 20 bp, Artificial Sequence
  Description of Artificial Sequence: Synthetic oligonucleotide
  Target: ATXN1; (-) strand; PAM type: NRG; PAM sequence: TAG
gcctggctagtttttttttt

SEQ ID NO: 75081 - DNA, 20 bp, Artificial Sequence
  Description of Artificial Sequence: Synthetic oligonucleotide
  Target: ATXN1; (-) strand; PAM type: NRG; PAM sequence: TAG
cgcccaccaccatgcctggc

SEQ ID NO: 75082 - DNA, 20 bp, Artificial Sequence
  Description of Artificial Sequence: Synthetic oligonucleotide
  Target: ATXN1; (-) strand; PAM type: NRG; PAM sequence: TGG
caggcgcccaccaccatgcc

SEQ ID NO: 75083 - DNA, 20 bp, Artificial Sequence
  Description of Artificial Sequence: Synthetic oligonucleotide
  Target: ATXN1; (-) strand; PAM type: NRG; PAM sequence: AGG
tcccgggtcactgggattac

SEQ ID NO: 75084 - DNA, 20 bp, Artificial Sequence
  Description of Artificial Sequence: Synthetic oligonucleotide
  Target: ATXN1; (-) strand; PAM type: NRG; PAM sequence: CAG
ctcccgggtcactgggatta

SEQ ID NO: 75085 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgggtcact

SEQ ID NO: 75086 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgggtcac

SEQ ID NO: 75087 - DNA, 20 bp, Artificial Sequence
  Description of Artificial Sequence: Synthetic oligonucleotide
  Target: ATXN1; (-) strand; PAM type: NRG; PAM sequence: GGG
ttctcctgcctcagcctccc

SEQ ID NO: 75088 - DNA, 20 bp, Artificial Sequence
  Description of Artificial Sequence: Synthetic oligonucleotide
  Target: ATXN1; (-) strand; PAM type: NRG; PAM sequence: CGG
attctcctgcctcagcctcc

SEQ ID NO: 75089 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcct

SEQ ID NO: 75090 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccaggttc

SEQ ID NO: 75091 - DNA, 20 bp, Artificial Sequence
  Description of Artificial Sequence: Synthetic oligonucleotide
  Target: ATXN1; (-) strand; PAM type: NRG; PAM sequence: AGG
tactgcaacctctgcctccc

SEQ ID NO: 75092 - DNA, 20 bp, Artificial Sequence
  Description of Artificial Sequence: Synthetic oligonucleotide
  Target: ATXN1; (-) strand; PAM type: NRG; PAM sequence: CAG
ttactgcaacctctgcctcc

SEQ ID NO: 75093 - DNA, 20 bp, Artificial Sequence
  Description of Artificial Sequence: Synthetic oligonucleotide
  Target: ATXN1; (-) strand; PAM type: NRG; PAM sequence: CAG
gtagtgcaatggcacgatct

SEQ ID NO: 75094 - DNA, 20 bp, Artificial Sequence
  Description of Artificial Sequence: Synthetic oligonucleotide
  Target: ATXN1; (-) strand; PAM type: NRG; PAM sequence: TGG
atgcccaggctgtagtgcaa

SEQ ID NO: 75095 - DNA, 20 bp, Artificial Sequence
  Description of Artificial Sequence: Synthetic oligonucleotide
  Target: ATXN1; (-) strand; PAM type: NRG; PAM sequence: TAG
cgctgttgatgcccaggctg

SEQ ID NO: 75096 - DNA, 20 bp, Artificial Sequence
  Description of Artificial Sequence: Synthetic oligonucleotide
  Target: ATXN1; (-) strand; PAM type: NRG; PAM sequence: AGG
gagttccgctgttgatgccc

SEQ ID NO: 75097 - DNA, 20 bp, Artificial Sequence
  Description of Artificial Sequence: Synthetic oligonucleotide
  Target: ATXN1; (-) strand; PAM type: NRG; PAM sequence: CAG
agagttccgctgttgatgcc

SEQ ID NO: 75098 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttagaca

SEQ ID NO: 75099 - DNA, 20 bp, Artificial Sequence
  Description of Artificial Sequence: Synthetic oligonucleotide
  Target: ATXN1; (-) strand; PAM type: NRG; PAM sequence: CAG
tctttttttttttttttaga

SEQ ID NO: 75100 - DNA, 20 bp, Artificial Sequence
  Description of Artificial Sequence: Synthetic oligonucleotide
  Target: ATXN1; (-) strand; PAM type: NRG; PAM sequence: TAG
attttctttttttttttttt

SEQ ID NO: 75101 - DNA, 20 bp, Artificial Sequence
  Description of Artificial Sequence: Synthetic oligonucleotide
  Target: ATXN1; (-) strand; PAM type: NRG; PAM sequence: AGG
gttggccttgaaaaatgagt

SEQ ID NO: 75102 - DNA, 20 bp, Artificial Sequence
  Description of Artificial Sequence: Synthetic oligonucleotide
  Target: ATXN1; (-) strand; PAM type: NRG; PAM sequence: TAG
ggttggccttgaaaaatgag

SEQ ID NO: 75103 - DNA, 20 bp, Artificial Sequence
  Description of Artificial Sequence: Synthetic oligonucleotide
  Target: ATXN1; (-) strand; PAM type: NRG; PAM sequence: GAG
caaggttggccttgaaaaat

SEQ ID NO: 75104 - DNA, 20 bp, Artificial Sequence
  Description of Artificial Sequence: Synthetic oligonucleotide
  Target: ATXN1; (-) strand; PAM type: NRG; PAM sequence: TGG
aagctatttaagctcaaggt

SEQ ID NO: 75105 - DNA, 20 bp, Artificial Sequence
  Description of Artificial Sequence: Synthetic oligonucleotide
  Target: ATXN1; (-) strand; PAM type: NRG; PAM sequence: AGG
atttaagctatttaagctca

SEQ ID NO: 75106 - DNA, 20 bp, Artificial Sequence
  Description of Artificial Sequence: Synthetic oligonucleotide
  Target: ATXN1; (-) strand; PAM type: NRG; PAM sequence: AAG
aatttaagctatttaagctc

SEQ ID NO: 75107 - DNA, 20 bp, Artificial Sequence
  Description of Artificial Sequence: Synthetic oligonucleotide
  Target: ATXN1; (-) strand; PAM type: NRG; PAM sequence: AAG
caatggaatttaagctattt

SEQ ID NO: 75108 - DNA, 20 bp, Artificial Sequence
  Description of Artificial Sequence: Synthetic oligonucleotide
  Target: ATXN1; (-) strand; PAM type: NRG; PAM sequence: AAG
atgacatcacaatggaattt

SEQ ID NO: 75109 - DNA, 20 bp, Artificial Sequence
  Description of Artificial Sequence: Synthetic oligonucleotide
  Target: ATXN1; (-) strand; PAM type: NRG; PAM sequence: TGG
agatgaggatgacatcacaa

SEQ ID NO: 75110 - DNA, 20 bp, Artificial Sequence
  Description of Artificial Sequence: Synthetic oligonucleotide
  Target: ATXN1; (-) strand; PAM type: NRG; PAM sequence: AGG
aaaacattaggggatagatg

SEQ ID NO: 75111 - DNA, 20 bp, Artificial Sequence
  Description of Artificial Sequence: Synthetic oligonucleotide
  Target: ATXN1; (-) strand; PAM type: NRG; PAM sequence: GAG
gaaaacattaggggatagat

SEQ ID NO: 75112 - DNA, 20 bp, Artificial Sequence
  Description of Artificial Sequence: Synthetic oligonucleotide
  Target: ATXN1; (-) strand; PAM type: NRG; PAM sequence: TAG
ttccagaaaacattagggga

SEQ ID NO: 75113 - DNA, 20 bp, Artificial Sequence
  Description of Artificial Sequence: Synthetic oligonucleotide
  Target: ATXN1; (-) strand; PAM type: NRG; PAM sequence: GGG
agatttccagaaaacattag

SEQ ID NO: 75114 - DNA, 20 bp, Artificial Sequence
  Description of Artificial Sequence: Synthetic oligonucleotide
  Target: ATXN1; (-) strand; PAM type: NRG; PAM sequence: GGG
tagatttccagaaaacatta

SEQ ID NO: 75115 - DNA, 20 bp, Artificial Sequence
  Description of Artificial Sequence: Synthetic oligonucleotide
  Target: ATXN1; (-) strand; PAM type: NRG; PAM sequence: AGG
ttagatttccagaaaacatt

SEQ ID NO: 75116 - DNA, 20 bp, Artificial Sequence
  Description of Artificial Sequence: Synthetic oligonucleotide
  Target: ATXN1; (-) strand; PAM type: NRG; PAM sequence: TAG
cttagatttccagaaaacat

SEQ ID NO: 75117 - DNA, 20 bp, Artificial Sequence
  Description of Artificial Sequence: Synthetic oligonucleotide
  Target: ATXN1; (-) strand; PAM type: NRG; PAM sequence: CAG
atctattctgcttagatttc

SEQ ID NO: 75118 - DNA, 20 bp, Artificial Sequence
  Description of Artificial Sequence: Synthetic oligonucleotide
  Target: ATXN1; (-) strand; PAM type: NRG; PAM sequence: TAG
gaggcagaatctattctgct

SEQ ID NO: 75119 - DNA, 20 bp, Artificial Sequence
  Description of Artificial Sequence: Synthetic oligonucleotide
  Target: ATXN1; (-) strand; PAM type: NRG; PAM sequence: CAG
gctaggaaacgtaggtgagg

SEQ ID NO: 75120 - DNA, 20 bp, Artificial Sequence
  Description of Artificial Sequence: Synthetic oligonucleotide
  Target: ATXN1; (-) strand; PAM type: NRG; PAM sequence: AGG
tgagctaggaaacgtaggtg

SEQ ID NO: 75121 - DNA, 20 bp, Artificial Sequence
  Description of Artificial Sequence: Synthetic oligonucleotide
  Target: ATXN1; (-) strand; PAM type: NRG; PAM sequence: GAG
ctgagctaggaaacgtaggt

SEQ ID NO: 75122 - DNA, 20 bp, Artificial Sequence
  Description of Artificial Sequence: Synthetic oligonucleotide
  Target: ATXN1; (-) strand; PAM type: NRG; PAM sequence: AGG
atcactgagctaggaaacgt

SEQ ID NO: 75123 - DNA, 20 bp, Artificial Sequence
  Description of Artificial Sequence: Synthetic oligonucleotide
  Target: ATXN1; (-) strand; PAM type: NRG; PAM sequence: TAG
catcactgagctaggaaacg

SEQ ID NO: 75124 - DNA, 20 bp, Artificial Sequence
  Description of Artificial Sequence: Synthetic oligonucleotide
  Target: ATXN1; (-) strand; PAM type: NRG; PAM sequence: AGG
gttgatgccatcactgagct

SEQ ID NO: 75125 - DNA, 20 bp, Artificial Sequence
  Description of Artificial Sequence: Synthetic oligonucleotide
  Target: ATXN1; (-) strand; PAM type: NRG; PAM sequence: TAG
tgttgatgccatcactgagc

SEQ ID NO: 75126 - DNA, 20 bp, Artificial Sequence
  Description of Artificial Sequence: Synthetic oligonucleotide
  Target: ATXN1; (-) strand; PAM type: NRG; PAM sequence: GAG
gtgatgttgatgccatcact

SEQ ID NO: 75127 - DNA, 20 bp, Artificial Sequence
  Description of Artificial Sequence: Synthetic oligonucleotide
  Target: ATXN1; (-) strand; PAM type: NRG; PAM sequence: GAG
tttgggagaggaagacgtca

SEQ ID NO: 75128 - DNA, 20 bp, Artificial Sequence
  Description of Artificial Sequence: Synthetic oligonucleotide
  Target: ATXN1; (-) strand; PAM type: NRG; PAM sequence: CAG
aatttgggagaggaagacgt

SEQ ID NO: 75129 - DNA, 20 bp, Artificial Sequence
  Description of Artificial Sequence: Synthetic oligonucleotide
  Target: ATXN1; (-) strand; PAM type: NRG; PAM sequence: AAG
ggggcataatttgggagagg

SEQ ID NO: 75130 - DNA, 20 bp, Artificial Sequence
  Description of Artificial Sequence: Synthetic oligonucleotide
  Target: ATXN1; (-) strand; PAM type: NRG; PAM sequence: AGG
tatggggcataatttgggag

SEQ ID NO: 75131 - DNA, 20 bp, Artificial Sequence
  Description of Artificial Sequence: Synthetic oligonucleotide
  Target: ATXN1; (-) strand; PAM type: NRG; PAM sequence: GAG
atatggggcataatttggga

SEQ ID NO: 75132 - DNA, 20 bp, Artificial Sequence
  Description of Artificial Sequence: Synthetic oligonucleotide
  Target: ATXN1; (-) strand; PAM type: NRG; PAM sequence: GAG
gaatatggggcataatttgg

SEQ ID NO: 75133 - DNA, 20 bp, Artificial Sequence
  Description of Artificial Sequence: Synthetic oligonucleotide
  Target: ATXN1; (-) strand; PAM type: NRG; PAM sequence: GGG
ttgaatatggggcataattt

SEQ ID NO: 75134 - DNA, 20 bp, Artificial Sequence
  Description of Artificial Sequence: Synthetic oligonucleotide
  Target: ATXN1; (-) strand; PAM type: NRG; PAM sequence: TGG
gttgaatatggggcataatt

SEQ ID NO: 75135 - DNA, 20 bp, Artificial Sequence
  Description of Artificial Sequence: Synthetic oligonucleotide
  Target: ATXN1; (-) strand; PAM type: NRG; PAM sequence: GGG
tggctgcatggttgaatatg

SEQ ID NO: 75136 - DNA, 20 bp, Artificial Sequence
  Description of Artificial Sequence: Synthetic oligonucleotide
  Target: ATXN1; (-) strand; PAM type: NRG; PAM sequence: GGG
atggctgcatggttgaatat

SEQ ID NO: 75137 - DNA, 20 bp, Artificial Sequence
  Description of Artificial Sequence: Synthetic oligonucleotide
  Target: ATXN1; (-) strand; PAM type: NRG; PAM sequence: TGG
tatggctgcatggttgaata

SEQ ID NO: 75138 - DNA, 20 bp, Artificial Sequence
  Description of Artificial Sequence: Synthetic oligonucleotide
  Target: ATXN1; (-) strand; PAM type: NRG; PAM sequence: TGG
agttgaggagtatggctgca

SEQ ID NO: 75139 - DNA, 20 bp, Artificial Sequence
  Description of Artificial Sequence: Synthetic oligonucleotide
  Target: ATXN1; (-) strand; PAM type: NRG; PAM sequence: TGG
gcggagggagttgaggagta

SEQ ID NO: 75140 - DNA, 20 bp, Artificial Sequence
  Description of Artificial Sequence: Synthetic oligonucleotide
  Target: ATXN1; (-) strand; PAM type: NRG; PAM sequence: GAG
gaggagcggagggagttgag

SEQ ID NO: 75141 - DNA, 20 bp, Artificial Sequence
  Description of Artificial Sequence: Synthetic oligonucleotide
  Target: ATXN1; (-) strand; PAM type: NRG; PAM sequence: AGG
gagaggagcggagggagttg

SEQ ID NO: 75142 - DNA, 20 bp, Artificial Sequence
  Description of Artificial Sequence: Synthetic oligonucleotide
  Target: ATXN1; (-) strand; PAM type: NRG; PAM sequence: GAG
ggagaggagcggagggagtt

SEQ ID NO: 75143 - DNA, 20 bp, Artificial Sequence
  Description of Artificial Sequence: Synthetic oligonucleotide
  Target: ATXN1; (-) strand; PAM type: NRG; PAM sequence: GAG
gtgccggagaggagcggagg

SEQ ID NO: 75144 - DNA, 20 bp, Artificial Sequence
  Description of Artificial Sequence: Synthetic oligonucleotide
  Target: ATXN1; (-) strand; PAM type: NRG; PAM sequence: GGG
tggtgccggagaggagcgga

SEQ ID NO: 75145 - DNA, 20 bp, Artificial Sequence
  Description of Artificial Sequence: Synthetic oligonucleotide
  Target: ATXN1; (-) strand; PAM type: NRG; PAM sequence: AGG
gtggtgccggagaggagcgg

SEQ ID NO: 75146 - DNA, 20 bp, Artificial Sequence
  Description of Artificial Sequence: Synthetic oligonucleotide
  Target: ATXN1; (-) strand; PAM type: NRG; PAM sequence: GAG
ggtggtgccggagaggagcg

SEQ ID NO: 75147 - DNA, 20 bp, Artificial Sequence
  Description of Artificial Sequence: Synthetic oligonucleotide
  Target: ATXN1; (-) strand; PAM type: NRG; PAM sequence: CGG
agggtggtgccggagaggag

SEQ ID NO: 75148 - DNA, 20 bp, Artificial Sequence
  Description of Artificial Sequence: Synthetic oligonucleotide
  Target: ATXN1; (-) strand; PAM type: NRG; PAM sequence: GAG
gccagggtggtgccggagag

SEQ ID NO: 75149 - DNA, 20 bp, Artificial Sequence
  Description of Artificial Sequence: Synthetic oligonucleotide
  Target: ATXN1; (-) strand; PAM type: NRG; PAM sequence: AGG
gagccagggtggtgccggag

SEQ ID NO: 75150 - DNA, 20 bp, Artificial Sequence
  Description of Artificial Sequence: Synthetic oligonucleotide
  Target: ATXN1; (-) strand; PAM type: NRG; PAM sequence: GAG
tgagccagggtggtgccgga

SEQ ID NO: 75151 - DNA, 20 bp, Artificial Sequence
  Description of Artificial Sequence: Synthetic oligonucleotide
  Target: ATXN1; (-) strand; PAM type: NRG; PAM sequence: GAG
gatgagccagggtggtgccg

SEQ ID NO: 75152 - DNA, 20 bp, Artificial Sequence
  Description of Artificial Sequence: Synthetic oligonucleotide
  Target: ATXN1; (-) strand; PAM type: NRG; PAM sequence: CGG
cagatgagccagggtggtgc

SEQ ID NO: 75153 - DNA, 20 bp, Artificial Sequence
  Description of Artificial Sequence: Synthetic oligonucleotide
  Target: ATXN1; (-) strand; PAM type: NRG; PAM sequence: TGG
agagtccagatgagccaggg

SEQ ID NO: 75154 - DNA, 20 bp, Artificial Sequence
  Description of Artificial Sequence: Synthetic oligonucleotide
  Target: ATXN1; (-) strand; PAM type: NRG; PAM sequence: GGG
gaaagagtccagatgagcca

SEQ ID NO: 75155 - DNA, 20 bp, Artificial Sequence
  Description of Artificial Sequence: Synthetic oligonucleotide
  Target: ATXN1; (-) strand; PAM type: NRG; PAM sequence: AGG
ggaaagagtccagatgagcc

SEQ ID NO: 75156 - DNA, 20 bp, Artificial Sequence
  Description of Artificial Sequence: Synthetic oligonucleotide
  Target: ATXN1; (-) strand; PAM type: NRG; PAM sequence: CAG
gggaaagagtccagatgagc

SEQ ID NO: 75157 - DNA, 20 bp, Artificial Sequence
  Description of Artificial Sequence: Synthetic oligonucleotide
  Target: ATXN1; (-) strand; PAM type: NRG; PAM sequence: GAG
gccagggaaagagtccagat

SEQ ID NO: 75158 - DNA, 20 bp, Artificial Sequence
  Description of Artificial Sequence: Synthetic oligonucleotide
  Target: ATXN1; (-) strand; PAM type: NRG; PAM sequence: CAG
agggggccagggaaagagtc

SEQ ID NO: 75159 - DNA, 20 bp, Artificial Sequence
  Description of Artificial Sequence: Synthetic oligonucleotide
  Target: ATXN1; (-) strand; PAM type: NRG; PAM sequence: GAG
gtgttagggggccagggaaa

SEQ ID NO: 75160 - DNA, 20 bp, Artificial Sequence
  Description of Artificial Sequence: Synthetic oligonucleotide
  Target: ATXN1; (-) strand; PAM type: NRG; PAM sequence: AAG
acgtgttagggggccaggga

SEQ ID NO: 75161 - DNA, 20 bp, Artificial Sequence
  Description of Artificial Sequence: Synthetic oligonucleotide
  Target: ATXN1; (-) strand; PAM type: NRG; PAM sequence: GGG
ggagacgtgttagggggcca

SEQ ID NO: 75162 - DNA, 20 bp, Artificial Sequence
  Description of Artificial Sequence: Synthetic oligonucleotide
  Target: ATXN1; (-) strand; PAM type: NRG; PAM sequence: AGG
gggagacgtgttagggggcc

SEQ ID NO: 75163 - DNA, 20 bp, Artificial Sequence
  Description of Artificial Sequence: Synthetic oligonucleotide
  Target: ATXN1; (-) strand; PAM type: NRG; PAM sequence: CAG
ggggagacgtgttagggggc

SEQ ID NO: 75164 - DNA, 20 bp, Artificial Sequence
  Description of Artificial Sequence: Synthetic oligonucleotide
  Target: ATXN1; (-) strand; PAM type: NRG; PAM sequence: GGG
acgcggggagacgtgttagg

SEQ ID NO: 75165 - DNA, 20 bp, Artificial Sequence
  Description of Artificial Sequence: Synthetic oligonucleotide
  Target: ATXN1; (-) strand; PAM type: NRG; PAM sequence: GGG
gacgcggggagacgtgttag

SEQ ID NO: 75166 - DNA, 20 bp, Artificial Sequence
  Description of Artificial Sequence: Synthetic oligonucleotide
  Target: ATXN1; (-) strand; PAM type: NRG; PAM sequence: GGG
ggacgcggggagacgtgtta

SEQ ID NO: 75167 - DNA, 20 bp, Artificial Sequence
  Description of Artificial Sequence: Synthetic oligonucleotide
  Target: ATXN1; (-) strand; PAM type: NRG; PAM sequence: AGG
tggacgcggggagacgtgtt

SEQ ID NO: 75168 - DNA, 20 bp, Artificial Sequence
  Description of Artificial Sequence: Synthetic oligonucleotide
  Target: ATXN1; (-) strand; PAM type: NRG; PAM sequence: TAG
gtggacgcggggagacgtgt

SEQ ID NO: 75169 - DNA, 20 bp, Artificial Sequence
  Description of Artificial Sequence: Synthetic oligonucleotide
  Target: ATXN1; (-) strand; PAM type: NRG; PAM sequence: GAG
ggtggcagggtggacgcggg

SEQ ID NO: 75170 - DNA, 20 bp, Artificial Sequence
  Description of Artificial Sequence: Synthetic oligonucleotide
  Target: ATXN1; (-) strand; PAM type: NRG; PAM sequence: GGG
agggtggcagggtggacgcg

SEQ ID NO: 75171 - DNA, 20 bp, Artificial Sequence
  Description of Artificial Sequence: Synthetic oligonucleotide
  Target: ATXN1; (-) strand; PAM type: NRG; PAM sequence: GGG
tagggtggcagggtggacgc

SEQ ID NO: 75172 - DNA, 20 bp, Artificial Sequence
  Description of Artificial Sequence: Synthetic oligonucleotide
  Target: ATXN1; (-) strand; PAM type: NRG; PAM sequence: CGG
gtagggtggcagggtggacg

SEQ ID NO: 75173 - DNA, 20 bp, Artificial Sequence
  Description of Artificial Sequence: Synthetic oligonucleotide
  Target: ATXN1; (-) strand; PAM type: NRG; PAM sequence: TGG
aaggtagtagggtggcaggg

SEQ ID NO: 75174 - DNA, 20 bp, Artificial Sequence
  Description of Artificial Sequence: Synthetic oligonucleotide
  Target: ATXN1; (-) strand; PAM type: NRG; PAM sequence: GGG
aggaaggtagtagggtggca

SEQ ID NO: 75175 - DNA, 20 bp, Artificial Sequence
  Description of Artificial Sequence: Synthetic oligonucleotide
  Target: ATXN1; (-) strand; PAM type: NRG; PAM sequence: AGG
aaggaaggtagtagggtggc

SEQ ID NO: 75176 - DNA, 20 bp, Artificial Sequence
  Description of Artificial Sequence: Synthetic oligonucleotide
  Target: ATXN1; (-) strand; PAM type: NRG; PAM sequence: CAG
caaggaaggtagtagggtgg

SEQ ID NO: 75177 - DNA, 20 bp, Artificial Sequence
  Description of Artificial Sequence: Synthetic oligonucleotide
  Target: ATXN1; (-) strand; PAM type: NRG; PAM sequence: TGG
agccaaggaaggtagtaggg

SEQ ID NO: 75178 - DNA, 20 bp, Artificial Sequence
  Description of Artificial Sequence: Synthetic oligonucleotide
  Target: ATXN1; (-) strand; PAM type: NRG; PAM sequence: GGG
aggagccaaggaaggtagta

SEQ ID NO: 75179 - DNA, 20 bp, Artificial Sequence
  Description of Artificial Sequence: Synthetic oligonucleotide
  Target: ATXN1; (-) strand; PAM type: NRG; PAM sequence: AGG
caggagccaaggaaggtagt

SEQ ID NO: 75180 - DNA, 20 bp, Artificial Sequence
  Description of Artificial Sequence: Synthetic oligonucleotide
  Target: ATXN1; (-) strand; PAM type: NRG; PAM sequence: TAG
gcaggagccaaggaaggtag

SEQ ID NO: 75181 - DNA, 20 bp, Artificial Sequence
  Description of Artificial Sequence: Synthetic oligonucleotide
  Target: ATXN1; (-) strand; PAM type: NRG; PAM sequence: TAG
taggcaggagccaaggaagg

SEQ ID NO: 75182 - DNA, 20 bp, Artificial Sequence
  Description of Artificial Sequence: Synthetic oligonucleotide
  Target: ATXN1; (-) strand; PAM type: NRG; PAM sequence: AGG
ccttaggcaggagccaagga

SEQ ID NO: 75183 - DNA, 20 bp, Artificial Sequence
  Description of Artificial Sequence: Synthetic oligonucleotide
  Target: ATXN1; (-) strand; PAM type: NRG; PAM sequence: AAG
gccttaggcaggagccaagg

SEQ ID NO: 75184 - DNA, 20 bp, Artificial Sequence
  Description of Artificial Sequence: Synthetic oligonucleotide
  Target: ATXN1; (-) strand; PAM type: NRG; PAM sequence: AGG
aatgccttaggcaggagcca

SEQ ID NO: 75185 - DNA, 20 bp, Artificial Sequence
  Description of Artificial Sequence: Synthetic oligonucleotide
  Target: ATXN1; (-) strand; PAM type: NRG; PAM sequence: AAG
caatgccttaggcaggagcc

SEQ ID NO: 75186 - DNA, 20 bp, Artificial Sequence
  Description of Artificial Sequence: Synthetic oligonucleotide
  Target: ATXN1; (-) strand; PAM type: NRG; PAM sequence: GAG
cactgcaatgccttaggcag

SEQ ID NO: 75187 - DNA, 20 bp, Artificial Sequence
  Description of Artificial Sequence: Synthetic oligonucleotide
  Target: ATXN1; (-) strand; PAM type: NRG; PAM sequence: AGG
gccactgcaatgccttaggc

SEQ ID NO: 75188 - DNA, 20 bp, Artificial Sequence
  Description of Artificial Sequence: Synthetic oligonucleotide
  Target: ATXN1; (-) strand; PAM type: NRG; PAM sequence: CAG
agccactgcaatgccttagg

SEQ ID NO: 75189 - DNA, 20 bp, Artificial Sequence
  Description of Artificial Sequence: Synthetic oligonucleotide
  Target: ATXN1; (-) strand; PAM type: NRG; PAM sequence: AGG
gaaagccactgcaatgcctt

SEQ ID NO: 75190 - DNA, 20 bp, Artificial Sequence
  Description of Artificial Sequence: Synthetic oligonucleotide
  Target: ATXN1; (-) strand; PAM type: NRG; PAM sequence: TAG
ggaaagccactgcaatgcct

SEQ ID NO: 75191 - DNA, 20 bp, Artificial Sequence
  Description of Artificial Sequence: Synthetic oligonucleotide
  Target: ATXN1; (-) strand; PAM type: NRG; PAM sequence: AAG
gggccatgtttagaaatgga

SEQ ID NO: 75192 - DNA, 20 bp, Artificial Sequence
  Description of Artificial Sequence: Synthetic oligonucleotide
  Target: ATXN1; (-) strand; PAM type: NRG; PAM sequence: TGG
ttgggggccatgtttagaaa

SEQ ID NO: 75193 - DNA, 20 bp, Artificial Sequence
  Description of Artificial Sequence: Synthetic oligonucleotide
  Target: ATXN1; (-) strand; PAM type: NRG; PAM sequence: TAG
caggttttgggggccatgtt

SEQ ID NO: 75194 - DNA, 20 bp, Artificial Sequence
  Description of Artificial Sequence: Synthetic oligonucleotide
  Target: ATXN1; (-) strand; PAM type: NRG; PAM sequence: GGG
gaagagaatgcaggttttgg

SEQ ID NO: 75195 - DNA, 20 bp, Artificial Sequence
  Description of Artificial Sequence: Synthetic oligonucleotide
  Target: ATXN1; (-) strand; PAM type: NRG; PAM sequence: GGG
ggaagagaatgcaggttttg

SEQ ID NO: 75196 - DNA, 20 bp, Artificial Sequence
  Description of Artificial Sequence: Synthetic oligonucleotide
  Target: ATXN1; (-) strand; PAM type: NRG; PAM sequence: GGG
tggaagagaatgcaggtttt

SEQ ID NO: 75197 - DNA, 20 bp, Artificial Sequence
  Description of Artificial Sequence: Synthetic oligonucleotide
  Target: ATXN1; (-) strand; PAM type: NRG; PAM sequence: TGG
ttggaagagaatgcaggttt

SEQ ID NO: 75198 - DNA, 20 bp, Artificial Sequence
  Description of Artificial Sequence: Synthetic oligonucleotide
  Target: ATXN1; (-) strand; PAM type: NRG; PAM sequence: AGG
tgcaagttggaagagaatgc

SEQ ID NO: 75199 - DNA, 20 bp, Artificial Sequence
  Description of Artificial Sequence: Synthetic oligonucleotide
  Target: ATXN1; (-) strand; PAM type: NRG; PAM sequence: CAG
gtgcaagttggaagagaatg

SEQ ID NO: 75200 - DNA, 20 bp, Artificial Sequence
  Description of Artificial Sequence: Synthetic oligonucleotide
  Target: ATXN1; (-) strand; PAM type: NRG; PAM sequence: GAG
tgctgtagtgcaagttggaa

SEQ ID NO: 75201 - DNA, 20 bp, Artificial Sequence
  Description of Artificial Sequence: Synthetic oligonucleotide
  Target: ATXN1; (-) strand; PAM type: NRG; PAM sequence: AAG
catgctgtagtgcaagttgg

SEQ ID NO: 75202 - DNA, 20 bp, Artificial Sequence
  Description of Artificial Sequence: Synthetic oligonucleotide
  Target: ATXN1; (-) strand; PAM type: NRG; PAM sequence: TGG
agccatgctgtagtgcaagt

SEQ ID NO: 75203 - DNA, 20 bp, Artificial Sequence
  Description of Artificial Sequence: Synthetic oligonucleotide
  Target: ATXN1; (-) strand; PAM type: NRG; PAM sequence: AAG
agccagccatgctgtagtgc

SEQ ID NO: 75204 - DNA, 20 bp, Artificial Sequence
  Description of Artificial Sequence: Synthetic oligonucleotide
  Target: ATXN1; (-) strand; PAM type: NRG; PAM sequence: TAG
aaagtaagccagccatgctg

SEQ ID NO: 75205 - DNA, 20 bp, Artificial Sequence
  Description of Artificial Sequence: Synthetic oligonucleotide
  Target: ATXN1; (-) strand; PAM type: NRG; PAM sequence: CAG
ttaaggaattgaaagtaagc

SEQ ID NO: 75206 - DNA, 20 bp, Artificial Sequence
  Description of Artificial Sequence: Synthetic oligonucleotide
  Target: ATXN1; (-) strand; PAM type: NRG; PAM sequence: AAG
ccttttaaggaattgaaagt

SEQ ID NO: 75207 - DNA, 20 bp, Artificial Sequence
  Description of Artificial Sequence: Synthetic oligonucleotide
  Target: ATXN1; (-) strand; PAM type: NRG; PAM sequence: AAG
aggtccttttaaggaattga

SEQ ID NO: 75208 - DNA, 20 bp, Artificial Sequence
  Description of Artificial Sequence: Synthetic oligonucleotide
  Target: ATXN1; (-) strand; PAM type: NRG; PAM sequence: AGG
gggaaagcaaggtcctttta

SEQ ID NO: 75209 - DNA, 20 bp, Artificial Sequence
  Description of Artificial Sequence: Synthetic oligonucleotide
  Target: ATXN1; (-) strand; PAM type: NRG; PAM sequence: AAG
tgggaaagcaaggtcctttt

SEQ ID NO: 75210 - DNA, 20 bp, Artificial Sequence
  Description of Artificial Sequence: Synthetic oligonucleotide
  Target: ATXN1; (-) strand; PAM type: NRG; PAM sequence: AGG
ctttaaggcctgggaaagca

SEQ ID NO: 75211 - DNA, 20 bp, Artificial Sequence
  Description of Artificial Sequence: Synthetic oligonucleotide
  Target: ATXN1; (-) strand; PAM type: NRG; PAM sequence: AAG
gctttaaggcctgggaaagc

SEQ ID NO: 75212 - DNA, 20 bp, Artificial Sequence
  Description of Artificial Sequence: Synthetic oligonucleotide
  Target: ATXN1; (-) strand; PAM type: NRG; PAM sequence: AAG
aaaggctttaaggcctggga

SEQ ID NO: 75213 - DNA, 20 bp, Artificial Sequence
  Description of Artificial Sequence: Synthetic oligonucleotide
  Target: ATXN1; (-) strand; PAM type: NRG; PAM sequence: GGG
gtgcaaaggctttaaggcct

SEQ ID NO: 75214 - DNA, 20 bp, Artificial Sequence
  Description of Artificial Sequence: Synthetic oligonucleotide
  Target: ATXN1; (-) strand; PAM type: NRG; PAM sequence: TGG
tgtgcaaaggctttaaggcc

SEQ ID NO: 75215 - DNA, 20 bp, Artificial Sequence
  Description of Artificial Sequence: Synthetic oligonucleotide
  Target: ATXN1; (-) strand; PAM type: NRG; PAM sequence: AGG
agtcatgtgcaaaggcttta

SEQ ID NO: 75216 - DNA, 20 bp, Artificial Sequence
  Description of Artificial Sequence: Synthetic oligonucleotide
  Target: ATXN1; (-) strand; PAM type: NRG; PAM sequence: AAG
aagtcatgtgcaaaggcttt

SEQ ID NO: 75217 - DNA, 20 bp, Artificial Sequence
  Description of Artificial Sequence: Synthetic oligonucleotide
  Target: ATXN1; (-) strand; PAM type: NRG; PAM sequence: AGG
aaggaggaagtcatgtgcaa

SEQ ID NO: 75218 - DNA, 20 bp, Artificial Sequence
  Description of Artificial Sequence: Synthetic oligonucleotide
  Target: ATXN1; (-) strand; PAM type: NRG; PAM sequence: AAG
caaggaggaagtcatgtgca

SEQ ID NO: 75219 - DNA, 20 bp, Artificial Sequence
  Description of Artificial Sequence: Synthetic oligonucleotide
  Target: ATXN1; (-) strand; PAM type: NRG; PAM sequence: AAG
gagaagtcttagcaaggagg

SEQ ID NO: 75220 - DNA, 20 bp, Artificial Sequence
  Description of Artificial Sequence: Synthetic oligonucleotide
  Target: ATXN1; (-) strand; PAM type: NRG; PAM sequence: AGG
gaggagaagtcttagcaagg

SEQ ID NO: 75221 - DNA, 20 bp, Artificial Sequence
  Description of Artificial Sequence: Synthetic oligonucleotide
  Target: ATXN1; (-) strand; PAM type: NRG; PAM sequence: GAG
tgaggagaagtcttagcaag

SEQ ID NO: 75222 - DNA, 20 bp, Artificial Sequence
  Description of Artificial Sequence: Synthetic oligonucleotide
  Target: ATXN1; (-) strand; PAM type: NRG; PAM sequence: AGG
tttgaggagaagtcttagca

SEQ ID NO: 75223 - DNA, 20 bp, Artificial Sequence
  Description of Artificial Sequence: Synthetic oligonucleotide
  Target: ATXN1; (-) strand; PAM type: NRG; PAM sequence: AAG
atttgaggagaagtcttagc

SEQ ID NO: 75224 - DNA, 20 bp, Artificial Sequence
  Description of Artificial Sequence: Synthetic oligonucleotide
  Target: ATXN1; (-) strand; PAM type: NRG; PAM sequence: TAG
ggtgatttgaggagaagtct

SEQ ID NO: 75225 - DNA, 20 bp, Artificial Sequence
  Description of Artificial Sequence: Synthetic oligonucleotide
  Target: ATXN1; (-) strand; PAM type: NRG; PAM sequence: AAG
ggggtgggtgatttgaggag

SEQ ID NO: 75226 - DNA, 20 bp, Artificial Sequence
  Description of Artificial Sequence: Synthetic oligonucleotide
  Target: ATXN1; (-) strand; PAM type: NRG; PAM sequence: GAG
gaaggggtgggtgatttgag

SEQ ID NO: 75227 - DNA, 20 bp, Artificial Sequence
  Description of Artificial Sequence: Synthetic oligonucleotide
  Target: ATXN1; (-) strand; PAM type: NRG; PAM sequence: AGG
tagaaggggtgggtgatttg

SEQ ID NO: 75228 - DNA, 20 bp, Artificial Sequence
  Description of Artificial Sequence: Synthetic oligonucleotide
  Target: ATXN1; (-) strand; PAM type: NRG; PAM sequence: GAG
atagaaggggtgggtgattt

SEQ ID NO: 75229 - DNA, 20 bp, Artificial Sequence
  Description of Artificial Sequence: Synthetic oligonucleotide
  Target: ATXN1; (-) strand; PAM type: NRG; PAM sequence: GGG
ggtcatttgatagaaggggt

SEQ ID NO: 75230 - DNA, 20 bp, Artificial Sequence
  Description of Artificial Sequence: Synthetic oligonucleotide
  Target: ATXN1; (-) strand; PAM type: NRG; PAM sequence: TGG
aggtcatttgatagaagggg

SEQ ID NO: 75231 - DNA, 20 bp, Artificial Sequence
  Description of Artificial Sequence: Synthetic oligonucleotide
  Target: ATXN1; (-) strand; PAM type: NRG; PAM sequence: GGG
acaaggtcatttgatagaag

SEQ ID NO: 75232 - DNA, 20 bp, Artificial Sequence
  Description of Artificial Sequence: Synthetic oligonucleotide
  Target: ATXN1; (-) strand; PAM type: NRG; PAM sequence: GGG
tacaaggtcatttgatagaa

SEQ ID NO: 75233 - DNA, 20 bp, Artificial Sequence
  Description of Artificial Sequence: Synthetic oligonucleotide
  Target: ATXN1; (-) strand; PAM type: NRG; PAM sequence: AGG
atacaaggtcatttgataga

SEQ ID NO: 75234 - DNA, 20 bp, Artificial Sequence
  Description of Artificial Sequence: Synthetic oligonucleotide
  Target: ATXN1; (-) strand; PAM type: NRG; PAM sequence: AAG
aatacaaggtcatttgatag

SEQ ID NO: 75235 - DNA, 20 bp, Artificial Sequence
  Description of Artificial Sequence: Synthetic oligonucleotide
  Target: ATXN1; (-) strand; PAM type: NRG; PAM sequence: TAG
aagaatacaaggtcatttga

SEQ ID NO: 75236 - DNA, 20 bp, Artificial Sequence
  Description of Artificial Sequence: Synthetic oligonucleotide
  Target: ATXN1; (-) strand; PAM type: NRG; PAM sequence: AGG
ctgaaggagaaaagaataca

SEQ ID NO: 75237 - DNA, 20 bp, Artificial Sequence
  Description of Artificial Sequence: Synthetic oligonucleotide
  Target: ATXN1; (-) strand; PAM type: NRG; PAM sequence: AAG
gctgaaggagaaaagaatac

SEQ ID NO: 75238 - DNA, 20 bp, Artificial Sequence
  Description of Artificial Sequence: Synthetic oligonucleotide
  Target: ATXN1; (-) strand; PAM type: NRG; PAM sequence: AAG
agctgagagctgaaggagaa

SEQ ID NO: 75239 - DNA, 20 bp, Artificial Sequence
  Description of Artificial Sequence: Synthetic oligonucleotide
  Target: ATXN1; (-) strand; PAM type: NRG; PAM sequence: GAG
gactgagctgagagctgaag

SEQ ID NO: 75240 - DNA, 20 bp, Artificial Sequence
  Description of Artificial Sequence: Synthetic oligonucleotide
  Target: ATXN1; (-) strand; PAM type: NRG; PAM sequence: AGG
aggactgagctgagagctga

SEQ ID NO: 75241 - DNA, 20 bp, Artificial Sequence
  Description of Artificial Sequence: Synthetic oligonucleotide
  Target: ATXN1; (-) strand; PAM type: NRG; PAM sequence: AAG
gaggactgagctgagagctg

SEQ ID NO: 75242 - DNA, 20 bp, Artificial Sequence
  Description of Artificial Sequence: Synthetic oligonucleotide
  Target: ATXN1; (-) strand; PAM type: NRG; PAM sequence: GAG
tgagaagaggactgagctga

SEQ ID NO: 75243 - DNA, 20 bp, Artificial Sequence
  Description of Artificial Sequence: Synthetic oligonucleotide
  Target: ATXN1; (-) strand; PAM type: NRG; PAM sequence: GAG
cttgagaagaggactgagct

SEQ ID NO: 75244 - DNA, 20 bp, Artificial Sequence
  Description of Artificial Sequence: Synthetic oligonucleotide
  Target: ATXN1; (-) strand; PAM type: NRG; PAM sequence: GAG
tctcccttgagaagaggact

SEQ ID NO: 75245 - DNA, 20 bp, Artificial Sequence
  Description of Artificial Sequence: Synthetic oligonucleotide
  Target: ATXN1; (-) strand; PAM type: NRG; PAM sequence: AGG
aggaagtctcccttgagaag

SEQ ID NO: 75246 - DNA, 20 bp, Artificial Sequence
  Description of Artificial Sequence: Synthetic oligonucleotide
  Target: ATXN1; (-) strand; PAM type: NRG; PAM sequence: GAG
gaggaagtctcccttgagaa

SEQ ID NO: 75247 - DNA, 20 bp, Artificial Sequence
  Description of Artificial Sequence: Synthetic oligonucleotide
  Target: ATXN1; (-) strand; PAM type: NRG; PAM sequence: AAG
ctgaggaagtctcccttgag

SEQ ID NO: 75248 - DNA, 20 bp, Artificial Sequence
  Description of Artificial Sequence: Synthetic oligonucleotide
  Target: ATXN1; (-) strand; PAM type: NRG; PAM sequence: GAG
tggctgaggaagtctccctt

SEQ ID NO: 75249 - DNA, 20 bp, Artificial Sequence
  Description of Artificial Sequence: Synthetic oligonucleotide
  Target: ATXN1; (-) strand; PAM type: NRG; PAM sequence: AAG
aggtggtgacctggctgagg

SEQ ID NO: 75250 - DNA, 20 bp, Artificial Sequence
  Description of Artificial Sequence: Synthetic oligonucleotide
  Target: ATXN1; (-) strand; PAM type: NRG; PAM sequence: AGG
aggaggtggtgacctggctg

SEQ ID NO: 75251 - DNA, 20 bp, Artificial Sequence
  Description of Artificial Sequence: Synthetic oligonucleotide
  Target: ATXN1; (-) strand; PAM type: NRG; PAM sequence: GAG
taggaggtggtgacctggct

SEQ ID NO: 75252 - DNA, 20 bp, Artificial Sequence
  Description of Artificial Sequence: Synthetic oligonucleotide
  Target: ATXN1; (-) strand; PAM type: NRG; PAM sequence: TGG
tgtcctaggaggtggtgacc

SEQ ID NO: 75253 - DNA, 20 bp, Artificial Sequence
  Description of Artificial Sequence: Synthetic oligonucleotide
  Target: ATXN1; (-) strand; PAM type: NRG; PAM sequence: TGG
tacaagtgtgtcctaggagg

SEQ ID NO: 75254 - DNA, 20 bp, Artificial Sequence
  Description of Artificial Sequence: Synthetic oligonucleotide
  Target: ATXN1; (-) strand; PAM type: NRG; PAM sequence: AGG
ctatacaagtgtgtcctagg

SEQ ID NO: 75255 - DNA, 20 bp, Artificial Sequence
  Description of Artificial Sequence: Synthetic oligonucleotide
  Target: ATXN1; (-) strand; PAM type: NRG; PAM sequence: GAG
tctatacaagtgtgtcctag

SEQ ID NO: 75256 - DNA, 20 bp, Artificial Sequence
  Description of Artificial Sequence: Synthetic oligonucleotide
  Target: ATXN1; (-) strand; PAM type: NRG; PAM sequence: AGG
attctatacaagtgtgtcct

SEQ ID NO: 75257 - DNA, 20 bp, Artificial Sequence
  Description of Artificial Sequence: Synthetic oligonucleotide
  Target: ATXN1; (-) strand; PAM type: NRG; PAM sequence: TAG
cattctatacaagtgtgtcc

SEQ ID NO: 75258 - DNA, 20 bp, Artificial Sequence
  Description of Artificial Sequence: Synthetic oligonucleotide
  Target: ATXN1; (-) strand; PAM type: NRG; PAM sequence: AAG
cagggagggtcattctatac

SEQ ID NO: 75259 - DNA, 20 bp, Artificial Sequence
  Description of Artificial Sequence: Synthetic oligonucleotide
  Target: ATXN1; (-) strand; PAM type: NRG; PAM sequence: GGG
atgactactataaccaggga

SEQ ID NO: 75260 - DNA, 20 bp, Artificial Sequence
  Description of Artificial Sequence: Synthetic oligonucleotide
  Target: ATXN1; (-) strand; PAM type: NRG; PAM sequence: AGG
aatgactactataaccaggg

SEQ ID NO: 75261 - DNA, 20 bp, Artificial Sequence
  Description of Artificial Sequence: Synthetic oligonucleotide
  Target: ATXN1; (-) strand; PAM type: NRG; PAM sequence: GAG
aaatgactactataaccagg

SEQ ID NO: 75262 - DNA, 20 bp, Artificial Sequence
  Description of Artificial Sequence: Synthetic oligonucleotide
  Target: ATXN1; (-) strand; PAM type: NRG; PAM sequence: GGG
caaaatgactactataacca

SEQ ID NO: 75263 - DNA, 20 bp, Artificial Sequence
  Description of Artificial Sequence: Synthetic oligonucleotide
  Target: ATXN1; (-) strand; PAM type: NRG; PAM sequence: AGG
acaaaatgactactataacc

SEQ ID NO: 75264 - DNA, 20 bp, Artificial Sequence
  Description of Artificial Sequence: Synthetic oligonucleotide
  Target: ATXN1; (-) strand; PAM type: NRG; PAM sequence: CAG
tacaaaatgactactataac

SEQ ID NO: 75265 - DNA, 20 bp, Artificial Sequence
  Description of Artificial Sequence: Synthetic oligonucleotide
  Target: ATXN1; (-) strand; PAM type: NRG; PAM sequence: AAG
gaatcaaccaaaaaatgtaa

SEQ ID NO: 75266 - DNA, 20 bp, Artificial Sequence
  Description of Artificial Sequence: Synthetic oligonucleotide
  Target: ATXN1; (-) strand; PAM type: NRG; PAM sequence: AAG
attgattcgtgggggaaaac

SEQ ID NO: 75267 - DNA, 20 bp, Artificial Sequence
  Description of Artificial Sequence: Synthetic oligonucleotide
  Target: ATXN1; (-) strand; PAM type: NRG; PAM sequence: GGG
tggagtttattgattcgtgg

SEQ ID NO: 75268 - DNA, 20 bp, Artificial Sequence
  Description of Artificial Sequence: Synthetic oligonucleotide
  Target: ATXN1; (-) strand; PAM type: NRG; PAM sequence: GGG
ctggagtttattgattcgtg

SEQ ID NO: 75269 - DNA, 20 bp, Artificial Sequence
  Description of Artificial Sequence: Synthetic oligonucleotide
  Target: ATXN1; (-) strand; PAM type: NRG; PAM sequence: GGG
tctggagtttattgattcgt

SEQ ID NO: 75270 - DNA, 20 bp, Artificial Sequence
  Description of Artificial Sequence: Synthetic oligonucleotide
  Target: ATXN1; (-) strand; PAM type: NRG; PAM sequence: TGG
ttctggagtttattgattcg

SEQ ID NO: 75271 - DNA, 20 bp, Artificial Sequence
  Description of Artificial Sequence: Synthetic oligonucleotide
  Target: ATXN1; (-) strand; PAM type: NRG; PAM sequence: GAG
gacacagttctccctttctg

SEQ ID NO: 75272 - DNA, 20 bp, Artificial Sequence
  Description of Artificial Sequence: Synthetic oligonucleotide
  Target: ATXN1; (-) strand; PAM type: NRG; PAM sequence: TGG
tggacacagttctccctttc

SEQ ID NO: 75273 - DNA, 20 bp, Artificial Sequence
  Description of Artificial Sequence: Synthetic oligonucleotide
  Target: ATXN1; (-) strand; PAM type: NRG; PAM sequence: CAG
aggaggggtgagagtggaca

SEQ ID NO: 75274 - DNA, 20 bp, Artificial Sequence
  Description of Artificial Sequence: Synthetic oligonucleotide
  Target: ATXN1; (-) strand; PAM type: NRG; PAM sequence: TGG
gatgaaaggaggggtgagag

SEQ ID NO: 75275 - DNA, 20 bp, Artificial Sequence
  Description of Artificial Sequence: Synthetic oligonucleotide
  Target: ATXN1; (-) strand; PAM type: NRG; PAM sequence: GAG
aaagatgaaaggaggggtga

SEQ ID NO: 75276 - DNA, 20 bp, Artificial Sequence
  Description of Artificial Sequence: Synthetic oligonucleotide
  Target: ATXN1; (-) strand; PAM type: NRG; PAM sequence: GAG
ccaaagatgaaaggaggggt

SEQ ID NO: 75277 - DNA, 20 bp, Artificial Sequence
  Description of Artificial Sequence: Synthetic oligonucleotide
  Target: ATXN1; (-) strand; PAM type: NRG; PAM sequence: GGG
aatcccaaagatgaaaggag

SEQ ID NO: 75278 - DNA, 20 bp, Artificial Sequence
  Description of Artificial Sequence: Synthetic oligonucleotide
  Target: ATXN1; (-) strand; PAM type: NRG; PAM sequence: GGG
gaatcccaaagatgaaagga

SEQ ID NO: 75279 - DNA, 20 bp, Artificial Sequence
  Description of Artificial Sequence: Synthetic oligonucleotide
  Target: ATXN1; (-) strand; PAM type: NRG; PAM sequence: AGG
tgaatcccaaagatgaaagg

SEQ ID NO: 75280 - DNA, 20 bp, Artificial Sequence
  Description of Artificial Sequence: Synthetic oligonucleotide
  Target: ATXN1; (-) strand; PAM type: NRG; PAM sequence: GAG
ttgaatcccaaagatgaaag

SEQ ID NO: 75281 - DNA, 20 bp, Artificial Sequence
  Description of Artificial Sequence: Synthetic oligonucleotide
  Target: ATXN1; (-) strand; PAM type: NRG; PAM sequence: AGG
cattgaatcccaaagatgaa

SEQ ID NO: 75282 - DNA, 20 bp, Artificial Sequence
  Description of Artificial Sequence: Synthetic oligonucleotide
  Target: ATXN1; (-) strand; PAM type: NRG; PAM sequence: AAG
ccattgaatcccaaagatga

SEQ ID NO: 75283 - DNA, 20 bp, Artificial Sequence
  Description of Artificial Sequence: Synthetic oligonucleotide
  Target: ATXN1; (-) strand; PAM type: NRG; PAM sequence: AAG
aagctttccattgaatccca

SEQ ID NO: 75284 - DNA, 20 bp, Artificial Sequence
  Description of Artificial Sequence: Synthetic oligonucleotide
  Target: ATXN1; (-) strand; PAM type: NRG; PAM sequence: AAG
ttgagtgcccataatgtgca

SEQ ID NO: 75285 - DNA, 20 bp, Artificial Sequence
  Description of Artificial Sequence: Synthetic oligonucleotide
  Target: ATXN1; (-) strand; PAM type: NRG; PAM sequence: GAG
ttcactcagaagattttatt

SEQ ID NO: 75286 - DNA, 20 bp, Artificial Sequence
  Description of Artificial Sequence: Synthetic oligonucleotide
  Target: ATXN1; (-) strand; PAM type: NRG; PAM sequence: AAG
tggctcatttattcactcag

SEQ ID NO: 75287 - DNA, 20 bp, Artificial Sequence
  Description of Artificial Sequence: Synthetic oligonucleotide
  Target: ATXN1; (-) strand; PAM type: NRG; PAM sequence: CAG
ctttggctcatttattcact

SEQ ID NO: 75288 - DNA, 20 bp, Artificial Sequence
  Description of Artificial Sequence: Synthetic oligonucleotide
  Target: ATXN1; (-) strand; PAM type: NRG; PAM sequence: TGG
ttcctccttccctccttctt

SEQ ID NO: 75289 - DNA, 20 bp, Artificial Sequence
  Description of Artificial Sequence: Synthetic oligonucleotide
  Target: ATXN1; (-) strand; PAM type: NRG; PAM sequence: GGG
aattaaatcagtatgattaa

SEQ ID NO: 75290 - DNA, 20 bp, Artificial Sequence
  Description of Artificial Sequence: Synthetic oligonucleotide
  Target: ATXN1; (-) strand; PAM type: NRG; PAM sequence: AGG
taattaaatcagtatgatta

SEQ ID NO: 75291 - DNA, 20 bp, Artificial Sequence
  Description of Artificial Sequence: Synthetic oligonucleotide
  Target: ATXN1; (-) strand; PAM type: NRG; PAM sequence: AAG
ctaattaaatcagtatgatt

SEQ ID NO: 75292 - DNA, 20 bp, Artificial Sequence
  Description of Artificial Sequence: Synthetic oligonucleotide
  Target: ATXN1; (-) strand; PAM type: NRG; PAM sequence: CAG
ccaatcaacactaattaaat

SEQ ID NO: 75293 - DNA, 20 bp, Artificial Sequence
  Description of Artificial Sequence: Synthetic oligonucleotide
  Target: ATXN1; (-) strand; PAM type: NRG; PAM sequence: CAG
gtgtgctggaaaacgattta

SEQ ID NO: 75294 - DNA, 20 bp, Artificial Sequence
  Description of Artificial Sequence: Synthetic oligonucleotide
  Target: ATXN1; (-) strand; PAM type: NRG; PAM sequence: TGG
agatgtcatactctgtgtgc

SEQ ID NO: 75295 - DNA, 20 bp, Artificial Sequence
  Description of Artificial Sequence: Synthetic oligonucleotide
  Target: ATXN1; (-) strand; PAM type: NRG; PAM sequence: TAG
gcatgttacccaaaggaatg

SEQ ID NO: 75296 - DNA, 20 bp, Artificial Sequence
  Description of Artificial Sequence: Synthetic oligonucleotide
  Target: ATXN1; (-) strand; PAM type: NRG; PAM sequence: AGG
gagccttgcatgttacccaa

SEQ ID NO: 75297 - DNA, 20 bp, Artificial Sequence
  Description of Artificial Sequence: Synthetic oligonucleotide
  Target: ATXN1; (-) strand; PAM type: NRG; PAM sequence: AAG
ggagccttgcatgttaccca

SEQ ID NO: 75298 - DNA, 20 bp, Artificial Sequence
  Description of Artificial Sequence: Synthetic oligonucleotide
  Target: ATXN1; (-) strand; PAM type: NRG; PAM sequence: GAG
ggctggggtcagagctcaag

SEQ ID NO: 75299 - DNA, 20 bp, Artificial Sequence
  Description of Artificial Sequence: Synthetic oligonucleotide
  Target: ATXN1; (-) strand; PAM type: NRG; PAM sequence: AGG
ctggctggggtcagagctca

SEQ ID NO: 75300 - DNA, 20 bp, Artificial Sequence
  Description of Artificial Sequence: Synthetic oligonucleotide
  Target: ATXN1; (-) strand; PAM type: NRG; PAM sequence: AAG
gctggctggggtcagagctc

SEQ ID NO: 75301 - DNA, 20 bp, Artificial Sequence
  Description of Artificial Sequence: Synthetic oligonucleotide
  Target: ATXN1; (-) strand; PAM type: NRG; PAM sequence: GAG
gacccggctggctggggtca

SEQ ID NO: 75302 - DNA, 20 bp, Artificial Sequence
  Description of Artificial Sequence: Synthetic oligonucleotide
  Target: ATXN1; (-) strand; PAM type: NRG; PAM sequence: CAG
gagacccggctggctggggt

SEQ ID NO: 75303 - DNA, 20 bp, Artificial Sequence
  Description of Artificial Sequence: Synthetic oligonucleotide
  Target: ATXN1; (-) strand; PAM type: NRG; PAM sequence: GGG
aggagagacccggctggctg

SEQ ID NO: 75304 - DNA, 20 bp, Artificial Sequence
  Description of Artificial Sequence: Synthetic oligonucleotide
  Target: ATXN1; (-) strand; PAM type: NRG; PAM sequence: GGG
gaggagagacccggctggct

SEQ ID NO: 75305 - DNA, 20 bp, Artificial Sequence
  Description of Artificial Sequence: Synthetic oligonucleotide
  Target: ATXN1; (-) strand; PAM type: NRG; PAM sequence: TGG
ggaggagagacccggctggc

SEQ ID NO: 75306 - DNA, 20 bp, Artificial Sequence
  Description of Artificial Sequence: Synthetic oligonucleotide
  Target: ATXN1; (-) strand; PAM type: NRG; PAM sequence: TGG
agcaggaggagagacccggc

SEQ ID NO: 75307 - DNA, 20 bp, Artificial Sequence
  Description of Artificial Sequence: Synthetic oligonucleotide
  Target: ATXN1; (-) strand; PAM type: NRG; PAM sequence: CGG
gtgcagcaggaggagagacc

SEQ ID NO: 75308 - DNA, 20 bp, Artificial Sequence
  Description of Artificial Sequence: Synthetic oligonucleotide
  Target: ATXN1; (-) strand; PAM type: NRG; PAM sequence: GAG
ggtcaagtgcagcaggagga

SEQ ID NO: 75309 - DNA, 20 bp, Artificial Sequence
  Description of Artificial Sequence: Synthetic oligonucleotide
  Target: ATXN1; (-) strand; PAM type: NRG; PAM sequence: GAG
agggtcaagtgcagcaggag

SEQ ID NO: 75310 - DNA, 20 bp, Artificial Sequence
  Description of Artificial Sequence: Synthetic oligonucleotide
  Target: ATXN1; (-) strand; PAM type: NRG; PAM sequence: AGG
tgagggtcaagtgcagcagg

SEQ ID NO: 75311 - DNA, 20 bp, Artificial Sequence
  Description of Artificial Sequence: Synthetic oligonucleotide
  Target: ATXN1; (-) strand; PAM type: NRG; PAM sequence: GAG
ctgagggtcaagtgcagcag

SEQ ID NO: 75312 - DNA, 20 bp, Artificial Sequence
  Description of Artificial Sequence: Synthetic oligonucleotide
  Target: ATXN1; (-) strand; PAM type: NRG; PAM sequence: AGG
tgctgagggtcaagtgcagc

SEQ ID NO: 75313 - DNA, 20 bp, Artificial Sequence
  Description of Artificial Sequence: Synthetic oligonucleotide
  Target: ATXN1; (-) strand; PAM type: NRG; PAM sequence: CAG
gtgctgagggtcaagtgcag

SEQ ID NO: 75314 - DNA, 20 bp, Artificial Sequence
  Description of Artificial Sequence: Synthetic oligonucleotide
  Target: ATXN1; (-) strand; PAM type: NRG; PAM sequence: CAG
gaggtgctgagggtcaagtg

SEQ ID NO: 75315 - DNA, 20 bp, Artificial Sequence
  Description of Artificial Sequence: Synthetic oligonucleotide
  Target: ATXN1; (-) strand; PAM type: NRG; PAM sequence: AAG
acttggaggtgctgagggtc

SEQ ID NO: 75316 - DNA, 20 bp, Artificial Sequence
  Description of Artificial Sequence: Synthetic oligonucleotide
  Target: ATXN1; (-) strand; PAM type: NRG; PAM sequence: GGG
gagggacttggaggtgctga

SEQ ID NO: 75317 - DNA, 20 bp, Artificial Sequence
  Description of Artificial Sequence: Synthetic oligonucleotide
  Target: ATXN1; (-) strand; PAM type: NRG; PAM sequence: AGG
ggagggacttggaggtgctg

SEQ ID NO: 75318 - DNA, 20 bp, Artificial Sequence
  Description of Artificial Sequence: Synthetic oligonucleotide
  Target: ATXN1; (-) strand; PAM type: NRG; PAM sequence: GAG
gggagggacttggaggtgct

SEQ ID NO: 75319 - DNA, 20 bp, Artificial Sequence
  Description of Artificial Sequence: Synthetic oligonucleotide
  Target: ATXN1; (-) strand; PAM type: NRG; PAM sequence: AGG
agctacagggagggacttgg

SEQ ID NO: 75320 - DNA, 20 bp, Artificial Sequence
  Description of Artificial Sequence: Synthetic oligonucleotide
  Target: ATXN1; (-) strand; PAM type: NRG; PAM sequence: GAG
gagctacagggagggacttg

SEQ ID NO: 75321 - DNA, 20 bp, Artificial Sequence
  Description of Artificial Sequence: Synthetic oligonucleotide
  Target: ATXN1; (-) strand; PAM type: NRG; PAM sequence: TGG
gggagctacagggagggact

SEQ ID NO: 75322 - DNA, 20 bp, Artificial Sequence
  Description of Artificial Sequence: Synthetic oligonucleotide
  Target: ATXN1; (-) strand; PAM type: NRG; PAM sequence: GGG
gggtcagggagctacaggga

SEQ ID NO: 75323 - DNA, 20 bp, Artificial Sequence
  Description of Artificial Sequence: Synthetic oligonucleotide
  Target: ATXN1; (-) strand; PAM type: NRG; PAM sequence: AGG
ggggtcagggagctacaggg

SEQ ID NO: 75324 - DNA, 20 bp, Artificial Sequence
  Description of Artificial Sequence: Synthetic oligonucleotide
  Target: ATXN1; (-) strand; PAM type: NRG; PAM sequence: GAG
tggggtcagggagctacagg

SEQ ID NO: 75325 - DNA, 20 bp, Artificial Sequence
  Description of Artificial Sequence: Synthetic oligonucleotide
  Target: ATXN1; (-) strand; PAM type: NRG; PAM sequence: GGG
gatggggtcagggagctaca

SEQ ID NO: 75326 - DNA, 20 bp, Artificial Sequence
  Description of Artificial Sequence: Synthetic oligonucleotide
  Target: ATXN1; (-) strand; PAM type: NRG; PAM sequence: AGG
agatggggtcagggagctac

SEQ ID NO: 75327 - DNA, 20 bp, Artificial Sequence
  Description of Artificial Sequence: Synthetic oligonucleotide
  Target: ATXN1; (-) strand; PAM type: NRG; PAM sequence: CAG
aagatggggtcagggagcta

SEQ ID NO: 75328 - DNA, 20 bp, Artificial Sequence
  Description of Artificial Sequence: Synthetic oligonucleotide
  Target: ATXN1; (-) strand; PAM type: NRG; PAM sequence: GAG
ggaaacaagatggggtcagg

SEQ ID NO: 75329 - DNA, 20 bp, Artificial Sequence
  Description of Artificial Sequence: Synthetic oligonucleotide
  Target: ATXN1; (-) strand; PAM type: NRG; PAM sequence: GGG
agggaaacaagatggggtca

SEQ ID NO: 75330 - DNA, 20 bp, Artificial Sequence
  Description of Artificial Sequence: Synthetic oligonucleotide
  Target: ATXN1; (-) strand; PAM type: NRG; PAM sequence: AGG
gagggaaacaagatggggtc

SEQ ID NO: 75331 - DNA, 20 bp, Artificial Sequence
  Description of Artificial Sequence: Synthetic oligonucleotide
  Target: ATXN1; (-) strand; PAM type: NRG; PAM sequence: CAG
tgagggaaacaagatggggt

SEQ ID NO: 75332 - DNA, 20 bp, Artificial Sequence
  Description of Artificial Sequence: Synthetic oligonucleotide
  Target: ATXN1; (-) strand; PAM type: NRG; PAM sequence: GGG
gagatgagggaaacaagatg

SEQ ID NO: 75333 - DNA, 20 bp, Artificial Sequence
  Description of Artificial Sequence: Synthetic oligonucleotide
  Target: ATXN1; (-) strand; PAM type: NRG; PAM sequence: GGG
ggagatgagggaaacaagat

SEQ ID NO: 75334 - DNA, 20 bp, Artificial Sequence
  Description of Artificial Sequence: Synthetic oligonucleotide
  Target: ATXN1; (-) strand; PAM type: NRG; PAM sequence: TGG
tggagatgagggaaacaaga

SEQ ID NO: 75335 - DNA, 20 bp, Artificial Sequence
  Description of Artificial Sequence: Synthetic oligonucleotide
  Target: ATXN1; (-) strand; PAM type: NRG; PAM sequence: AAG
ggtgtggagatgagggaaac

SEQ ID NO: 75336 - DNA, 20 bp, Artificial Sequence
  Description of Artificial Sequence: Synthetic oligonucleotide
  Target: ATXN1; (-) strand; PAM type: NRG; PAM sequence: GGG
agagaagggtgtggagatga

SEQ ID NO: 75337 - DNA, 20 bp, Artificial Sequence
  Description of Artificial Sequence: Synthetic oligonucleotide
  Target: ATXN1; (-) strand; PAM type: NRG; PAM sequence: AGG
gagagaagggtgtggagatg

SEQ ID NO: 75338 - DNA, 20 bp, Artificial Sequence
  Description of Artificial Sequence: Synthetic oligonucleotide
  Target: ATXN1; (-) strand; PAM type: NRG; PAM sequence: GAG
agagagaagggtgtggagat

SEQ ID NO: 75339 - DNA, 20 bp, Artificial Sequence
  Description of Artificial Sequence: Synthetic oligonucleotide
  Target: ATXN1; (-) strand; PAM type: NRG; PAM sequence: GAG
acagaagagagaagggtgtg

SEQ ID NO: 75340 - DNA, 20 bp, Artificial Sequence
  Description of Artificial Sequence: Synthetic oligonucleotide
  Target: ATXN1; (-) strand; PAM type: NRG; PAM sequence: TGG
gaacagaagagagaagggtg

SEQ ID NO: 75341 - DNA, 20 bp, Artificial Sequence
  Description of Artificial Sequence: Synthetic oligonucleotide
  Target: ATXN1; (-) strand; PAM type: NRG; PAM sequence: GGG
ggggggaacagaagagagaa

SEQ ID NO: 75342 - DNA, 20 bp, Artificial Sequence
  Description of Artificial Sequence: Synthetic oligonucleotide
  Target: ATXN1; (-) strand; PAM type: NRG; PAM sequence: AGG
tggggggaacagaagagaga

SEQ ID NO: 75343 - DNA, 20 bp, Artificial Sequence
  Description of Artificial Sequence: Synthetic oligonucleotide
  Target: ATXN1; (-) strand; PAM type: NRG; PAM sequence: AAG
gtggggggaacagaagagag

SEQ ID NO: 75344 - DNA, 20 bp, Artificial Sequence
  Description of Artificial Sequence: Synthetic oligonucleotide
  Target: ATXN1; (-) strand; PAM type: NRG; PAM sequence: GAG
tgtgtggggggaacagaaga

SEQ ID NO: 75345 - DNA, 20 bp, Artificial Sequence
  Description of Artificial Sequence: Synthetic oligonucleotide
  Target: ATXN1; (-) strand; PAM type: NRG; PAM sequence: GAG
gatgtgtggggggaacagaa

SEQ ID NO: 75346 - DNA, 20 bp, Artificial Sequence
  Description of Artificial Sequence: Synthetic oligonucleotide
  Target: ATXN1; (-) strand; PAM type: NRG; PAM sequence: AAG
atgatgtgtggggggaacag

SEQ ID NO: 75347 - DNA, 20 bp, Artificial Sequence
  Description of Artificial Sequence: Synthetic oligonucleotide
  Target: ATXN1; (-) strand; PAM type: NRG; PAM sequence: CAG
aagatgatgtgtggggggaa

SEQ ID NO: 75348 - DNA, 20 bp, Artificial Sequence
  Description of Artificial Sequence: Synthetic oligonucleotide
  Target: ATXN1; (-) strand; PAM type: NRG; PAM sequence: GGG
ttgaaaagatgatgtgtggg

SEQ ID NO: 75349 - DNA, 20 bp, Artificial Sequence
  Description of Artificial Sequence: Synthetic oligonucleotide
  Target: ATXN1; (-) strand; PAM type: NRG; PAM sequence: GGG
tttgaaaagatgatgtgtgg

SEQ ID NO: 75350 - DNA, 20 bp, Artificial Sequence
  Description of Artificial Sequence: Synthetic oligonucleotide
  Target: ATXN1; (-) strand; PAM type: NRG; PAM sequence: GGG
gtttgaaaagatgatgtgtg

SEQ ID NO: 75351 - DNA, 20 bp, Artificial Sequence
  Description of Artificial Sequence: Synthetic oligonucleotide
  Target: ATXN1; (-) strand; PAM type: NRG; PAM sequence: GGG
agtttgaaaagatgatgtgt

SEQ ID NO: 75352 - DNA, 20 bp, Artificial Sequence
  Description of Artificial Sequence: Synthetic oligonucleotide
  Target: ATXN1; (-) strand; PAM type: NRG; PAM sequence: TGG
gagtttgaaaagatgatgtg

SEQ ID NO: 75353 - DNA, 20 bp, Artificial Sequence
  Description of Artificial Sequence: Synthetic oligonucleotide
  Target: ATXN1; (-) strand; PAM type: NRG; PAM sequence: AAG
gaagactgagtgagtttgaa

SEQ ID NO: 75354 - DNA, 20 bp, Artificial Sequence
  Description of Artificial Sequence: Synthetic oligonucleotide
  Target: ATXN1; (-) strand; PAM type: NRG; PAM sequence: GAG
ctgagacttgaagactgagt

SEQ ID NO: 75355 - DNA, 20 bp, Artificial Sequence
  Description of Artificial Sequence: Synthetic oligonucleotide
  Target: ATXN1; (-) strand; PAM type: NRG; PAM sequence: GAG
agccctgagacttgaagact

SEQ ID NO: 75356 - DNA, 20 bp, Artificial Sequence
  Description of Artificial Sequence: Synthetic oligonucleotide
  Target: ATXN1; (-) strand; PAM type: NRG; PAM sequence: AAG
gtccccagccctgagacttg

SEQ ID NO: 75357 - DNA, 20 bp, Artificial Sequence
  Description of Artificial Sequence: Synthetic oligonucleotide
  Target: ATXN1; (-) strand; PAM type: NRG; PAM sequence: GAG
agagaagcgtccccagccct

SEQ ID NO: 75358 - DNA, 20 bp, Artificial Sequence
  Description of Artificial Sequence: Synthetic oligonucleotide
  Target: ATXN1; (-) strand; PAM type: NRG; PAM sequence: CAG
ttttcacagagaagcgtccc

SEQ ID NO: 75359 - DNA, 20 bp, Artificial Sequence
  Description of Artificial Sequence: Synthetic oligonucleotide
  Target: ATXN1; (-) strand; PAM type: NRG; PAM sequence: AAG
tcagggagtttttcacagag

SEQ ID NO: 75360 - DNA, 20 bp, Artificial Sequence
  Description of Artificial Sequence: Synthetic oligonucleotide
  Target: ATXN1; (-) strand; PAM type: NRG; PAM sequence: GAG
gtgtcagggagtttttcaca

SEQ ID NO: 75361 - DNA, 20 bp, Artificial Sequence
  Description of Artificial Sequence: Synthetic oligonucleotide
  Target: ATXN1; (-) strand; PAM type: NRG; PAM sequence: CAG
aggtgtcagggagtttttca

SEQ ID NO: 75362 - DNA, 20 bp, Artificial Sequence
  Description of Artificial Sequence: Synthetic oligonucleotide
  Target: ATXN1; (-) strand; PAM type: NRG; PAM sequence: GAG
acttcccagaaggtgtcagg

SEQ ID NO: 75363 - DNA, 20 bp, Artificial Sequence
  Description of Artificial Sequence: Synthetic oligonucleotide
  Target: ATXN1; (-) strand; PAM type: NRG; PAM sequence: GGG
ccacttcccagaaggtgtca

SEQ ID NO: 75364 - DNA, 20 bp, Artificial Sequence
  Description of Artificial Sequence: Synthetic oligonucleotide
  Target: ATXN1; (-) strand; PAM type: NRG; PAM sequence: AGG
cccacttcccagaaggtgtc

SEQ ID NO: 75365 - DNA, 20 bp, Artificial Sequence
  Description of Artificial Sequence: Synthetic oligonucleotide
  Target: ATXN1; (-) strand; PAM type: NRG; PAM sequence: CAG
ccccacttcccagaaggtgt

SEQ ID NO: 75366 - DNA, 20 bp, Artificial Sequence
  Description of Artificial Sequence: Synthetic oligonucleotide
  Target: ATXN1; (-) strand; PAM type: NRG; PAM sequence: AGG
aagggcccccacttcccaga

SEQ ID NO: 75367 - DNA, 20 bp, Artificial Sequence
  Description of Artificial Sequence: Synthetic oligonucleotide
  Target: ATXN1; (-) strand; PAM type: NRG; PAM sequence: AAG
aaagggcccccacttcccag

SEQ ID NO: 75368 - DNA, 20 bp, Artificial Sequence
  Description of Artificial Sequence: Synthetic oligonucleotide
  Target: ATXN1; (-) strand; PAM type: NRG; PAM sequence: CAG
agaaaagggcccccacttcc

SEQ ID NO: 75369 - DNA, 20 bp, Artificial Sequence
  Description of Artificial Sequence: Synthetic oligonucleotide
  Target: ATXN1; (-) strand; PAM type: NRG; PAM sequence: GGG
tgtagaaaaatgagagaaaa

SEQ ID NO: 75370 - DNA, 20 bp, Artificial Sequence
  Description of Artificial Sequence: Synthetic oligonucleotide
  Target: ATXN1; (-) strand; PAM type: NRG; PAM sequence: AGG
ttgtagaaaaatgagagaaa

SEQ ID NO: 75371 - DNA, 20 bp, Artificial Sequence
  Description of Artificial Sequence: Synthetic oligonucleotide
  Target: ATXN1; (-) strand; PAM type: NRG; PAM sequence: AAG
gttgtagaaaaatgagagaa

SEQ ID NO: 75372 - DNA, 20 bp, Artificial Sequence
  Description of Artificial Sequence: Synthetic oligonucleotide
  Target: ATXN1; (-) strand; PAM type: NRG; PAM sequence: GAG
caggggttgtagaaaaatga

SEQ ID NO: 75373 - DNA, 20 bp, Artificial Sequence
  Description of Artificial Sequence: Synthetic oligonucleotide
  Target: ATXN1; (-) strand; PAM type: NRG; PAM sequence: GAG
tacaggggttgtagaaaaat

SEQ ID NO: 75374 - DNA, 20 bp, Artificial Sequence
  Description of Artificial Sequence: Synthetic oligonucleotide
  Target: ATXN1; (-) strand; PAM type: NRG; PAM sequence: TAG
agggataggtacaggggttg

SEQ ID NO: 75375 - DNA, 20 bp, Artificial Sequence
  Description of Artificial Sequence: Synthetic oligonucleotide
  Target: ATXN1; (-) strand; PAM type: NRG; PAM sequence: GGG
tttaatagggataggtacag

SEQ ID NO: 75376 - DNA, 20 bp, Artificial Sequence
  Description of Artificial Sequence: Synthetic oligonucleotide
  Target: ATXN1; (-) strand; PAM type: NRG; PAM sequence: GGG
ctttaatagggataggtaca

SEQ ID NO: 75377 - DNA, 20 bp, Artificial Sequence
  Description of Artificial Sequence: Synthetic oligonucleotide
  Target: ATXN1; (-) strand; PAM type: NRG; PAM sequence: AGG
gctttaatagggataggtac

SEQ ID NO: 75378 - DNA, 20 bp, Artificial Sequence
  Description of Artificial Sequence: Synthetic oligonucleotide
  Target: ATXN1; (-) strand; PAM type: NRG; PAM sequence: CAG
tgctttaatagggataggta

SEQ ID NO: 75379 - DNA, 20 bp, Artificial Sequence
  Description of Artificial Sequence: Synthetic oligonucleotide
  Target: ATXN1; (-) strand; PAM type: NRG; PAM sequence: AGG
ataattgctttaatagggat

SEQ ID NO: 75380 - DNA, 20 bp, Artificial Sequence
  Description of Artificial Sequence: Synthetic oligonucleotide
  Target: ATXN1; (-) strand; PAM type: NRG; PAM sequence: TAG
gataattgctttaataggga

SEQ ID NO: 75381 - DNA, 20 bp, Artificial Sequence
  Description of Artificial Sequence: Synthetic oligonucleotide
  Target: ATXN1; (-) strand; PAM type: NRG; PAM sequence: GGG
atatgataattgctttaata

SEQ ID NO: 75382 - DNA, 20 bp, Artificial Sequence
  Description of Artificial Sequence: Synthetic oligonucleotide
  Target: ATXN1; (-) strand; PAM type: NRG; PAM sequence: AGG
aatatgataattgctttaat

SEQ ID NO: 75383 - DNA, 20 bp, Artificial Sequence
  Description of Artificial Sequence: Synthetic oligonucleotide
  Target: ATXN1; (-) strand; PAM type: NRG; PAM sequence: TAG
aaatatgataattgctttaa

SEQ ID NO: 75384 - DNA, 20 bp, Artificial Sequence
  Description of Artificial Sequence: Synthetic oligonucleotide
  Target: ATXN1; (-) strand; PAM type: NRG; PAM sequence: AGG
cttggttaaggaacaagtac

SEQ ID NO: 75385 - DNA, 20 bp, Artificial Sequence
  Description of Artificial Sequence: Synthetic oligonucleotide
  Target: ATXN1; (-) strand; PAM type: NRG; PAM sequence: CAG
acttggttaaggaacaagta

SEQ ID NO: 75386 - DNA, 20 bp, Artificial Sequence
  Description of Artificial Sequence: Synthetic oligonucleotide
  Target: ATXN1; (-) strand; PAM type: NRG; PAM sequence: AAG
gatggacttggttaaggaac

SEQ ID NO: 75387 - DNA, 20 bp, Artificial Sequence
  Description of Artificial Sequence: Synthetic oligonucleotide
  Target: ATXN1; (-) strand; PAM type: NRG; PAM sequence: AGG
gggagagatggacttggtta

SEQ ID NO: 75388 - DNA, 20 bp, Artificial Sequence
  Description of Artificial Sequence: Synthetic oligonucleotide
  Target: ATXN1; (-) strand; PAM type: NRG; PAM sequence: AAG
tgggagagatggacttggtt

SEQ ID NO: 75389 - DNA, 20 bp, Artificial Sequence
  Description of Artificial Sequence: Synthetic oligonucleotide
  Target: ATXN1; (-) strand; PAM type: NRG; PAM sequence: TGG
tgtggtgggagagatggact

SEQ ID NO: 75390 - DNA, 20 bp, Artificial Sequence
  Description of Artificial Sequence: Synthetic oligonucleotide
  Target: ATXN1; (-) strand; PAM type: NRG; PAM sequence: TGG
ttaggttgtggtgggagaga

SEQ ID NO: 75391 - DNA, 20 bp, Artificial Sequence
  Description of Artificial Sequence: Synthetic oligonucleotide
  Target: ATXN1; (-) strand; PAM type: NRG; PAM sequence: GAG
ggacttaggttgtggtggga

SEQ ID NO: 75392 - DNA, 20 bp, Artificial Sequence
  Description of Artificial Sequence: Synthetic oligonucleotide
  Target: ATXN1; (-) strand; PAM type: NRG; PAM sequence: GAG
agggacttaggttgtggtgg

SEQ ID NO: 75393 - DNA, 20 bp, Artificial Sequence
  Description of Artificial Sequence: Synthetic oligonucleotide
  Target: ATXN1; (-) strand; PAM type: NRG; PAM sequence: GGG
taagggacttaggttgtggt

SEQ ID NO: 75394 - DNA, 20 bp, Artificial Sequence
  Description of Artificial Sequence: Synthetic oligonucleotide
  Target: ATXN1; (-) strand; PAM type: NRG; PAM sequence: TGG
ttaagggacttaggttgtgg

SEQ ID NO: 75395 - DNA, 20 bp, Artificial Sequence
  Description of Artificial Sequence: Synthetic oligonucleotide
  Target: ATXN1; (-) strand; PAM type: NRG; PAM sequence: TGG
cctttaagggacttaggttg

SEQ ID NO: 75396 - DNA, 20 bp, Artificial Sequence
  Description of Artificial Sequence: Synthetic oligonucleotide
  Target: ATXN1; (-) strand; PAM type: NRG; PAM sequence: AGG
ttcttgcctttaagggactt

SEQ ID NO: 75397 - DNA, 20 bp, Artificial Sequence
  Description of Artificial Sequence: Synthetic oligonucleotide
  Target: ATXN1; (-) strand; PAM type: NRG; PAM sequence: TAG
tttcttgcctttaagggact

SEQ ID NO: 75398 - DNA, 20 bp, Artificial Sequence
  Description of Artificial Sequence: Synthetic oligonucleotide
  Target: ATXN1; (-) strand; PAM type: NRG; PAM sequence: GGG
tacctctttcttgcctttaa

SEQ ID NO: 75399 - DNA, 20 bp, Artificial Sequence
  Description of Artificial Sequence: Synthetic oligonucleotide
  Target: ATXN1; (-) strand; PAM type: NRG; PAM sequence: AGG
atacctctttcttgccttta

SEQ ID NO: 75400 - DNA, 20 bp, Artificial Sequence
  Description of Artificial Sequence: Synthetic oligonucleotide
  Target: ATXN1; (-) strand; PAM type: NRG; PAM sequence: AAG
gatacctctttcttgccttt

SEQ ID NO: 75401 - DNA, 20 bp, Artificial Sequence
  Description of Artificial Sequence: Synthetic oligonucleotide
  Target: ATXN1; (-) strand; PAM type: NRG; PAM sequence: GGG
ctctggggtactatgatgag

SEQ ID NO: 75402 - DNA, 20 bp, Artificial Sequence
  Description of Artificial Sequence: Synthetic oligonucleotide
  Target: ATXN1; (-) strand; PAM type: NRG; PAM sequence: GGG
actctggggtactatgatga

SEQ ID NO: 75403 - DNA, 20 bp, Artificial Sequence
  Description of Artificial Sequence: Synthetic oligonucleotide
  Target: ATXN1; (-) strand; PAM type: NRG; PAM sequence: AGG
aactctggggtactatgatg

SEQ ID NO: 75404 - DNA, 20 bp, Artificial Sequence
  Description of Artificial Sequence: Synthetic oligonucleotide
  Target: ATXN1; (-) strand; PAM type: NRG; PAM sequence: GAG
aaactctggggtactatgat

SEQ ID NO: 75405 - DNA, 20 bp, Artificial Sequence
  Description of Artificial Sequence: Synthetic oligonucleotide
  Target: ATXN1; (-) strand; PAM type: NRG; PAM sequence: GGG
cgctgctgtacgaaactctg

SEQ ID NO: 75406 - DNA, 20 bp, Artificial Sequence
  Description of Artificial Sequence: Synthetic oligonucleotide
  Target: ATXN1; (-) strand; PAM type: NRG; PAM sequence: GGG
acgctgctgtacgaaactct

SEQ ID NO: 75407 - DNA, 20 bp, Artificial Sequence
  Description of Artificial Sequence: Synthetic oligonucleotide
  Target: ATXN1; (-) strand; PAM type: NRG; PAM sequence: TGG
cacgctgctgtacgaaactc

SEQ ID NO: 75408 - DNA, 20 bp, Artificial Sequence
  Description of Artificial Sequence: Synthetic oligonucleotide
  Target: ATXN1; (-) strand; PAM type: NRG; PAM sequence: TAG
gtatatataatatataaatg

SEQ ID NO: 75409 - DNA, 20 bp, Artificial Sequence
  Description of Artificial Sequence: Synthetic oligonucleotide
  Target: ATXN1; (-) strand; PAM type: NRG; PAM sequence: AAG
gtgatgtatatataatatat

SEQ ID NO: 75410 - DNA, 20 bp, Artificial Sequence
  Description of Artificial Sequence: Synthetic oligonucleotide
  Target: ATXN1; (-) strand; PAM type: NRG; PAM sequence: CAG
tgcccagctctggaactttg

SEQ ID NO: 75411 - DNA, 20 bp, Artificial Sequence
  Description of Artificial Sequence: Synthetic oligonucleotide
  Target: ATXN1; (-) strand; PAM type: NRG; PAM sequence: TGG
atatttcagatgcccagctc

SEQ ID NO: 75412 - DNA, 20 bp, Artificial Sequence
  Description of Artificial Sequence: Synthetic oligonucleotide
  Target: ATXN1; (-) strand; PAM type: NRG; PAM sequence: CAG
aatcgtatatttcagatgcc

SEQ ID NO: 75413 - DNA, 20 bp, Artificial Sequence
  Description of Artificial Sequence: Synthetic oligonucleotide
  Target: ATXN1; (-) strand; PAM type: NRG; PAM sequence: CAG
tctctattaatcgtatattt

SEQ ID NO: 75414 - DNA, 20 bp, Artificial Sequence
  Description of Artificial Sequence: Synthetic oligonucleotide
  Target: ATXN1; (-) strand; PAM type: NRG; PAM sequence: CAG
ggtgttattagcccgtttca

SEQ ID NO: 75415 - DNA, 20 bp, Artificial Sequence
  Description of Artificial Sequence: Synthetic oligonucleotide
  Target: ATXN1; (-) strand; PAM type: NRG; PAM sequence: TAG
ccctgtgaggtaggtgttat

SEQ ID NO: 75416 - DNA, 20 bp, Artificial Sequence
  Description of Artificial Sequence: Synthetic oligonucleotide
  Target: ATXN1; (-) strand; PAM type: NRG; PAM sequence: AGG
tcgtaacaaccctgtgaggt

SEQ ID NO: 75417 - DNA, 20 bp, Artificial Sequence
  Description of Artificial Sequence: Synthetic oligonucleotide
  Target: ATXN1; (-) strand; PAM type: NRG; PAM sequence: TAG
ctcgtaacaaccctgtgagg

SEQ ID NO: 75418 - DNA, 20 bp, Artificial Sequence
  Description of Artificial Sequence: Synthetic oligonucleotide
  Target: ATXN1; (-) strand; PAM type: NRG; PAM sequence: AGG
actctcgtaacaaccctgtg

SEQ ID NO: 75419 - DNA, 20 bp, Artificial Sequence
  Description of Artificial Sequence: Synthetic oligonucleotide
  Target: ATXN1; (-) strand; PAM type: NRG; PAM sequence: GAG
aactctcgtaacaaccctgt

SEQ ID NO: 75420 - DNA, 20 bp, Artificial Sequence
  Description of Artificial Sequence: Synthetic oligonucleotide
  Target: ATXN1; (-) strand; PAM type: NRG; PAM sequence: TAG
aacattttacttatgtagct

SEQ ID NO: 75421 - DNA, 20 bp, Artificial Sequence
  Description of Artificial Sequence: Synthetic oligonucleotide
  Target: ATXN1; (-) strand; PAM type: NRG; PAM sequence: TAG
tgctaaacattttacttatg

SEQ ID NO: 75422 - DNA, 20 bp, Artificial Sequence
  Description of Artificial Sequence: Synthetic oligonucleotide
  Target: ATXN1; (-) strand; PAM type: NRG; PAM sequence: GAG
tggagtgcttccagtatact

SEQ ID NO: 75423 - DNA, 20 bp, Artificial Sequence
  Description of Artificial Sequence: Synthetic oligonucleotide
  Target: ATXN1; (-) strand; PAM type: NRG; PAM sequence: CAG
taatatttatggagtgcttc

SEQ ID NO: 75424 - DNA, 20 bp, Artificial Sequence
  Description of Artificial Sequence: Synthetic oligonucleotide
  Target: ATXN1; (-) strand; PAM type: NRG; PAM sequence: GAG
ctgtacaattaatatttatg

SEQ ID NO: 75425 - DNA, 20 bp, Artificial Sequence
  Description of Artificial Sequence: Synthetic oligonucleotide
  Target: ATXN1; (-) strand; PAM type: NRG; PAM sequence: TGG
ggctgtacaattaatattta

SEQ ID NO: 75426 - DNA, 20 bp, Artificial Sequence
  Description of Artificial Sequence: Synthetic oligonucleotide
  Target: ATXN1; (-) strand; PAM type: NRG; PAM sequence: TGG
aacaatactgatagtgataa

SEQ ID NO: 75427 - DNA, 20 bp, Artificial Sequence
  Description of Artificial Sequence: Synthetic oligonucleotide
  Target: ATXN1; (-) strand; PAM type: NRG; PAM sequence: TAG
agttgccctaacaatactga

SEQ ID NO: 75428 - DNA, 20 bp, Artificial Sequence
  Description of Artificial Sequence: Synthetic oligonucleotide
  Target: ATXN1; (-) strand; PAM type: NRG; PAM sequence: TAG
cataagttgtaaattcagct

SEQ ID NO: 75429 - DNA, 20 bp, Artificial Sequence
  Description of Artificial Sequence: Synthetic oligonucleotide
  Target: ATXN1; (-) strand; PAM type: NRG; PAM sequence: CAG
ttacccataagttgtaaatt

SEQ ID NO: 75430 - DNA, 20 bp, Artificial Sequence
  Description of Artificial Sequence: Synthetic oligonucleotide
  Target: ATXN1; (-) strand; PAM type: NRG; PAM sequence: AAG
aactgttacattttacccat

SEQ ID NO: 75431 - DNA, 20 bp, Artificial Sequence
  Description of Artificial Sequence: Synthetic oligonucleotide
  Target: ATXN1; (-) strand; PAM type: NRG; PAM sequence: TGG
tgctttaatatgaaagatac

SEQ ID NO: 75432 - DNA, 20 bp, Artificial Sequence
  Description of Artificial Sequence: Synthetic oligonucleotide
  Target: ATXN1; (-) strand; PAM type: NRG; PAM sequence: AAG
taattaatgctttaatatga

SEQ ID NO: 75433 - DNA, 20 bp, Artificial Sequence
  Description of Artificial Sequence: Synthetic oligonucleotide
  Target: ATXN1; (-) strand; PAM type: NRG; PAM sequence: CAG
aggcattttatgttcttaca

SEQ ID NO: 75434 - DNA, 20 bp, Artificial Sequence
  Description of Artificial Sequence: Synthetic oligonucleotide
  Target: ATXN1; (-) strand; PAM type: NRG; PAM sequence: AGG
aattttctgagctcctttct

SEQ ID NO: 75435 - DNA, 20 bp, Artificial Sequence
  Description of Artificial Sequence: Synthetic oligonucleotide
  Target: ATXN1; (-) strand; PAM type: NRG; PAM sequence: TAG
taattttctgagctcctttc

SEQ ID NO: 75436 - DNA, 20 bp, Artificial Sequence
  Description of Artificial Sequence: Synthetic oligonucleotide
  Target: ATXN1; (-) strand; PAM type: NRG; PAM sequence: GAG
ttctttatccttaattttct

SEQ ID NO: 75437 - DNA, 20 bp, Artificial Sequence
  Description of Artificial Sequence: Synthetic oligonucleotide
  Target: ATXN1; (-) strand; PAM type: NRG; PAM sequence: AAG
gtccttcagttgcaacggat

SEQ ID NO: 75438 - DNA, 20 bp, Artificial Sequence
  Description of Artificial Sequence: Synthetic oligonucleotide
  Target: ATXN1; (-) strand; PAM type: NRG; PAM sequence: CGG
cattagtccttcagttgcaa

SEQ ID NO: 75439 - DNA, 20 bp, Artificial Sequence
  Description of Artificial Sequence: Synthetic oligonucleotide
  Target: ATXN1; (-) strand; PAM type: NRG; PAM sequence: CAG
cgaaacaatcattagtcctt

SEQ ID NO: 75440 - DNA, 20 bp, Artificial Sequence
  Description of Artificial Sequence: Synthetic oligonucleotide
  Target: ATXN1; (-) strand; PAM type: NRG; PAM sequence: TAG
cagattaccgaaacaatcat

SEQ ID NO: 75441 - DNA, 20 bp, Artificial Sequence
  Description of Artificial Sequence: Synthetic oligonucleotide
  Target: ATXN1; (-) strand; PAM type: NRG; PAM sequence: CAG
cttccttcacacatatatca

SEQ ID NO: 75442 - DNA, 20 bp, Artificial Sequence
  Description of Artificial Sequence: Synthetic oligonucleotide
  Target: ATXN1; (-) strand; PAM type: NRG; PAM sequence: CAG
cttcatagataatttttgta

SEQ ID NO: 75443 - DNA, 20 bp, Artificial Sequence
  Description of Artificial Sequence: Synthetic oligonucleotide
  Target: ATXN1; (-) strand; PAM type: NRG; PAM sequence: TAG
tttctgtcatttagacttca

SEQ ID NO: 75444 - DNA, 20 bp, Artificial Sequence
  Description of Artificial Sequence: Synthetic oligonucleotide
  Target: ATXN1; (-) strand; PAM type: NRG; PAM sequence: TAG
tatgtgtagtttctgtcatt

SEQ ID NO: 75445 - DNA, 20 bp, Artificial Sequence
  Description of Artificial Sequence: Synthetic oligonucleotide
  Target: ATXN1; (-) strand; PAM type: NRG; PAM sequence: TAG
cacttgaatggcgatatgtg

SEQ ID NO: 75446 - DNA, 20 bp, Artificial Sequence
  Description of Artificial Sequence: Synthetic oligonucleotide
  Target: ATXN1; (-) strand; PAM type: NRG; PAM sequence: TGG
caatgtttacagcacttgaa

SEQ ID NO: 75447 - DNA, 20 bp, Artificial Sequence
  Description of Artificial Sequence: Synthetic oligonucleotide
  Target: ATXN1; (-) strand; PAM type: NRG; PAM sequence: CAG
ttacgtcagctcaatgttta

SEQ ID NO: 75448 - DNA, 20 bp, Artificial Sequence
  Description of Artificial Sequence: Synthetic oligonucleotide
  Target: ATXN1; (-) strand; PAM type: NRG; PAM sequence: CAG
gtaagtatttataattacgt

SEQ ID NO: 75449 - DNA, 20 bp, Artificial Sequence
  Description of Artificial Sequence: Synthetic oligonucleotide
  Target: ATXN1; (-) strand; PAM type: NRG; PAM sequence: AAG
caaaagaaatagcttacagt

SEQ ID NO: 75450 - DNA, 20 bp, Artificial Sequence
  Description of Artificial Sequence: Synthetic oligonucleotide
  Target: ATXN1; (-) strand; PAM type: NRG; PAM sequence: CAG
ttagcaaaagaaatagctta

SEQ ID NO: 75451 - DNA, 20 bp, Artificial Sequence
  Description of Artificial Sequence: Synthetic oligonucleotide
  Target: ATXN1; (-) strand; PAM type: NRG; PAM sequence: TAG
tttttttttagcaaaagaaa

SEQ ID NO: 75452 - DNA, 20 bp, Artificial Sequence
  Description of Artificial Sequence: Synthetic oligonucleotide
  Target: ATXN1; (-) strand; PAM type: NRG; PAM sequence: AAG
tctaattttttttttagcaa

SEQ ID NO: 75453 - DNA, 20 bp, Artificial Sequence
  Description of Artificial Sequence: Synthetic oligonucleotide
  Target: ATXN1; (-) strand; PAM type: NRG; PAM sequence: TAG
tgcatctctaattttttttt

SEQ ID NO: 75454 - DNA, 20 bp, Artificial Sequence
  Description of Artificial Sequence: Synthetic oligonucleotide
  Target: ATXN1; (-) strand; PAM type: NRG; PAM sequence: TGG
tgtccagtaattaacagaag

SEQ ID NO: 75455 - DNA, 20 bp, Artificial Sequence
  Description of Artificial Sequence: Synthetic oligonucleotide
  Target: ATXN1; (-) strand; PAM type: NRG; PAM sequence: AAG
ctctgtccagtaattaacag

SEQ ID NO: 75456 - DNA, 20 bp, Artificial Sequence
  Description of Artificial Sequence: Synthetic oligonucleotide
  Target: ATXN1; (-) strand; PAM type: NRG; PAM sequence: CAG
ttactctgtccagtaattaa

SEQ ID NO: 75457 - DNA, 20 bp, Artificial Sequence
  Description of Artificial Sequence: Synthetic oligonucleotide
  Target: ATXN1; (-) strand; PAM type: NRG; PAM sequence: CAG
tgaagtcacattactctgtc

SEQ ID NO: 75458 - DNA, 20 bp, Artificial Sequence
  Description of Artificial Sequence: Synthetic oligonucleotide
  Target: ATXN1; (-) strand; PAM type: NRG; PAM sequence: AAG
atccttagtatttatttatg

SEQ ID NO: 75459 - DNA, 20 bp, Artificial Sequence
  Description of Artificial Sequence: Synthetic oligonucleotide
  Target: ATXN1; (-) strand; PAM type: NRG; PAM sequence: TAG
atattcattagtcaaatcct

SEQ ID NO: 75460 - DNA, 20 bp, Artificial Sequence
  Description of Artificial Sequence: Synthetic oligonucleotide
  Target: ATXN1; (-) strand; PAM type: NRG; PAM sequence: TAG
acattttatggcatattcat

SEQ ID NO: 75461 - DNA, 20 bp, Artificial Sequence
  Description of Artificial Sequence: Synthetic oligonucleotide
  Target: ATXN1; (-) strand; PAM type: NRG; PAM sequence: TGG
ctattaattcagacatttta

SEQ ID NO: 75462 - DNA, 20 bp, Artificial Sequence
  Description of Artificial Sequence: Synthetic oligonucleotide
  Target: ATXN1; (-) strand; PAM type: NRG; PAM sequence: CAG
aaatgtgcttgctattaatt

SEQ ID NO: 75463 - DNA, 20 bp, Artificial Sequence
  Description of Artificial Sequence: Synthetic oligonucleotide
  Target: ATXN1; (-) strand; PAM type: NRG; PAM sequence: TAG
taaattagaatagcatctaa

SEQ ID NO: 75464 - DNA, 20 bp, Artificial Sequence
  Description of Artificial Sequence: Synthetic oligonucleotide
  Target: ATXN1; (-) strand; PAM type: NRG; PAM sequence: TAG
tctgcaattctaaattagaa

SEQ ID NO: 75465 - DNA, 20 bp, Artificial Sequence
  Description of Artificial Sequence: Synthetic oligonucleotide
  Target: ATXN1; (-) strand; PAM type: NRG; PAM sequence: TAG
aaatttctgcaattctaaat

SEQ ID NO: 75466 - DNA, 20 bp, Artificial Sequence
  Description of Artificial Sequence: Synthetic oligonucleotide
  Target: ATXN1; (-) strand; PAM type: NRG; PAM sequence: CAG
tgcctgtattttcctgtttg

SEQ ID NO: 75467 - DNA, 20 bp, Artificial Sequence
  Description of Artificial Sequence: Synthetic oligonucleotide
  Target: ATXN1; (-) strand; PAM type: NRG; PAM sequence: TAG
ttccaaagtgcattgcaaaa

SEQ ID NO: 75468 - DNA, 20 bp, Artificial Sequence
  Description of Artificial Sequence: Synthetic oligonucleotide
  Target: ATXN1; (-) strand; PAM type: NRG; PAM sequence: AAG
tcattcttattttttttcca

SEQ ID NO: 75469 - DNA, 20 bp, Artificial Sequence
  Description of Artificial Sequence: Synthetic oligonucleotide
  Target: ATXN1; (-) strand; PAM type: NRG; PAM sequence: TAG
tctgttcaactatgtactgg

SEQ ID NO: 75470 - DNA, 20 bp, Artificial Sequence
  Description of Artificial Sequence: Synthetic oligonucleotide
  Target: ATXN1; (-) strand; PAM type: NRG; PAM sequence: TGG
cattctgttcaactatgtac

SEQ ID NO: 75471 - DNA, 20 bp, Artificial Sequence
  Description of Artificial Sequence: Synthetic oligonucleotide
  Target: ATXN1; (-) strand; PAM type: NRG; PAM sequence: CAG
cttcgtaaaataactattac

SEQ ID NO: 75472 - DNA, 20 bp, Artificial Sequence
  Description of Artificial Sequence: Synthetic oligonucleotide
  Target: ATXN1; (-) strand; PAM type: NRG; PAM sequence: GAG
gcaacatagggcagaattat

SEQ ID NO: 75473 - DNA, 20 bp, Artificial Sequence
  Description of Artificial Sequence: Synthetic oligonucleotide
  Target: ATXN1; (-) strand; PAM type: NRG; PAM sequence: CAG
aagagaaaagcaacataggg

SEQ ID NO: 75474 - DNA, 20 bp, Artificial Sequence
  Description of Artificial Sequence: Synthetic oligonucleotide
  Target: ATXN1; (-) strand; PAM type: NRG; PAM sequence: GGG
tgcaagagaaaagcaacata

SEQ ID NO: 75475 - DNA, 20 bp, Artificial Sequence
  Description of Artificial Sequence: Synthetic oligonucleotide
  Target: ATXN1; (-) strand; PAM type: NRG; PAM sequence: AGG
atgcaagagaaaagcaacat

SEQ ID NO: 75476 - DNA, 20 bp, Artificial Sequence
  Description of Artificial Sequence: Synthetic oligonucleotide
  Target: ATXN1; (-) strand; PAM type: NRG; PAM sequence: TAG
tatgcaagagaaaagcaaca

SEQ ID NO: 75477 - DNA, 20 bp, Artificial Sequence
  Description of Artificial Sequence: Synthetic oligonucleotide
  Target: ATXN1; (-) strand; PAM type: NRG; PAM sequence: AAG
ttggccaatatgcaagagaa

SEQ ID NO: 75478 - DNA, 20 bp, Artificial Sequence
  Description of Artificial Sequence: Synthetic oligonucleotide
  Target: ATXN1; (-) strand; PAM type: NRG; PAM sequence: GAG
taaatttggccaatatgcaa

SEQ ID NO: 75479 - DNA, 20 bp, Artificial Sequence
  Description of Artificial Sequence: Synthetic oligonucleotide
  Target: ATXN1; (-) strand; PAM type: NRG; PAM sequence: AAG
tttaaatttggccaatatgc

SEQ ID NO: 75480 - DNA, 20 bp, Artificial Sequence
  Description of Artificial Sequence: Synthetic oligonucleotide
  Target: ATXN1; (-) strand; PAM type: NRG; PAM sequence: TGG
taatatgcattatttaaatt

SEQ ID NO: 75481 - DNA, 20 bp, Artificial Sequence
  Description of Artificial Sequence: Synthetic oligonucleotide
  Target: ATXN1; (-) strand; PAM type: NRG; PAM sequence: AGG
atagtactttatatttcagt

SEQ ID NO: 75482 - DNA, 20 bp, Artificial Sequence
  Description of Artificial Sequence: Synthetic oligonucleotide
  Target: ATXN1; (-) strand; PAM type: NRG; PAM sequence: TAG
gatagtactttatatttcag

SEQ ID NO: 75483 - DNA, 20 bp, Artificial Sequence
  Description of Artificial Sequence: Synthetic oligonucleotide
  Target: ATXN1; (-) strand; PAM type: NRG; PAM sequence: CAG
aatgatagtactttatattt

SEQ ID NO: 75484 - DNA, 20 bp, Artificial Sequence
  Description of Artificial Sequence: Synthetic oligonucleotide
  Target: ATXN1; (-) strand; PAM type: NRG; PAM sequence: TAG
atctcaaaatgcaataatga

SEQ ID NO: 75485 - DNA, 20 bp, Artificial Sequence
  Description of Artificial Sequence: Synthetic oligonucleotide
  Target: ATXN1; (-) strand; PAM type: NRG; PAM sequence: TAG
tgataaatgtgaattgagaa

SEQ ID NO: 75486 - DNA, 20 bp, Artificial Sequence
  Description of Artificial Sequence: Synthetic oligonucleotide
  Target: ATXN1; (-) strand; PAM type: NRG; PAM sequence: GAG
atcagtgataaatgtgaatt

SEQ ID NO: 75487 - DNA, 20 bp, Artificial Sequence
  Description of Artificial Sequence: Synthetic oligonucleotide
  Target: ATXN1; (-) strand; PAM type: NRG; PAM sequence: CAG
tttggggttttatcttttat

SEQ ID NO: 75488 - DNA, 20 bp, Artificial Sequence
  Description of Artificial Sequence: Synthetic oligonucleotide
  Target: ATXN1; (-) strand; PAM type: NRG; PAM sequence: GGG
cagaaaaatgatttgctttg

SEQ ID NO: 75489 - DNA, 20 bp, Artificial Sequence
  Description of Artificial Sequence: Synthetic oligonucleotide
  Target: ATXN1; (-) strand; PAM type: NRG; PAM sequence: GGG
tcagaaaaatgatttgcttt

SEQ ID NO: 75490 - DNA, 20 bp, Artificial Sequence
  Description of Artificial Sequence: Synthetic oligonucleotide
  Target: ATXN1; (-) strand; PAM type: NRG; PAM sequence: TGG
atcagaaaaatgatttgctt

SEQ ID NO: 75491 - DNA, 20 bp, Artificial Sequence
  Description of Artificial Sequence: Synthetic oligonucleotide
  Target: ATXN1; (-) strand; PAM type: NRG; PAM sequence: CAG
ctctgaggaaaagcctcaat

SEQ ID NO: 75492 - DNA, 20 bp, Artificial Sequence
  Description of Artificial Sequence: Synthetic oligonucleotide
  Target: ATXN1; (-) strand; PAM type: NRG; PAM sequence: AAG
actctagtatctctgaggaa

SEQ ID NO: 75493 - DNA, 20 bp, Artificial Sequence
  Description of Artificial Sequence: Synthetic oligonucleotide
  Target: ATXN1; (-) strand; PAM type: NRG; PAM sequence: AGG
ctacaactctagtatctctg

SEQ ID NO: 75494 - DNA, 20 bp, Artificial Sequence
  Description of Artificial Sequence: Synthetic oligonucleotide
  Target: ATXN1; (-) strand; PAM type: NRG; PAM sequence: GAG
cctacaactctagtatctct

SEQ ID NO: 75495 - DNA, 20 bp, Artificial Sequence
  Description of Artificial Sequence: Synthetic oligonucleotide
  Target: ATXN1; (-) strand; PAM type: NRG; PAM sequence: TAG
ttatacttcccctacaactc

SEQ ID NO: 75496 - DNA, 20 bp, Artificial Sequence
  Description of Artificial Sequence: Synthetic oligonucleotide
  Target: ATXN1; (-) strand; PAM type: NRG; PAM sequence: TAG
aaaaaagaatgttatgaatt

SEQ ID NO: 75497 - DNA, 20 bp, Artificial Sequence
  Description of Artificial Sequence: Synthetic oligonucleotide
  Target: ATXN1; (-) strand; PAM type: NRG; PAM sequence: AAG
tgtctcaaagaaaaaaaaaa

SEQ ID NO: 75498 - DNA, 20 bp, Artificial Sequence
  Description of Artificial Sequence: Synthetic oligonucleotide
  Target: ATXN1; (-) strand; PAM type: NRG; PAM sequence: AAG
cagagtgagaacttgtctca

SEQ ID NO: 75499 - DNA, 20 bp, Artificial Sequence
  Description of Artificial Sequence: Synthetic oligonucleotide
  Target: ATXN1; (-) strand; PAM type: NRG; PAM sequence: GAG
tccaacctgggaaacagagt

SEQ ID NO: 75500 - DNA, 20 bp, Artificial Sequence
  Description of Artificial Sequence: Synthetic oligonucleotide
  Target: ATXN1; (-) strand; PAM type: NRG; PAM sequence: GAG
gcactccaacctgggaaaca

SEQ ID NO: 75501 - DNA, 20 bp, Artificial Sequence
  Description of Artificial Sequence: Synthetic oligonucleotide
  Target: ATXN1; (-) strand; PAM type: NRG; PAM sequence: CAG
ctgcactccaacctgggaaa

SEQ ID NO: 75502 - DNA, 20 bp, Artificial Sequence
  Description of Artificial Sequence: Synthetic oligonucleotide
  Target: ATXN1; (-) strand; PAM type: NRG; PAM sequence: GGG
acaccactgcactccaacct

SEQ ID NO: 75503 - DNA, 20 bp, Artificial Sequence
  Description of Artificial Sequence: Synthetic oligonucleotide
  Target: ATXN1; (-) strand; PAM type: NRG; PAM sequence: TGG
cacaccactgcactccaacc

SEQ ID NO: 75504 - DNA, 20 bp, Artificial Sequence
  Description of Artificial Sequence: Synthetic oligonucleotide
  Target: ATXN1; (-) strand; PAM type: NRG; PAM sequence: GAG
cgagaggttgaggctgaagt

SEQ ID NO: 75505 - DNA, 20 bp, Artificial Sequence
  Description of Artificial Sequence: Synthetic oligonucleotide
  Target: ATXN1; (-) strand; PAM type: NRG; PAM sequence: AAG
agcccgagaggttgaggctg

SEQ ID NO: 75506 - DNA, 20 bp, Artificial Sequence
  Description of Artificial Sequence: Synthetic oligonucleotide
  Target: ATXN1; (-) strand; PAM type: NRG; PAM sequence: AGG
cacctgagcccgagaggttg

SEQ ID NO: 75507 - DNA, 20 bp, Artificial Sequence
  Description of Artificial Sequence: Synthetic oligonucleotide
  Target: ATXN1; (-) strand; PAM type: NRG; PAM sequence: GAG
ccacctgagcccgagaggtt

SEQ ID NO: 75508 - DNA, 20 bp, Artificial Sequence
  Description of Artificial Sequence: Synthetic oligonucleotide
  Target: ATXN1; (-) strand; PAM type: NRG; PAM sequence: AGG
gaggaccacctgagcccgag

SEQ ID NO: 75509 - DNA, 20 bp, Artificial Sequence
  Description of Artificial Sequence: Synthetic oligonucleotide
  Target: ATXN1; (-) strand; PAM type: NRG; PAM sequence: GAG
agaggaccacctgagcccga

SEQ ID NO: 75510 - DNA, 20 bp, Artificial Sequence
  Description of Artificial Sequence: Synthetic oligonucleotide
  Target: ATXN1; (-) strand; PAM type: NRG; PAM sequence: GAG
tgagaggaccacctgagccc

SEQ ID NO: 75511 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgagaggaccacct

SEQ ID NO: 75512 - DNA, 20 bp, Artificial Sequence
  Description of Artificial Sequence: Synthetic oligonucleotide
  Target: ATXN1; (-) strand; PAM type: NRG; PAM sequence: AGG
acccaggaggctgaggtgag

SEQ ID NO: 75513 - DNA, 20 bp, Artificial Sequence
  Description of Artificial Sequence: Synthetic oligonucleotide
  Target: ATXN1; (-) strand; PAM type: NRG; PAM sequence: GAG
tacccaggaggctgaggtga

SEQ ID NO: 75514 - DNA, 20 bp, Artificial Sequence
  Description of Artificial Sequence: Synthetic oligonucleotide
  Target: ATXN1; (-) strand; PAM type: NRG; PAM sequence: GAG
gctacccaggaggctgaggt

SEQ ID NO: 75515 - DNA, 20 bp, Artificial Sequence
  Description of Artificial Sequence: Synthetic oligonucleotide
  Target: ATXN1; (-) strand; PAM type: NRG; PAM sequence: AGG
cccagctacccaggaggctg

SEQ ID NO: 75516 - DNA, 20 bp, Artificial Sequence
  Description of Artificial Sequence: Synthetic oligonucleotide
  Target: ATXN1; (-) strand; PAM type: NRG; PAM sequence: GAG
tcccagctacccaggaggct

SEQ ID NO: 75517 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctacccagg

SEQ ID NO: 75518 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacccag

SEQ ID NO: 75519 - DNA, 20 bp, Artificial Sequence
  Description of Artificial Sequence: Synthetic oligonucleotide
  Target: ATXN1; (-) strand; PAM type: NRG; PAM sequence: AGG
gcctgtagtcccagctaccc

SEQ ID NO: 75520 - DNA, 20 bp, Artificial Sequence
  Description of Artificial Sequence: Synthetic oligonucleotide
  Target: ATXN1; (-) strand; PAM type: NRG; PAM sequence: CAG
tgcctgtagtcccagctacc

SEQ ID NO: 75521 - DNA, 20 bp, Artificial Sequence
  Description of Artificial Sequence: Synthetic oligonucleotide
  Target: ATXN1; (-) strand; PAM type: NRG; PAM sequence: CAG
gtggcgtgtgcctgtagtcc

SEQ ID NO: 75522 - DNA, 20 bp, Artificial Sequence
  Description of Artificial Sequence: Synthetic oligonucleotide
  Target: ATXN1; (-) strand; PAM type: NRG; PAM sequence: TAG
ggcatggtggcgtgtgcctg

SEQ ID NO: 75523 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggcatgg

SEQ ID NO: 75524 - DNA, 20 bp, Artificial Sequence
  Description of Artificial Sequence: Synthetic oligonucleotide
  Target: ATXN1; (-) strand; PAM type: NRG; PAM sequence: TGG
attaaaaaattagccaggca

SEQ ID NO: 75525 - DNA, 20 bp, Artificial Sequence
  Description of Artificial Sequence: Synthetic oligonucleotide
  Target: ATXN1; (-) strand; PAM type: NRG; PAM sequence: AGG
aaaaaattaaaaaattagcc

SEQ ID NO: 75526 - DNA, 20 bp, Artificial Sequence
  Description of Artificial Sequence: Synthetic oligonucleotide
  Target: ATXN1; (-) strand; PAM type: NRG; PAM sequence: CAG
aaaaaaattaaaaaattagc

SEQ ID NO: 75527 - DNA, 20 bp, Artificial Sequence
  Description of Artificial Sequence: Synthetic oligonucleotide
  Target: ATXN1; (-) strand; PAM type: NRG; PAM sequence: TAG
aaaaaaaaaaattaaaaaat

SEQ ID NO: 75528 - DNA, 20 bp, Artificial Sequence
  Description of Artificial Sequence: Synthetic oligonucleotide
  Target: ATXN1; (-) strand; PAM type: NRG; PAM sequence: GAG
cactccagcctgggcaacag

SEQ ID NO: 75529 - DNA, 20 bp, Artificial Sequence
  Description of Artificial Sequence: Synthetic oligonucleotide
  Target: ATXN1; (-) strand; PAM type: NRG; PAM sequence: AGG
tgcactccagcctgggcaac

SEQ ID NO: 75530 - DNA, 20 bp, Artificial Sequence
  Description of Artificial Sequence: Synthetic oligonucleotide
  Target: ATXN1; (-) strand; PAM type: NRG; PAM sequence: CAG
ttgcactccagcctgggcaa

SEQ ID NO: 75531 - DNA, 20 bp, Artificial Sequence
  Description of Artificial Sequence: Synthetic oligonucleotide
  Target: ATXN1; (-) strand; PAM type: NRG; PAM sequence: GGG
gcgccattgcactccagcct

SEQ ID NO: 75532 - DNA, 20 bp, Artificial Sequence
  Description of Artificial Sequence: Synthetic oligonucleotide
  Target: ATXN1; (-) strand; PAM type: NRG; PAM sequence: TGG
tgcgccattgcactccagcc

SEQ ID NO: 75533 - DNA, 20 bp, Artificial Sequence
  Description of Artificial Sequence: Synthetic oligonucleotide
  Target: ATXN1; (-) strand; PAM type: NRG; PAM sequence: CAG
gagattgcgccattgcactc

SEQ ID NO: 75534 - DNA, 20 bp, Artificial Sequence
  Description of Artificial Sequence: Synthetic oligonucleotide
  Target: ATXN1; (-) strand; PAM type: NRG; PAM sequence: GAG
ggcggaggttatggtgagtg

SEQ ID NO: 75535 - DNA, 20 bp, Artificial Sequence
  Description of Artificial Sequence: Synthetic oligonucleotide
  Target: ATXN1; (-) strand; PAM type: NRG; PAM sequence: TGG
aaggcggaggttatggtgag

SEQ ID NO: 75536 - DNA, 20 bp, Artificial Sequence
  Description of Artificial Sequence: Synthetic oligonucleotide
  Target: ATXN1; (-) strand; PAM type: NRG; PAM sequence: GAG
tggaaggcggaggttatggt

SEQ ID NO: 75537 - DNA, 20 bp, Artificial Sequence
  Description of Artificial Sequence: Synthetic oligonucleotide
  Target: ATXN1; (-) strand; PAM type: NRG; PAM sequence: TGG
aacctggaaggcggaggtta

SEQ ID NO: 75538 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctggaaggcgg

SEQ ID NO: 75539 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaacctggaaggcg

SEQ ID NO: 75540 - DNA, 20 bp, Artificial Sequence
  Description of Artificial Sequence: Synthetic oligonucleotide
  Target: ATXN1; (-) strand; PAM type: NRG; PAM sequence: CGG
aattgcttgaacctggaagg

SEQ ID NO: 75541 - DNA, 20 bp, Artificial Sequence
  Description of Artificial Sequence: Synthetic oligonucleotide
  Target: ATXN1; (-) strand; PAM type: NRG; PAM sequence: AGG
gataattgcttgaacctgga

SEQ ID NO: 75542 - DNA, 20 bp, Artificial Sequence
  Description of Artificial Sequence: Synthetic oligonucleotide
  Target: ATXN1; (-) strand; PAM type: NRG; PAM sequence: AAG
ggataattgcttgaacctgg

SEQ ID NO: 75543 - DNA, 20 bp, Artificial Sequence
  Description of Artificial Sequence: Synthetic oligonucleotide
  Target: ATXN1; (-) strand; PAM type: NRG; PAM sequence: TGG
gcaggataattgcttgaacc

SEQ ID NO: 75544 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgaggc

SEQ ID NO: 75545 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 75546 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 75547 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 75548 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctactcagg

SEQ ID NO: 75549 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctactcag

SEQ ID NO: 75550 - DNA, 20 bp, Artificial Sequence
  Description of Artificial Sequence: Synthetic oligonucleotide
  Target: ATXN1; (-) strand; PAM type: NRG; PAM sequence: AGG
gcctgtaatcccagctactc

SEQ ID NO: 75551 - DNA, 20 bp, Artificial Sequence
  Description of Artificial Sequence: Synthetic oligonucleotide
  Target: ATXN1; (-) strand; PAM type: NRG; PAM sequence: CAG
tgcctgtaatcccagctact

SEQ ID NO: 75552 - DNA, 20 bp, Artificial Sequence
  Description of Artificial Sequence: Synthetic oligonucleotide
  Target: ATXN1; (-) strand; PAM type: NRG; PAM sequence: CAG
gtggtgcatgcctgtaatcc

SEQ ID NO: 75553 - DNA, 20 bp, Artificial Sequence
  Description of Artificial Sequence: Synthetic oligonucleotide
  Target: ATXN1; (-) strand; PAM type: NRG; PAM sequence: TGG
acaaaattagctggacgtgg

SEQ ID NO: 75554 - DNA, 20 bp, Artificial Sequence
  Description of Artificial Sequence: Synthetic oligonucleotide
  Target: ATXN1; (-) strand; PAM type: NRG; PAM sequence: TGG
aatacaaaattagctggacg

SEQ ID NO: 75555 - DNA, 20 bp, Artificial Sequence
  Description of Artificial Sequence: Synthetic oligonucleotide
  Target: ATXN1; (-) strand; PAM type: NRG; PAM sequence: TGG
actaaaaatacaaaattagc

SEQ ID NO: 75556 - DNA, 20 bp, Artificial Sequence
  Description of Artificial Sequence: Synthetic oligonucleotide
  Target: ATXN1; (-) strand; PAM type: NRG; PAM sequence: TAG
ctctactaaaaatacaaaat

SEQ ID NO: 75557 - DNA, 20 bp, Artificial Sequence
  Description of Artificial Sequence: Synthetic oligonucleotide
  Target: ATXN1; (-) strand; PAM type: NRG; PAM sequence: GAG
agaccatcctggccaacatg

SEQ ID NO: 75558 - DNA, 20 bp, Artificial Sequence
  Description of Artificial Sequence: Synthetic oligonucleotide
  Target: ATXN1; (-) strand; PAM type: NRG; PAM sequence: TGG
cgagaccatcctggccaaca

SEQ ID NO: 75559 - DNA, 20 bp, Artificial Sequence
  Description of Artificial Sequence: Synthetic oligonucleotide
  Target: ATXN1; (-) strand; PAM type: NRG; PAM sequence: TGG
catgctggtcgagaccatcc

SEQ ID NO: 75560 - DNA, 20 bp, Artificial Sequence
  Description of Artificial Sequence: Synthetic oligonucleotide
  Target: ATXN1; (-) strand; PAM type: NRG; PAM sequence: GAG
tgggagaccacatgctggtc

SEQ ID NO: 75561 - DNA, 20 bp, Artificial Sequence
  Description of Artificial Sequence: Synthetic oligonucleotide
  Target: ATXN1; (-) strand; PAM type: NRG; PAM sequence: TGG
cactttgggagaccacatgc

SEQ ID NO: 75562 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcacagcactttgg

SEQ ID NO: 75563 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcacagcacttt

SEQ ID NO: 75564 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcacagcactt

SEQ ID NO: 75565 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatca

SEQ ID NO: 75566 - DNA, 20 bp, Artificial Sequence
  Description of Artificial Sequence: Synthetic oligonucleotide
  Target: ATXN1; (-) strand; PAM type: NRG; PAM sequence: TGG
aaaaaaatagttgggcgcag

SEQ ID NO: 75567 - DNA, 20 bp, Artificial Sequence
  Description of Artificial Sequence: Synthetic oligonucleotide
  Target: ATXN1; (-) strand; PAM type: NRG; PAM sequence: CAG
attaaaaaaatagttgggcg

SEQ ID NO: 75568 - DNA, 20 bp, Artificial Sequence
  Description of Artificial Sequence: Synthetic oligonucleotide
  Target: ATXN1; (-) strand; PAM type: NRG; PAM sequence: GGG
aaaaaattaaaaaaatagtt

SEQ ID NO: 75569 - DNA, 20 bp, Artificial Sequence
  Description of Artificial Sequence: Synthetic oligonucleotide
  Target: ATXN1; (-) strand; PAM type: NRG; PAM sequence: TGG
taaaaaattaaaaaaatagt

SEQ ID NO: 75570 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaaattaaaaaaa

SEQ ID NO: 75571 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggcgacatagc

SEQ ID NO: 75572 - DNA, 20 bp, Artificial Sequence
  Description of Artificial Sequence: Synthetic oligonucleotide
  Target: ATXN1; (-) strand; PAM type: NRG; PAM sequence: TAG
tgagtccagcctgggcgaca

SEQ ID NO: 75573 - DNA, 20 bp, Artificial Sequence
  Description of Artificial Sequence: Synthetic oligonucleotide
  Target: ATXN1; (-) strand; PAM type: NRG; PAM sequence: GGG
cagtagtttgagtccagcct

SEQ ID NO: 75574 - DNA, 20 bp, Artificial Sequence
  Description of Artificial Sequence: Synthetic oligonucleotide
  Target: ATXN1; (-) strand; PAM type: NRG; PAM sequence: TGG
ccagtagtttgagtccagcc

SEQ ID NO: 75575 - DNA, 20 bp, Artificial Sequence
  Description of Artificial Sequence: Synthetic oligonucleotide
  Target: ATXN1; (-) strand; PAM type: NRG; PAM sequence: CAG
ggagaccagtagtttgagtc

SEQ ID NO: 75576 - DNA, 20 bp, Artificial Sequence
  Description of Artificial Sequence: Synthetic oligonucleotide
  Target: ATXN1; (-) strand; PAM type: NRG; PAM sequence: GAG
ttgctggagaccagtagttt

SEQ ID NO: 75577 - DNA, 20 bp, Artificial Sequence
  Description of Artificial Sequence: Synthetic oligonucleotide
  Target: ATXN1; (-) strand; PAM type: NRG; PAM sequence: TAG
ggaagattgctggagaccag

SEQ ID NO: 75578 - DNA, 20 bp, Artificial Sequence
  Description of Artificial Sequence: Synthetic oligonucleotide
  Target: ATXN1; (-) strand; PAM type: NRG; PAM sequence: CAG
gtgggaagattgctggagac

SEQ ID NO: 75579 - DNA, 20 bp, Artificial Sequence
  Description of Artificial Sequence: Synthetic oligonucleotide
  Target: ATXN1; (-) strand; PAM type: NRG; PAM sequence: GAG
cctaggtgggaagattgctg

SEQ ID NO: 75580 - DNA, 20 bp, Artificial Sequence
  Description of Artificial Sequence: Synthetic oligonucleotide
  Target: ATXN1; (-) strand; PAM type: NRG; PAM sequence: TGG
ggcctaggtgggaagattgc

SEQ ID NO: 75581 - DNA, 20 bp, Artificial Sequence
  Description of Artificial Sequence: Synthetic oligonucleotide
  Target: ATXN1; (-) strand; PAM type: NRG; PAM sequence: AAG
ctttgggaggcctaggtggg

SEQ ID NO: 75582 - DNA, 20 bp, Artificial Sequence
  Description of Artificial Sequence: Synthetic oligonucleotide
  Target: ATXN1; (-) strand; PAM type: NRG; PAM sequence: GGG
gttctttgggaggcctaggt

SEQ ID NO: 75583 - DNA, 20 bp, Artificial Sequence
  Description of Artificial Sequence: Synthetic oligonucleotide
  Target: ATXN1; (-) strand; PAM type: NRG; PAM sequence: TGG
agttctttgggaggcctagg

SEQ ID NO: 75584 - DNA, 20 bp, Artificial Sequence
  Description of Artificial Sequence: Synthetic oligonucleotide
  Target: ATXN1; (-) strand; PAM type: NRG; PAM sequence: AGG
cccagttctttgggaggcct

SEQ ID NO: 75585 - DNA, 20 bp, Artificial Sequence
  Description of Artificial Sequence: Synthetic oligonucleotide
  Target: ATXN1; (-) strand; PAM type: NRG; PAM sequence: TAG
tcccagttctttgggaggcc

SEQ ID NO: 75586 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagttctttggg

SEQ ID NO: 75587 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagttctttgg

SEQ ID NO: 75588 - DNA, 20 bp, Artificial Sequence
  Description of Artificial Sequence: Synthetic oligonucleotide
  Target: ATXN1; (-) strand; PAM type: NRG; PAM sequence: GGG
acctgtagtcccagttcttt

SEQ ID NO: 75589 - DNA, 20 bp, Artificial Sequence
  Description of Artificial Sequence: Synthetic oligonucleotide
  Target: ATXN1; (-) strand; PAM type: NRG; PAM sequence: TGG
cacctgtagtcccagttctt

SEQ ID NO: 75590 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtagtcc

SEQ ID NO: 75591 - DNA, 20 bp, Artificial Sequence
  Description of Artificial Sequence: Synthetic oligonucleotide
  Target: ATXN1; (-) strand; PAM type: NRG; PAM sequence: TAG
ggcactgtggctcacacctg

SEQ ID NO: 75592 - DNA, 20 bp, Artificial Sequence
  Description of Artificial Sequence: Synthetic oligonucleotide
  Target: ATXN1; (-) strand; PAM type: NRG; PAM sequence: TGG
taggttacagctgggcactg

SEQ ID NO: 75593 - DNA, 20 bp, Artificial Sequence
  Description of Artificial Sequence: Synthetic oligonucleotide
  Target: ATXN1; (-) strand; PAM type: NRG; PAM sequence: GGG
taaatgaataggttacagct

SEQ ID NO: 75594 - DNA, 20 bp, Artificial Sequence
  Description of Artificial Sequence: Synthetic oligonucleotide
  Target: ATXN1; (-) strand; PAM type: NRG; PAM sequence: TGG
gtaaatgaataggttacagc

SEQ ID NO: 75595 - DNA, 20 bp, Artificial Sequence
  Description of Artificial Sequence: Synthetic oligonucleotide
  Target: ATXN1; (-) strand; PAM type: NRG; PAM sequence: CAG
catggtaaatgaataggtta

SEQ ID NO: 75596 - DNA, 20 bp, Artificial Sequence
  Description of Artificial Sequence: Synthetic oligonucleotide
  Target: ATXN1; (-) strand; PAM type: NRG; PAM sequence: AGG
tagtctcatggtaaatgaat

SEQ ID NO: 75597 - DNA, 20 bp, Artificial Sequence
  Description of Artificial Sequence: Synthetic oligonucleotide
  Target: ATXN1; (-) strand; PAM type: NRG; PAM sequence: TAG
atagtctcatggtaaatgaa

SEQ ID NO: 75598 - DNA, 20 bp, Artificial Sequence
  Description of Artificial Sequence: Synthetic oligonucleotide
  Target: ATXN1; (-) strand; PAM type: NRG; PAM sequence: TGG
aaaggagtttaatagtctca

SEQ ID NO: 75599 - DNA, 20 bp, Artificial Sequence
  Description of Artificial Sequence: Synthetic oligonucleotide
  Target: ATXN1; (-) strand; PAM type: NRG; PAM sequence: TAG
tcaatttaaaaggagtttaa

SEQ ID NO: 75600 - DNA, 20 bp, Artificial Sequence
  Description of Artificial Sequence: Synthetic oligonucleotide
  Target: ATXN1; (-) strand; PAM type: NRG; PAM sequence: GAG
attataattcaatttaaaag

SEQ ID NO: 75601 - DNA, 20 bp, Artificial Sequence
  Description of Artificial Sequence: Synthetic oligonucleotide
  Target: ATXN1; (-) strand; PAM type: NRG; PAM sequence: AGG
gaattataattcaatttaaa

SEQ ID NO: 75602 - DNA, 20 bp, Artificial Sequence
  Description of Artificial Sequence: Synthetic oligonucleotide
  Target: ATXN1; (-) strand; PAM type: NRG; PAM sequence: AAG
agaattataattcaatttaa

SEQ ID NO: 75603 - DNA, 20 bp, Artificial Sequence
  Description of Artificial Sequence: Synthetic oligonucleotide
  Target: ATXN1; (-) strand; PAM type: NRG; PAM sequence: TAG
caatagctgtggccatggaa

SEQ ID NO: 75604 - DNA, 20 bp, Artificial Sequence
  Description of Artificial Sequence: Synthetic oligonucleotide
  Target: ATXN1; (-) strand; PAM type: NRG; PAM sequence: TGG
ctggtcaatagctgtggcca

SEQ ID NO: 75605 - DNA, 20 bp, Artificial Sequence
  Description of Artificial Sequence: Synthetic oligonucleotide
  Target: ATXN1; (-) strand; PAM type: NRG; PAM sequence: TGG
ggtaaactggtcaatagctg

SEQ ID NO: 75606 - DNA, 20 bp, Artificial Sequence
  Description of Artificial Sequence: Synthetic oligonucleotide
  Target: ATXN1; (-) strand; PAM type: NRG; PAM sequence: TAG
acttagggtaaactggtcaa

SEQ ID NO: 75607 - DNA, 20 bp, Artificial Sequence
  Description of Artificial Sequence: Synthetic oligonucleotide
  Target: ATXN1; (-) strand; PAM type: NRG; PAM sequence: TGG
accatatacttagggtaaac

SEQ ID NO: 75608 - DNA, 20 bp, Artificial Sequence
  Description of Artificial Sequence: Synthetic oligonucleotide
  Target: ATXN1; (-) strand; PAM type: NRG; PAM sequence: GGG
tgcaaagaaccatatactta

SEQ ID NO: 75609 - DNA, 20 bp, Artificial Sequence
  Description of Artificial Sequence: Synthetic oligonucleotide
  Target: ATXN1; (-) strand; PAM type: NRG; PAM sequence: AGG
ttgcaaagaaccatatactt

SEQ ID NO: 75610 - DNA, 20 bp, Artificial Sequence
  Description of Artificial Sequence: Synthetic oligonucleotide
  Target: ATXN1; (-) strand; PAM type: NRG; PAM sequence: TAG
gttgcaaagaaccatatact

SEQ ID NO: 75611 - DNA, 20 bp, Artificial Sequence
  Description of Artificial Sequence: Synthetic oligonucleotide
  Target: ATXN1; (-) strand; PAM type: NRG; PAM sequence: AAG
ctcattttaattatgttgca

SEQ ID NO: 75612 - DNA, 20 bp, Artificial Sequence
  Description of Artificial Sequence: Synthetic oligonucleotide
  Target: ATXN1; (-) strand; PAM type: NRG; PAM sequence: TGG
tgatcaaattaagacttttt

SEQ ID NO: 75613 - DNA, 20 bp, Artificial Sequence
  Description of Artificial Sequence: Synthetic oligonucleotide
  Target: ATXN1; (-) strand; PAM type: NRG; PAM sequence: AAG
taaataaaaatgatcaaatt

SEQ ID NO: 75614 - DNA, 20 bp, Artificial Sequence
  Description of Artificial Sequence: Synthetic oligonucleotide
  Target: ATXN1; (-) strand; PAM type: NRG; PAM sequence: TAG
catcatggtaatgaaattaa

SEQ ID NO: 75615 - DNA, 20 bp, Artificial Sequence
  Description of Artificial Sequence: Synthetic oligonucleotide
  Target: ATXN1; (-) strand; PAM type: NRG; PAM sequence: TGG
tgacgcaaacataagcatca

SEQ ID NO: 75616 - DNA, 20 bp, Artificial Sequence
  Description of Artificial Sequence: Synthetic oligonucleotide
  Target: ATXN1; (-) strand; PAM type: NRG; PAM sequence: AAG
agatgttatgacgcaaacat

SEQ ID NO: 75617 - DNA, 20 bp, Artificial Sequence
  Description of Artificial Sequence: Synthetic oligonucleotide
  Target: ATXN1; (-) strand; PAM type: NRG; PAM sequence: CAG
ttatattactaagattccat

SEQ ID NO: 75618 - DNA, 20 bp, Artificial Sequence
  Description of Artificial Sequence: Synthetic oligonucleotide
  Target: ATXN1; (-) strand; PAM type: NRG; PAM sequence: AAG
gaattttgccttatattact

SEQ ID NO: 75619 - DNA, 20 bp, Artificial Sequence
  Description of Artificial Sequence: Synthetic oligonucleotide
  Target: ATXN1; (-) strand; PAM type: NRG; PAM sequence: AAG
aaggaccagcataatgaaca

SEQ ID NO: 75620 - DNA, 20 bp, Artificial Sequence
  Description of Artificial Sequence: Synthetic oligonucleotide
  Target: ATXN1; (-) strand; PAM type: NRG; PAM sequence: CAG
gacatccctgattgaaggac

SEQ ID NO: 75621 - DNA, 20 bp, Artificial Sequence
  Description of Artificial Sequence: Synthetic oligonucleotide
  Target: ATXN1; (-) strand; PAM type: NRG; PAM sequence: AGG
atgaggacatccctgattga

SEQ ID NO: 75622 - DNA, 20 bp, Artificial Sequence
  Description of Artificial Sequence: Synthetic oligonucleotide
  Target: ATXN1; (-) strand; PAM type: NRG; PAM sequence: AAG
aatgaggacatccctgattg

SEQ ID NO: 75623 - DNA, 20 bp, Artificial Sequence
  Description of Artificial Sequence: Synthetic oligonucleotide
  Target: ATXN1; (-) strand; PAM type: NRG; PAM sequence: AGG
gagcaatgcttgaatgaatg

SEQ ID NO: 75624 - DNA, 20 bp, Artificial Sequence
  Description of Artificial Sequence: Synthetic oligonucleotide
  Target: ATXN1; (-) strand; PAM type: NRG; PAM sequence: GAG
agagcaatgcttgaatgaat

SEQ ID NO: 75625 - DNA, 20 bp, Artificial Sequence
  Description of Artificial Sequence: Synthetic oligonucleotide
  Target: ATXN1; (-) strand; PAM type: NRG; PAM sequence: GAG
cgagctgaatcttaaaggaa

SEQ ID NO: 75626 - DNA, 20 bp, Artificial Sequence
  Description of Artificial Sequence: Synthetic oligonucleotide
  Target: ATXN1; (-) strand; PAM type: NRG; PAM sequence: AAG
atcgagctgaatcttaaagg

SEQ ID NO: 75627 - DNA, 20 bp, Artificial Sequence
  Description of Artificial Sequence: Synthetic oligonucleotide
  Target: ATXN1; (-) strand; PAM type: NRG; PAM sequence: AGG
gacatcgagctgaatcttaa

SEQ ID NO: 75628 - DNA, 20 bp, Artificial Sequence
  Description of Artificial Sequence: Synthetic oligonucleotide
  Target: ATXN1; (-) strand; PAM type: NRG; PAM sequence: AAG
tgacatcgagctgaatctta

SEQ ID NO: 75629 - DNA, 20 bp, Artificial Sequence
  Description of Artificial Sequence: Synthetic oligonucleotide
  Target: ATXN1; (-) strand; PAM type: NRG; PAM sequence: GAG
gtcacaaaggaagtgacatc

SEQ ID NO: 75630 - DNA, 20 bp, Artificial Sequence
  Description of Artificial Sequence: Synthetic oligonucleotide
  Target: ATXN1; (-) strand; PAM type: NRG; PAM sequence: AAG
atgggagcatgtcacaaagg

SEQ ID NO: 75631 - DNA, 20 bp, Artificial Sequence
  Description of Artificial Sequence: Synthetic oligonucleotide
  Target: ATXN1; (-) strand; PAM type: NRG; PAM sequence: AGG
tgtatgggagcatgtcacaa

SEQ ID NO: 75632 - DNA, 20 bp, Artificial Sequence
  Description of Artificial Sequence: Synthetic oligonucleotide
  Target: ATXN1; (-) strand; PAM type: NRG; PAM sequence: AAG
atgtatgggagcatgtcaca

SEQ ID NO: 75633 - DNA, 20 bp, Artificial Sequence
  Description of Artificial Sequence: Synthetic oligonucleotide
  Target: ATXN1; (-) strand; PAM type: NRG; PAM sequence: GAG
ggaaaatacaatatgtatgg

SEQ ID NO: 75634 - DNA, 20 bp, Artificial Sequence
  Description of Artificial Sequence: Synthetic oligonucleotide
  Target: ATXN1; (-) strand; PAM type: NRG; PAM sequence: GGG
agggaaaatacaatatgtat

SEQ ID NO: 75635 - DNA, 20 bp, Artificial Sequence
  Description of Artificial Sequence: Synthetic oligonucleotide
  Target: ATXN1; (-) strand; PAM type: NRG; PAM sequence: TGG
cagggaaaatacaatatgta

SEQ ID NO: 75636 - DNA, 20 bp, Artificial Sequence
  Description of Artificial Sequence: Synthetic oligonucleotide
  Target: ATXN1; (-) strand; PAM type: NRG; PAM sequence: GGG
agacagatcattacacggca

SEQ ID NO: 75637 - DNA, 20 bp, Artificial Sequence
  Description of Artificial Sequence: Synthetic oligonucleotide
  Target: ATXN1; (-) strand; PAM type: NRG; PAM sequence: AGG
gagacagatcattacacggc

SEQ ID NO: 75638 - DNA, 20 bp, Artificial Sequence
  Description of Artificial Sequence: Synthetic oligonucleotide
  Target: ATXN1; (-) strand; PAM type: NRG; PAM sequence: CAG
ggagacagatcattacacgg

SEQ ID NO: 75639 - DNA, 20 bp, Artificial Sequence
  Description of Artificial Sequence: Synthetic oligonucleotide
  Target: ATXN1; (-) strand; PAM type: NRG; PAM sequence: CGG
aagggagacagatcattaca

SEQ ID NO: 75640 - DNA, 20 bp, Artificial Sequence
  Description of Artificial Sequence: Synthetic oligonucleotide
  Target: ATXN1; (-) strand; PAM type: NRG; PAM sequence: CAG
tcatagtctagaaagggaga

SEQ ID NO: 75641 - DNA, 20 bp, Artificial Sequence
  Description of Artificial Sequence: Synthetic oligonucleotide
  Target: ATXN1; (-) strand; PAM type: NRG; PAM sequence: GAG
gagctcatagtctagaaagg

SEQ ID NO: 75642 - DNA, 20 bp, Artificial Sequence
  Description of Artificial Sequence: Synthetic oligonucleotide
  Target: ATXN1; (-) strand; PAM type: NRG; PAM sequence: GGG
aggagctcatagtctagaaa

SEQ ID NO: 75643 - DNA, 20 bp, Artificial Sequence
  Description of Artificial Sequence: Synthetic oligonucleotide
  Target: ATXN1; (-) strand; PAM type: NRG; PAM sequence: AGG
aaggagctcatagtctagaa

SEQ ID NO: 75644 - DNA, 20 bp, Artificial Sequence
  Description of Artificial Sequence: Synthetic oligonucleotide
  Target: ATXN1; (-) strand; PAM type: NRG; PAM sequence: AAG
taaggagctcatagtctaga

SEQ ID NO: 75645 - DNA, 20 bp, Artificial Sequence
  Description of Artificial Sequence: Synthetic oligonucleotide
  Target: ATXN1; (-) strand; PAM type: NRG; PAM sequence: TAG
cccctaaggagctcatagtc

SEQ ID NO: 75646 - DNA, 20 bp, Artificial Sequence
  Description of Artificial Sequence: Synthetic oligonucleotide
  Target: ATXN1; (-) strand; PAM type: NRG; PAM sequence: TAG
tggggcccctaaggagctca

SEQ ID NO: 75647 - DNA, 20 bp, Artificial Sequence
  Description of Artificial Sequence: Synthetic oligonucleotide
  Target: ATXN1; (-) strand; PAM type: NRG; PAM sequence: GAG
acctcgctggggcccctaag

SEQ ID NO: 75648 - DNA, 20 bp, Artificial Sequence
  Description of Artificial Sequence: Synthetic oligonucleotide
  Target: ATXN1; (-) strand; PAM type: NRG; PAM sequence: AGG
agacctcgctggggccccta

SEQ ID NO: 75649 - DNA, 20 bp, Artificial Sequence
  Description of Artificial Sequence: Synthetic oligonucleotide
  Target: ATXN1; (-) strand; PAM type: NRG; PAM sequence: AAG
gagacctcgctggggcccct

SEQ ID NO: 75650 - DNA, 20 bp, Artificial Sequence
  Description of Artificial Sequence: Synthetic oligonucleotide
  Target: ATXN1; (-) strand; PAM type: NRG; PAM sequence: GGG
aaaatacagagacctcgctg

SEQ ID NO: 75651 - DNA, 20 bp, Artificial Sequence
  Description of Artificial Sequence: Synthetic oligonucleotide
  Target: ATXN1; (-) strand; PAM type: NRG; PAM sequence: GGG
aaaaatacagagacctcgct

SEQ ID NO: 75652 - DNA, 20 bp, Artificial Sequence
  Description of Artificial Sequence: Synthetic oligonucleotide
  Target: ATXN1; (-) strand; PAM type: NRG; PAM sequence: TGG
gaaaaatacagagacctcgc

SEQ ID NO: 75653 - DNA, 20 bp, Artificial Sequence
  Description of Artificial Sequence: Synthetic oligonucleotide
  Target: ATXN1; (-) strand; PAM type: NRG; PAM sequence: GAG
agtttgttatgaaaaataca

SEQ ID NO: 75654 - DNA, 20 bp, Artificial Sequence
  Description of Artificial Sequence: Synthetic oligonucleotide
  Target: ATXN1; (-) strand; PAM type: NRG; PAM sequence: CAG
gcagtttgttatgaaaaata

SEQ ID NO: 75655 - DNA, 20 bp, Artificial Sequence
  Description of Artificial Sequence: Synthetic oligonucleotide
  Target: ATXN1; (-) strand; PAM type: NRG; PAM sequence: CAG
attctgtgcaaagaattgtg

SEQ ID NO: 75656 - DNA, 20 bp, Artificial Sequence
  Description of Artificial Sequence: Synthetic oligonucleotide
  Target: ATXN1; (-) strand; PAM type: NRG; PAM sequence: AAG
ctgagagtatattctgtgca

SEQ ID NO: 75657 - DNA, 20 bp, Artificial Sequence
  Description of Artificial Sequence: Synthetic oligonucleotide
  Target: ATXN1; (-) strand; PAM type: NRG; PAM sequence: GAG
atcaaaccagtgtttactga

SEQ ID NO: 75658 - DNA, 20 bp, Artificial Sequence
  Description of Artificial Sequence: Synthetic oligonucleotide
  Target: ATXN1; (-) strand; PAM type: NRG; PAM sequence: GAG
acatcaaaccagtgtttact

SEQ ID NO: 75659 - DNA, 20 bp, Artificial Sequence
  Description of Artificial Sequence: Synthetic oligonucleotide
  Target: ATXN1; (-) strand; PAM type: NRG; PAM sequence: CAG
tattcacccacacatcaaac

SEQ ID NO: 75660 - DNA, 20 bp, Artificial Sequence
  Description of Artificial Sequence: Synthetic oligonucleotide
  Target: ATXN1; (-) strand; PAM type: NRG; PAM sequence: AAG
ccatagtcataagagtatca

SEQ ID NO: 75661 - DNA, 20 bp, Artificial Sequence
  Description of Artificial Sequence: Synthetic oligonucleotide
  Target: ATXN1; (-) strand; PAM type: NRG; PAM sequence: GAG
ccttttcaccatagtcataa

SEQ ID NO: 75662 - DNA, 20 bp, Artificial Sequence
  Description of Artificial Sequence: Synthetic oligonucleotide
  Target: ATXN1; (-) strand; PAM type: NRG; PAM sequence: AAG
ggccttttcaccatagtcat

SEQ ID NO: 75663 - DNA, 20 bp, Artificial Sequence
  Description of Artificial Sequence: Synthetic oligonucleotide
  Target: ATXN1; (-) strand; PAM type: NRG; PAM sequence: TAG
aattagtggccttttcacca

SEQ ID NO: 75664 - DNA, 20 bp, Artificial Sequence
  Description of Artificial Sequence: Synthetic oligonucleotide
  Target: ATXN1; (-) strand; PAM type: NRG; PAM sequence: TGG
taagttgaaatcacaattag

SEQ ID NO: 75665 - DNA, 20 bp, Artificial Sequence
  Description of Artificial Sequence: Synthetic oligonucleotide
  Target: ATXN1; (-) strand; PAM type: NRG; PAM sequence: TAG
ctttaagttgaaatcacaat

SEQ ID NO: 75666 - DNA, 20 bp, Artificial Sequence
  Description of Artificial Sequence: Synthetic oligonucleotide
  Target: ATXN1; (-) strand; PAM type: NRG; PAM sequence: AAG
tttttttggctttaaccttt

SEQ ID NO: 75667 - DNA, 20 bp, Artificial Sequence
  Description of Artificial Sequence: Synthetic oligonucleotide
  Target: ATXN1; (-) strand; PAM type: NRG; PAM sequence: TGG
actaaaaaatggattttttt

SEQ ID NO: 75668 - DNA, 20 bp, Artificial Sequence
  Description of Artificial Sequence: Synthetic oligonucleotide
  Target: ATXN1; (-) strand; PAM type: NRG; PAM sequence: TGG
agtttcatttcactaaaaaa

SEQ ID NO: 75669 - DNA, 20 bp, Artificial Sequence
  Description of Artificial Sequence: Synthetic oligonucleotide
  Target: ATXN1; (-) strand; PAM type: NRG; PAM sequence: GAG
tctggaagtgaaaacgctaa

SEQ ID NO: 75670 - DNA, 20 bp, Artificial Sequence
  Description of Artificial Sequence: Synthetic oligonucleotide
  Target: ATXN1; (-) strand; PAM type: NRG; PAM sequence: AAG
catctggaagtgaaaacgct

SEQ ID NO: 75671 - DNA, 20 bp, Artificial Sequence
  Description of Artificial Sequence: Synthetic oligonucleotide
  Target: ATXN1; (-) strand; PAM type: NRG; PAM sequence: AAG
tgtaatgctgatgcatctgg

SEQ ID NO: 75672 - DNA, 20 bp, Artificial Sequence
  Description of Artificial Sequence: Synthetic oligonucleotide
  Target: ATXN1; (-) strand; PAM type: NRG; PAM sequence: TGG
ttatgtaatgctgatgcatc

SEQ ID NO: 75673 - DNA, 20 bp, Artificial Sequence
  Description of Artificial Sequence: Synthetic oligonucleotide
  Target: ATXN1; (-) strand; PAM type: NRG; PAM sequence: TAG
agcatgactattttttaaaa

SEQ ID NO: 75674 - DNA, 20 bp, Artificial Sequence
  Description of Artificial Sequence: Synthetic oligonucleotide
  Target: ATXN1; (-) strand; PAM type: NRG; PAM sequence: CAG
ttctcagacaggaaaatgcg

SEQ ID NO: 75675 - DNA, 20 bp, Artificial Sequence
  Description of Artificial Sequence: Synthetic oligonucleotide
  Target: ATXN1; (-) strand; PAM type: NRG; PAM sequence: AGG
tttcagtctaattctcagac

SEQ ID NO: 75676 - DNA, 20 bp, Artificial Sequence
  Description of Artificial Sequence: Synthetic oligonucleotide
  Target: ATXN1; (-) strand; PAM type: NRG; PAM sequence: CAG
ttttcagtctaattctcaga

SEQ ID NO: 75677 - DNA, 20 bp, Artificial Sequence
  Description of Artificial Sequence: Synthetic oligonucleotide
  Target: ATXN1; (-) strand; PAM type: NRG; PAM sequence: CAG
ggtattttcagtctaattct

SEQ ID NO: 75678 - DNA, 20 bp, Artificial Sequence
  Description of Artificial Sequence: Synthetic oligonucleotide
  Target: ATXN1; (-) strand; PAM type: NRG; PAM sequence: CAG
cctggggaatttggtatttt

SEQ ID NO: 75679 - DNA, 20 bp, Artificial Sequence
  Description of Artificial Sequence: Synthetic oligonucleotide
  Target: ATXN1; (-) strand; PAM type: NRG; PAM sequence: TGG
ccaggggcccctggggaatt

SEQ ID NO: 75680 - DNA, 20 bp, Artificial Sequence
  Description of Artificial Sequence: Synthetic oligonucleotide
  Target: ATXN1; (-) strand; PAM type: NRG; PAM sequence: GGG
agaacacccaggggcccctg

SEQ ID NO: 75681 - DNA, 20 bp, Artificial Sequence
  Description of Artificial Sequence: Synthetic oligonucleotide
  Target: ATXN1; (-) strand; PAM type: NRG; PAM sequence: GGG
tagaacacccaggggcccct

SEQ ID NO: 75682 - DNA, 20 bp, Artificial Sequence
  Description of Artificial Sequence: Synthetic oligonucleotide
  Target: ATXN1; (-) strand; PAM type: NRG; PAM sequence: TGG
ttagaacacccaggggcccc

SEQ ID NO: 75683 - DNA, 20 bp, Artificial Sequence
  Description of Artificial Sequence: Synthetic oligonucleotide
  Target: ATXN1; (-) strand; PAM type: NRG; PAM sequence: GGG
tttgtctttagaacacccag

SEQ ID NO: 75684 - DNA, 20 bp, Artificial Sequence
  Description of Artificial Sequence: Synthetic oligonucleotide
  Target: ATXN1; (-) strand; PAM type: NRG; PAM sequence: GGG
atttgtctttagaacaccca

SEQ ID NO: 75685 - DNA, 20 bp, Artificial Sequence
  Description of Artificial Sequence: Synthetic oligonucleotide
  Target: ATXN1; (-) strand; PAM type: NRG; PAM sequence: AGG
catttgtctttagaacaccc

SEQ ID NO: 75686 - DNA, 20 bp, Artificial Sequence
  Description of Artificial Sequence: Synthetic oligonucleotide
  Target: ATXN1; (-) strand; PAM type: NRG; PAM sequence: CAG
acatttgtctttagaacacc

SEQ ID NO: 75687 - DNA, 20 bp, Artificial Sequence
  Description of Artificial Sequence: Synthetic oligonucleotide
  Target: ATXN1; (-) strand; PAM type: NRG; PAM sequence: TAG
gctaactgaacatttgtctt

SEQ ID NO: 75688 - DNA, 20 bp, Artificial Sequence
  Description of Artificial Sequence: Synthetic oligonucleotide
  Target: ATXN1; (-) strand; PAM type: NRG; PAM sequence: TAG
aaatgagtgcatggaatcaa

SEQ ID NO: 75689 - DNA, 20 bp, Artificial Sequence
  Description of Artificial Sequence: Synthetic oligonucleotide
  Target: ATXN1; (-) strand; PAM type: NRG; PAM sequence: TGG
atttccattaaatgagtgca

SEQ ID NO: 75690 - DNA, 20 bp, Artificial Sequence
  Description of Artificial Sequence: Synthetic oligonucleotide
  Target: ATXN1; (-) strand; PAM type: NRG; PAM sequence: GAG
actccggatttccattaaat

SEQ ID NO: 75691 - DNA, 20 bp, Artificial Sequence
  Description of Artificial Sequence: Synthetic oligonucleotide
  Target: ATXN1; (-) strand; PAM type: NRG; PAM sequence: CGG
ggggaggttgagtcttactc

SEQ ID NO: 75692 - DNA, 20 bp, Artificial Sequence
  Description of Artificial Sequence: Synthetic oligonucleotide
  Target: ATXN1; (-) strand; PAM type: NRG; PAM sequence: GAG
aggctggtggtggggaggtt

SEQ ID NO: 75693 - DNA, 20 bp, Artificial Sequence
  Description of Artificial Sequence: Synthetic oligonucleotide
  Target: ATXN1; (-) strand; PAM type: NRG; PAM sequence: AGG
gtgacaggctggtggtgggg

SEQ ID NO: 75694 - DNA, 20 bp, Artificial Sequence
  Description of Artificial Sequence: Synthetic oligonucleotide
  Target: ATXN1; (-) strand; PAM type: NRG; PAM sequence: GAG
agtgacaggctggtggtggg

SEQ ID NO: 75695 - DNA, 20 bp, Artificial Sequence
  Description of Artificial Sequence: Synthetic oligonucleotide
  Target: ATXN1; (-) strand; PAM type: NRG; PAM sequence: GGG
tgagtgacaggctggtggtg

SEQ ID NO: 75696 - DNA, 20 bp, Artificial Sequence
  Description of Artificial Sequence: Synthetic oligonucleotide
  Target: ATXN1; (-) strand; PAM type: NRG; PAM sequence: GGG
atgagtgacaggctggtggt

SEQ ID NO: 75697 - DNA, 20 bp, Artificial Sequence
  Description of Artificial Sequence: Synthetic oligonucleotide
  Target: ATXN1; (-) strand; PAM type: NRG; PAM sequence: TGG
aatgagtgacaggctggtgg

SEQ ID NO: 75698 - DNA, 20 bp, Artificial Sequence
  Description of Artificial Sequence: Synthetic oligonucleotide
  Target: ATXN1; (-) strand; PAM type: NRG; PAM sequence: TGG
aataatgagtgacaggctgg

SEQ ID NO: 75699 - DNA, 20 bp, Artificial Sequence
  Description of Artificial Sequence: Synthetic oligonucleotide
  Target: ATXN1; (-) strand; PAM type: NRG; PAM sequence: TGG
cagaataatgagtgacaggc

SEQ ID NO: 75700 - DNA, 20 bp, Artificial Sequence
  Description of Artificial Sequence: Synthetic oligonucleotide
  Target: ATXN1; (-) strand; PAM type: NRG; PAM sequence: AGG
tgagcagaataatgagtgac

SEQ ID NO: 75701 - DNA, 20 bp, Artificial Sequence
  Description of Artificial Sequence: Synthetic oligonucleotide
  Target: ATXN1; (-) strand; PAM type: NRG; PAM sequence: CAG
ctgagcagaataatgagtga

SEQ ID NO: 75702 - DNA, 20 bp, Artificial Sequence
  Description of Artificial Sequence: Synthetic oligonucleotide
  Target: ATXN1; (-) strand; PAM type: NRG; PAM sequence: GAG
aaacagctgagcagaataat

SEQ ID NO: 75703 - DNA, 20 bp, Artificial Sequence
  Description of Artificial Sequence: Synthetic oligonucleotide
  Target: ATXN1; (-) strand; PAM type: NRG; PAM sequence: CAG
cttattctgaaacagctgag

SEQ ID NO: 75704 - DNA, 20 bp, Artificial Sequence
  Description of Artificial Sequence: Synthetic oligonucleotide
  Target: ATXN1; (-) strand; PAM type: NRG; PAM sequence: GAG
tcgcttattctgaaacagct

SEQ ID NO: 75705 - DNA, 20 bp, Artificial Sequence
  Description of Artificial Sequence: Synthetic oligonucleotide
  Target: ATXN1; (-) strand; PAM type: NRG; PAM sequence: CAG
agtcgtcgcttattctgaaa

SEQ ID NO: 75706 - DNA, 20 bp, Artificial Sequence
  Description of Artificial Sequence: Synthetic oligonucleotide
  Target: ATXN1; (-) strand; PAM type: NRG; PAM sequence: GAG
ggggggcagagctctcccgg

SEQ ID NO: 75707 - DNA, 20 bp, Artificial Sequence
  Description of Artificial Sequence: Synthetic oligonucleotide
  Target: ATXN1; (-) strand; PAM type: NRG; PAM sequence: GGG
gaggggggcagagctctccc

SEQ ID NO: 75708 - DNA, 20 bp, Artificial Sequence
  Description of Artificial Sequence: Synthetic oligonucleotide
  Target: ATXN1; (-) strand; PAM type: NRG; PAM sequence: CGG
ggaggggggcagagctctcc

SEQ ID NO: 75709 - DNA, 20 bp, Artificial Sequence
  Description of Artificial Sequence: Synthetic oligonucleotide
  Target: ATXN1; (-) strand; PAM type: NRG; PAM sequence: GAG
ccagtactgggaggggggca

SEQ ID NO: 75710 - DNA, 20 bp, Artificial Sequence
  Description of Artificial Sequence: Synthetic oligonucleotide
  Target: ATXN1; (-) strand; PAM type: NRG; PAM sequence: CAG
ggccagtactgggagggggg

SEQ ID NO: 75711 - DNA, 20 bp, Artificial Sequence
  Description of Artificial Sequence: Synthetic oligonucleotide
  Target: ATXN1; (-) strand; PAM type: NRG; PAM sequence: GGG
gctggccagtactgggaggg

SEQ ID NO: 75712 - DNA, 20 bp, Artificial Sequence
  Description of Artificial Sequence: Synthetic oligonucleotide
  Target: ATXN1; (-) strand; PAM type: NRG; PAM sequence: GGG
tgctggccagtactgggagg

SEQ ID NO: 75713 - DNA, 20 bp, Artificial Sequence
  Description of Artificial Sequence: Synthetic oligonucleotide
  Target: ATXN1; (-) strand; PAM type: NRG; PAM sequence: GGG
gtgctggccagtactgggag

SEQ ID NO: 75714 - DNA, 20 bp, Artificial Sequence
  Description of Artificial Sequence: Synthetic oligonucleotide
  Target: ATXN1; (-) strand; PAM type: NRG; PAM sequence: GGG
agtgctggccagtactggga

SEQ ID NO: 75715 - DNA, 20 bp, Artificial Sequence
  Description of Artificial Sequence: Synthetic oligonucleotide
  Target: ATXN1; (-) strand; PAM type: NRG; PAM sequence: AGG
aagtgctggccagtactggg

SEQ ID NO: 75716 - DNA, 20 bp, Artificial Sequence
  Description of Artificial Sequence: Synthetic oligonucleotide
  Target: ATXN1; (-) strand; PAM type: NRG; PAM sequence: GAG
gaagtgctggccagtactgg

SEQ ID NO: 75717 - DNA, 20 bp, Artificial Sequence
  Description of Artificial Sequence: Synthetic oligonucleotide
  Target: ATXN1; (-) strand; PAM type: NRG; PAM sequence: GGG
ctgaagtgctggccagtact

SEQ ID NO: 75718 - DNA, 20 bp, Artificial Sequence
  Description of Artificial Sequence: Synthetic oligonucleotide
  Target: ATXN1; (-) strand; PAM type: NRG; PAM sequence: TGG
actgaagtgctggccagtac

SEQ ID NO: 75719 - DNA, 20 bp, Artificial Sequence
  Description of Artificial Sequence: Synthetic oligonucleotide
  Target: ATXN1; (-) strand; PAM type: NRG; PAM sequence: CAG
atcatcactgaagtgctggc

SEQ ID NO: 75720 - DNA, 20 bp, Artificial Sequence
  Description of Artificial Sequence: Synthetic oligonucleotide
  Target: ATXN1; (-) strand; PAM type: NRG; PAM sequence: TGG
attcatcatcactgaagtgc

SEQ ID NO: 75721 - DNA, 20 bp, Artificial Sequence
  Description of Artificial Sequence: Synthetic oligonucleotide
  Target: ATXN1; (-) strand; PAM type: NRG; PAM sequence: AAG
gctcggattcatcatcactg

SEQ ID NO: 75722 - DNA, 20 bp, Artificial Sequence
  Description of Artificial Sequence: Synthetic oligonucleotide
  Target: ATXN1; (-) strand; PAM type: NRG; PAM sequence: CGG
tactgaaattctctgctgct

SEQ ID NO: 75723 - DNA, 20 bp, Artificial Sequence
  Description of Artificial Sequence: Synthetic oligonucleotide
  Target: ATXN1; (-) strand; PAM type: NRG; PAM sequence: GAG
gactgatgttctgctgcttt

SEQ ID NO: 75724 - DNA, 20 bp, Artificial Sequence
  Description of Artificial Sequence: Synthetic oligonucleotide
  Target: ATXN1; (-) strand; PAM type: NRG; PAM sequence: GGG
ggaagtggaaaatgtaagtt

SEQ ID NO: 75725 - DNA, 20 bp, Artificial Sequence
  Description of Artificial Sequence: Synthetic oligonucleotide
  Target: ATXN1; (-) strand; PAM type: NRG; PAM sequence: TGG
tggaagtggaaaatgtaagt

SEQ ID NO: 75726 - DNA, 20 bp, Artificial Sequence
  Description of Artificial Sequence: Synthetic oligonucleotide
  Target: ATXN1; (-) strand; PAM type: NRG; PAM sequence: AAG
acaatggaagtggaaaatgt

SEQ ID NO: 75727 - DNA, 20 bp, Artificial Sequence
  Description of Artificial Sequence: Synthetic oligonucleotide
  Target: ATXN1; (-) strand; PAM type: NRG; PAM sequence: TGG
aataagaatgacaatggaag

SEQ ID NO: 75728 - DNA, 20 bp, Artificial Sequence
  Description of Artificial Sequence: Synthetic oligonucleotide
  Target: ATXN1; (-) strand; PAM type: NRG; PAM sequence: AAG
aggaataagaatgacaatgg

SEQ ID NO: 75729 - DNA, 20 bp, Artificial Sequence
  Description of Artificial Sequence: Synthetic oligonucleotide
  Target: ATXN1; (-) strand; PAM type: NRG; PAM sequence: TGG
tataggaataagaatgacaa

SEQ ID NO: 75730 - DNA, 20 bp, Artificial Sequence
  Description of Artificial Sequence: Synthetic oligonucleotide
  Target: ATXN1; (-) strand; PAM type: NRG; PAM sequence: AAG
aaataagcccatataggaat

SEQ ID NO: 75731 - DNA, 20 bp, Artificial Sequence
  Description of Artificial Sequence: Synthetic oligonucleotide
  Target: ATXN1; (-) strand; PAM type: NRG; PAM sequence: AGG
tgtgagaaataagcccatat

SEQ ID NO: 75732 - DNA, 20 bp, Artificial Sequence
  Description of Artificial Sequence: Synthetic oligonucleotide
  Target: ATXN1; (-) strand; PAM type: NRG; PAM sequence: TAG
atgtgagaaataagcccata

SEQ ID NO: 75733 - DNA, 20 bp, Artificial Sequence
  Description of Artificial Sequence: Synthetic oligonucleotide
  Target: ATXN1; (-) strand; PAM type: NRG; PAM sequence: AAG
aaggtggatatgtgagaaat

SEQ ID NO: 75734 - DNA, 20 bp, Artificial Sequence
  Description of Artificial Sequence: Synthetic oligonucleotide
  Target: ATXN1; (-) strand; PAM type: NRG; PAM sequence: GAG
aaaatcaaaggtggatatgt

SEQ ID NO: 75735 - DNA, 20 bp, Artificial Sequence
  Description of Artificial Sequence: Synthetic oligonucleotide
  Target: ATXN1; (-) strand; PAM type: NRG; PAM sequence: TGG
cgatcttgaaaaatcaaagg

SEQ ID NO: 75736 - DNA, 20 bp, Artificial Sequence
  Description of Artificial Sequence: Synthetic oligonucleotide
  Target: ATXN1; (-) strand; PAM type: NRG; PAM sequence: AGG
gttcgatcttgaaaaatcaa

SEQ ID NO: 75737 - DNA, 20 bp, Artificial Sequence
  Description of Artificial Sequence: Synthetic oligonucleotide
  Target: ATXN1; (-) strand; PAM type: NRG; PAM sequence: AAG
ggttcgatcttgaaaaatca

SEQ ID NO: 75738 - DNA, 20 bp, Artificial Sequence
  Description of Artificial Sequence: Synthetic oligonucleotide
  Target: ATXN1; (-) strand; PAM type: NRG; PAM sequence: AGG
ccaggccctcaccttttcaa

SEQ ID NO: 75739 - DNA, 20 bp, Artificial Sequence
  Description of Artificial Sequence: Synthetic oligonucleotide
  Target: ATXN1; (-) strand; PAM type: NRG; PAM sequence: AAG
gccaggccctcaccttttca

SEQ ID NO: 75740 - DNA, 20 bp, Artificial Sequence
  Description of Artificial Sequence: Synthetic oligonucleotide
  Target: ATXN1; (-) strand; PAM type: NRG; PAM sequence: AGG
atgtaatatgttaggcagcc

SEQ ID NO: 75741 - DNA, 20 bp, Artificial Sequence
  Description of Artificial Sequence: Synthetic oligonucleotide
  Target: ATXN1; (-) strand; PAM type: NRG; PAM sequence: CAG
gatgtaatatgttaggcagc

SEQ ID NO: 75742 - DNA, 20 bp, Artificial Sequence
  Description of Artificial Sequence: Synthetic oligonucleotide
  Target: ATXN1; (-) strand; PAM type: NRG; PAM sequence: CAG
tgatgatgtaatatgttagg

SEQ ID NO: 75743 - DNA, 20 bp, Artificial Sequence
  Description of Artificial Sequence: Synthetic oligonucleotide
  Target: ATXN1; (-) strand; PAM type: NRG; PAM sequence: AGG
gcgtgatgatgtaatatgtt

SEQ ID NO: 75744 - DNA, 20 bp, Artificial Sequence
  Description of Artificial Sequence: Synthetic oligonucleotide
  Target: ATXN1; (-) strand; PAM type: NRG; PAM sequence: TAG
tgcgtgatgatgtaatatgt

SEQ ID NO: 75745 - DNA, 20 bp, Artificial Sequence
  Description of Artificial Sequence: Synthetic oligonucleotide
  Target: ATXN1; (-) strand; PAM type: NRG; PAM sequence: CGG
ttctgagtgaggcaggagtc

SEQ ID NO: 75746 - DNA, 20 bp, Artificial Sequence
  Description of Artificial Sequence: Synthetic oligonucleotide
  Target: ATXN1; (-) strand; PAM type: NRG; PAM sequence: GAG
tggtcttctgagtgaggcag

SEQ ID NO: 75747 - DNA, 20 bp, Artificial Sequence
  Description of Artificial Sequence: Synthetic oligonucleotide
  Target: ATXN1; (-) strand; PAM type: NRG; PAM sequence: AGG
cgtggtcttctgagtgaggc

SEQ ID NO: 75748 - DNA, 20 bp, Artificial Sequence
  Description of Artificial Sequence: Synthetic oligonucleotide
  Target: ATXN1; (-) strand; PAM type: NRG; PAM sequence: CAG
acgtggtcttctgagtgagg

SEQ ID NO: 75749 - DNA, 20 bp, Artificial Sequence
  Description of Artificial Sequence: Synthetic oligonucleotide
  Target: ATXN1; (-) strand; PAM type: NRG; PAM sequence: AGG
aacacgtggtcttctgagtg

SEQ ID NO: 75750 - DNA, 20 bp, Artificial Sequence
  Description of Artificial Sequence: Synthetic oligonucleotide
  Target: ATXN1; (-) strand; PAM type: NRG; PAM sequence: GAG
caacacgtggtcttctgagt

SEQ ID NO: 75751 - DNA, 20 bp, Artificial Sequence
  Description of Artificial Sequence: Synthetic oligonucleotide
  Target: ATXN1; (-) strand; PAM type: NRG; PAM sequence: GAG
tgagcaacacgtggtcttct

SEQ ID NO: 75752 - DNA, 20 bp, Artificial Sequence
  Description of Artificial Sequence: Synthetic oligonucleotide
  Target: ATXN1; (-) strand; PAM type: NRG; PAM sequence: TGG
tttcttttctgagcaacacg

SEQ ID NO: 75753 - DNA, 20 bp, Artificial Sequence
  Description of Artificial Sequence: Synthetic oligonucleotide
  Target: ATXN1; (-) strand; PAM type: NRG; PAM sequence: GAG
ggtgcccacctttcttttct

SEQ ID NO: 75754 - DNA, 20 bp, Artificial Sequence
  Description of Artificial Sequence: Synthetic oligonucleotide
  Target: ATXN1; (-) strand; PAM type: NRG; PAM sequence: TGG
ttatgagaaacctgttcttt

SEQ ID NO: 75755 - DNA, 20 bp, Artificial Sequence
  Description of Artificial Sequence: Synthetic oligonucleotide
  Target: ATXN1; (-) strand; PAM type: NRG; PAM sequence: GAG
gggcctgggtaggatattat

SEQ ID NO: 75756 - DNA, 20 bp, Artificial Sequence
  Description of Artificial Sequence: Synthetic oligonucleotide
  Target: ATXN1; (-) strand; PAM type: NRG; PAM sequence: AGG
gtctaactgtgggcctgggt

SEQ ID NO: 75757 - DNA, 20 bp, Artificial Sequence
  Description of Artificial Sequence: Synthetic oligonucleotide
  Target: ATXN1; (-) strand; PAM type: NRG; PAM sequence: TAG
cgtctaactgtgggcctggg

SEQ ID NO: 75758 - DNA, 20 bp, Artificial Sequence
  Description of Artificial Sequence: Synthetic oligonucleotide
  Target: ATXN1; (-) strand; PAM type: NRG; PAM sequence: GGG
atacgtctaactgtgggcct

SEQ ID NO: 75759 - DNA, 20 bp, Artificial Sequence
  Description of Artificial Sequence: Synthetic oligonucleotide
  Target: ATXN1; (-) strand; PAM type: NRG; PAM sequence: TGG
aatacgtctaactgtgggcc

SEQ ID NO: 75760 - DNA, 20 bp, Artificial Sequence
  Description of Artificial Sequence: Synthetic oligonucleotide
  Target: ATXN1; (-) strand; PAM type: NRG; PAM sequence: GGG
tgactaatacgtctaactgt

SEQ ID NO: 75761 - DNA, 20 bp, Artificial Sequence
  Description of Artificial Sequence: Synthetic oligonucleotide
  Target: ATXN1; (-) strand; PAM type: NRG; PAM sequence: TGG
gtgactaatacgtctaactg

SEQ ID NO: 75762 - DNA, 20 bp, Artificial Sequence
  Description of Artificial Sequence: Synthetic oligonucleotide
  Target: ATXN1; (-) strand; PAM type: NRG; PAM sequence: CAG
acccatattcattgtcccaa

SEQ ID NO: 75763 - DNA, 20 bp, Artificial Sequence
  Description of Artificial Sequence: Synthetic oligonucleotide
  Target: ATXN1; (-) strand; PAM type: NRG; PAM sequence: TGG
gtaaaggcttgatcacctct

SEQ ID NO: 75764 - DNA, 20 bp, Artificial Sequence
  Description of Artificial Sequence: Synthetic oligonucleotide
  Target: ATXN1; (-) strand; PAM type: NRG; PAM sequence: AGG
aaagaaaatccatcaagtaa

SEQ ID NO: 75765 - DNA, 20 bp, Artificial Sequence
  Description of Artificial Sequence: Synthetic oligonucleotide
  Target: ATXN1; (-) strand; PAM type: NRG; PAM sequence: AAG
aaaagaaaatccatcaagta

SEQ ID NO: 75766 - DNA, 20 bp, Artificial Sequence
  Description of Artificial Sequence: Synthetic oligonucleotide
  Target: ATXN1; (-) strand; PAM type: NRG; PAM sequence: AAG
tggagaaaagaaaatccatc

SEQ ID NO: 75767 - DNA, 20 bp, Artificial Sequence
  Description of Artificial Sequence: Synthetic oligonucleotide
  Target: ATXN1; (-) strand; PAM type: NRG; PAM sequence: AAG
aaatcttggggcgtggagaa

SEQ ID NO: 75768 - DNA, 20 bp, Artificial Sequence
  Description of Artificial Sequence: Synthetic oligonucleotide
  Target: ATXN1; (-) strand; PAM type: NRG; PAM sequence: GAG
ctagaaaatcttggggcgtg

SEQ ID NO: 75769 - DNA, 20 bp, Artificial Sequence
  Description of Artificial Sequence: Synthetic oligonucleotide
  Target: ATXN1; (-) strand; PAM type: NRG; PAM sequence: TGG
gcctagaaaatcttggggcg

SEQ ID NO: 75770 - DNA, 20 bp, Artificial Sequence
  Description of Artificial Sequence: Synthetic oligonucleotide
  Target: ATXN1; (-) strand; PAM type: NRG; PAM sequence: GGG
caaaagcctagaaaatcttg

SEQ ID NO: 75771 - DNA, 20 bp, Artificial Sequence
  Description of Artificial Sequence: Synthetic oligonucleotide
  Target: ATXN1; (-) strand; PAM type: NRG; PAM sequence: GGG
ccaaaagcctagaaaatctt

SEQ ID NO: 75772 - DNA, 20 bp, Artificial Sequence
  Description of Artificial Sequence: Synthetic oligonucleotide
  Target: ATXN1; (-) strand; PAM type: NRG; PAM sequence: TGG
accaaaagcctagaaaatct

SEQ ID NO: 75773 - DNA, 20 bp, Artificial Sequence
  Description of Artificial Sequence: Synthetic oligonucleotide
  Target: ATXN1; (-) strand; PAM type: NRG; PAM sequence: TAG
agtgcttcctaccaaaagcc

SEQ ID NO: 75774 - DNA, 20 bp, Artificial Sequence
  Description of Artificial Sequence: Synthetic oligonucleotide
  Target: ATXN1; (-) strand; PAM type: NRG; PAM sequence: AAG
tgtatagtgcttcctaccaa

SEQ ID NO: 75775 - DNA, 20 bp, Artificial Sequence
  Description of Artificial Sequence: Synthetic oligonucleotide
  Target: ATXN1; (-) strand; PAM type: NRG; PAM sequence: TAG
agacgtgggtgctttctgta

SEQ ID NO: 75776 - DNA, 20 bp, Artificial Sequence
  Description of Artificial Sequence: Synthetic oligonucleotide
  Target: ATXN1; (-) strand; PAM type: NRG; PAM sequence: GGG
cagaatcagctaggagacgt

SEQ ID NO: 75777 - DNA, 20 bp, Artificial Sequence
  Description of Artificial Sequence: Synthetic oligonucleotide
  Target: ATXN1; (-) strand; PAM type: NRG; PAM sequence: TGG
acagaatcagctaggagacg

SEQ ID NO: 75778 - DNA, 20 bp, Artificial Sequence
  Description of Artificial Sequence: Synthetic oligonucleotide
  Target: ATXN1; (-) strand; PAM type: NRG; PAM sequence: GAG
ccagacacagaatcagctag

SEQ ID NO: 75779 - DNA, 20 bp, Artificial Sequence
  Description of Artificial Sequence: Synthetic oligonucleotide
  Target: ATXN1; (-) strand; PAM type: NRG; PAM sequence: AGG
ctccagacacagaatcagct

SEQ ID NO: 75780 - DNA, 20 bp, Artificial Sequence
  Description of Artificial Sequence: Synthetic oligonucleotide
  Target: ATXN1; (-) strand; PAM type: NRG; PAM sequence: TAG
actccagacacagaatcagc

SEQ ID NO: 75781 - DNA, 20 bp, Artificial Sequence
  Description of Artificial Sequence: Synthetic oligonucleotide
  Target: ATXN1; (-) strand; PAM type: NRG; PAM sequence: CAG
accaactccagacacagaat

SEQ ID NO: 75782 - DNA, 20 bp, Artificial Sequence
  Description of Artificial Sequence: Synthetic oligonucleotide
  Target: ATXN1; (-) strand; PAM type: NRG; PAM sequence: CAG
gaaggaaccaactccagaca

SEQ ID NO: 75783 - DNA, 20 bp, Artificial Sequence
  Description of Artificial Sequence: Synthetic oligonucleotide
  Target: ATXN1; (-) strand; PAM type: NRG; PAM sequence: CAG
ccaccagaaggaaccaactc

SEQ ID NO: 75784 - DNA, 20 bp, Artificial Sequence
  Description of Artificial Sequence: Synthetic oligonucleotide
  Target: ATXN1; (-) strand; PAM type: NRG; PAM sequence: AGG
gagaccacgaacccaccaga

SEQ ID NO: 75785 - DNA, 20 bp, Artificial Sequence
  Description of Artificial Sequence: Synthetic oligonucleotide
  Target: ATXN1; (-) strand; PAM type: NRG; PAM sequence: AAG
cgagaccacgaacccaccag

SEQ ID NO: 75786 - DNA, 20 bp, Artificial Sequence
  Description of Artificial Sequence: Synthetic oligonucleotide
  Target: ATXN1; (-) strand; PAM type: NRG; PAM sequence: CAG
cagcgagaccacgaacccac

SEQ ID NO: 75787 - DNA, 20 bp, Artificial Sequence
  Description of Artificial Sequence: Synthetic oligonucleotide
  Target: ATXN1; (-) strand; PAM type: NRG; PAM sequence: GAG
gctccattcttgaagtcagc

SEQ ID NO: 75788 - DNA, 20 bp, Artificial Sequence
  Description of Artificial Sequence: Synthetic oligonucleotide
  Target: ATXN1; (-) strand; PAM type: NRG; PAM sequence: CAG
agcggctccattcttgaagt

SEQ ID NO: 75789 - DNA, 20 bp, Artificial Sequence
  Description of Artificial Sequence: Synthetic oligonucleotide
  Target: ATXN1; (-) strand; PAM type: NRG; PAM sequence: AAG
ggttagcggctccattcttg

SEQ ID NO: 75790 - DNA, 20 bp, Artificial Sequence
  Description of Artificial Sequence: Synthetic oligonucleotide
  Target: ATXN1; (-) strand; PAM type: NRG; PAM sequence: CGG
acagtcaccgcaaaggttag

SEQ ID NO: 75791 - DNA, 20 bp, Artificial Sequence
  Description of Artificial Sequence: Synthetic oligonucleotide
  Target: ATXN1; (-) strand; PAM type: NRG; PAM sequence: TAG
gtaacagtcaccgcaaaggt

SEQ ID NO: 75792 - DNA, 20 bp, Artificial Sequence
  Description of Artificial Sequence: Synthetic oligonucleotide
  Target: ATXN1; (-) strand; PAM type: NRG; PAM sequence: AGG
agctgtaacagtcaccgcaa

SEQ ID NO: 75793 - DNA, 20 bp, Artificial Sequence
  Description of Artificial Sequence: Synthetic oligonucleotide
  Target: ATXN1; (-) strand; PAM type: NRG; PAM sequence: AAG
gagctgtaacagtcaccgca

SEQ ID NO: 75794 - DNA, 20 bp, Artificial Sequence
  Description of Artificial Sequence: Synthetic oligonucleotide
  Target: ATXN1; (-) strand; PAM type: NRG; PAM sequence: CAG
gccatctttaagagctgtaa

SEQ ID NO: 75795 - DNA, 20 bp, Artificial Sequence
  Description of Artificial Sequence: Synthetic oligonucleotide
  Target: ATXN1; (-) strand; PAM type: NRG; PAM sequence: GAG
tgggtctgtgccatctttaa

SEQ ID NO: 75796 - DNA, 20 bp, Artificial Sequence
  Description of Artificial Sequence: Synthetic oligonucleotide
  Target: ATXN1; (-) strand; PAM type: NRG; PAM sequence: AAG
tttgggtctgtgccatcttt

SEQ ID NO: 75797 - DNA, 20 bp, Artificial Sequence
  Description of Artificial Sequence: Synthetic oligonucleotide
  Target: ATXN1; (-) strand; PAM type: NRG; PAM sequence: GGG
ttgctgctgttcagtctttt

SEQ ID NO: 75798 - DNA, 20 bp, Artificial Sequence
  Description of Artificial Sequence: Synthetic oligonucleotide
  Target: ATXN1; (-) strand; PAM type: NRG; PAM sequence: TGG
cttgctgctgttcagtcttt

SEQ ID NO: 75799 - DNA, 20 bp, Artificial Sequence
  Description of Artificial Sequence: Synthetic oligonucleotide
  Target: ATXN1; (-) strand; PAM type: NRG; PAM sequence: CAG
tgataaatcttgctgctgtt

SEQ ID NO: 75800 - DNA, 20 bp, Artificial Sequence
  Description of Artificial Sequence: Synthetic oligonucleotide
  Target: ATXN1; (-) strand; PAM type: NRG; PAM sequence: AAG
agattcttttccagctgtgg

SEQ ID NO: 75801 - DNA, 20 bp, Artificial Sequence
  Description of Artificial Sequence: Synthetic oligonucleotide
  Target: ATXN1; (-) strand; PAM type: NRG; PAM sequence: TGG
ctcagattcttttccagctg

SEQ ID NO: 75802 - DNA, 20 bp, Artificial Sequence
  Description of Artificial Sequence: Synthetic oligonucleotide
  Target: ATXN1; (-) strand; PAM type: NRG; PAM sequence: CAG
aacctgctcagattcttttc

SEQ ID NO: 75803 - DNA, 20 bp, Artificial Sequence
  Description of Artificial Sequence: Synthetic oligonucleotide
  Target: ATXN1; (-) strand; PAM type: NRG; PAM sequence: CAG
agccaccagtgcaacctgct

SEQ ID NO: 75804 - DNA, 20 bp, Artificial Sequence
  Description of Artificial Sequence: Synthetic oligonucleotide
  Target: ATXN1; (-) strand; PAM type: NRG; PAM sequence: CAG
cccccacccgcaccagccac

SEQ ID NO: 75805 - DNA, 20 bp, Artificial Sequence
  Description of Artificial Sequence: Synthetic oligonucleotide
  Target: ATXN1; (-) strand; PAM type: NRG; PAM sequence: CAG
ccccccacccccacccgcac

SEQ ID NO: 75806 - DNA, 20 bp, Artificial Sequence
  Description of Artificial Sequence: Synthetic oligonucleotide
  Target: ATXN1; (-) strand; PAM type: NRG; PAM sequence: AAG
cgggaaaaataatggaataa

SEQ ID NO: 75807 - DNA, 20 bp, Artificial Sequence
  Description of Artificial Sequence: Synthetic oligonucleotide
  Target: ATXN1; (-) strand; PAM type: NRG; PAM sequence: TGG
gacatggacgggaaaaataa

SEQ ID NO: 75808 - DNA, 20 bp, Artificial Sequence
  Description of Artificial Sequence: Synthetic oligonucleotide
  Target: ATXN1; (-) strand; PAM type: NRG; PAM sequence: GGG
gacagaaacaggacatggac

SEQ ID NO: 75809 - DNA, 20 bp, Artificial Sequence
  Description of Artificial Sequence: Synthetic oligonucleotide
  Target: ATXN1; (-) strand; PAM type: NRG; PAM sequence: CGG
ggacagaaacaggacatgga

SEQ ID NO: 75810 - DNA, 20 bp, Artificial Sequence
  Description of Artificial Sequence: Synthetic oligonucleotide
  Target: ATXN1; (-) strand; PAM type: NRG; PAM sequence: TGG
gataggacagaaacaggaca

SEQ ID NO: 75811 - DNA, 20 bp, Artificial Sequence
  Description of Artificial Sequence: Synthetic oligonucleotide
  Target: ATXN1; (-) strand; PAM type: NRG; PAM sequence: AGG
cgttctgataggacagaaac

SEQ ID NO: 75812 - DNA, 20 bp, Artificial Sequence
  Description of Artificial Sequence: Synthetic oligonucleotide
  Target: ATXN1; (-) strand; PAM type: NRG; PAM sequence: CAG
gcgttctgataggacagaaa

SEQ ID NO: 75813 - DNA, 20 bp, Artificial Sequence
  Description of Artificial Sequence: Synthetic oligonucleotide
  Target: ATXN1; (-) strand; PAM type: NRG; PAM sequence: CAG
aaaagggcgttctgatagga

SEQ ID NO: 75814 - DNA, 20 bp, Artificial Sequence
  Description of Artificial Sequence: Synthetic oligonucleotide
  Target: ATXN1; (-) strand; PAM type: NRG; PAM sequence: AGG
tgagaaaagggcgttctgat

SEQ ID NO: 75815 - DNA, 20 bp, Artificial Sequence
  Description of Artificial Sequence: Synthetic oligonucleotide
  Target: ATXN1; (-) strand; PAM type: NRG; PAM sequence: TAG
ttgagaaaagggcgttctga

SEQ ID NO: 75816 - DNA, 20 bp, Artificial Sequence
  Description of Artificial Sequence: Synthetic oligonucleotide
  Target: ATXN1; (-) strand; PAM type: NRG; PAM sequence: GGG
catggggaggattgagaaaa

SEQ ID NO: 75817 - DNA, 20 bp, Artificial Sequence
  Description of Artificial Sequence: Synthetic oligonucleotide
  Target: ATXN1; (-) strand; PAM type: NRG; PAM sequence: AGG
tcatggggaggattgagaaa

SEQ ID NO: 75818 - DNA, 20 bp, Artificial Sequence
  Description of Artificial Sequence: Synthetic oligonucleotide
  Target: ATXN1; (-) strand; PAM type: NRG; PAM sequence: AAG
atcatggggaggattgagaa

SEQ ID NO: 75819 - DNA, 20 bp, Artificial Sequence
  Description of Artificial Sequence: Synthetic oligonucleotide
  Target: ATXN1; (-) strand; PAM type: NRG; PAM sequence: GAG
aaccaatcatggggaggatt

SEQ ID NO: 75820 - DNA, 20 bp, Artificial Sequence
  Description of Artificial Sequence: Synthetic oligonucleotide
  Target: ATXN1; (-) strand; PAM type: NRG; PAM sequence: AGG
aaaagtaaccaatcatgggg

SEQ ID NO: 75821 - DNA, 20 bp, Artificial Sequence
  Description of Artificial Sequence: Synthetic oligonucleotide
  Target: ATXN1; (-) strand; PAM type: NRG; PAM sequence: GAG
taaaagtaaccaatcatggg

SEQ ID NO: 75822 - DNA, 20 bp, Artificial Sequence
  Description of Artificial Sequence: Synthetic oligonucleotide
  Target: ATXN1; (-) strand; PAM type: NRG; PAM sequence: GGG
tctaaaagtaaccaatcatg

SEQ ID NO: 75823 - DNA, 20 bp, Artificial Sequence
  Description of Artificial Sequence: Synthetic oligonucleotide
  Target: ATXN1; (-) strand; PAM type: NRG; PAM sequence: GGG
ttctaaaagtaaccaatcat

SEQ ID NO: 75824 - DNA, 20 bp, Artificial Sequence
  Description of Artificial Sequence: Synthetic oligonucleotide
  Target: ATXN1; (-) strand; PAM type: NRG; PAM sequence: TGG
gttctaaaagtaaccaatca

SEQ ID NO: 75825 - DNA, 20 bp, Artificial Sequence
  Description of Artificial Sequence: Synthetic oligonucleotide
  Target: ATXN1; (-) strand; PAM type: NRG; PAM sequence: AAG
accaatcagcagggttctaa

SEQ ID NO: 75826 - DNA, 20 bp, Artificial Sequence
  Description of Artificial Sequence: Synthetic oligonucleotide
  Target: ATXN1; (-) strand; PAM type: NRG; PAM sequence: GGG
gtaaaatggaccaatcagca

SEQ ID NO: 75827 - DNA, 20 bp, Artificial Sequence
  Description of Artificial Sequence: Synthetic oligonucleotide
  Target: ATXN1; (-) strand; PAM type: NRG; PAM sequence: AGG
tgtaaaatggaccaatcagc

SEQ ID NO: 75828 - DNA, 20 bp, Artificial Sequence
  Description of Artificial Sequence: Synthetic oligonucleotide
  Target: ATXN1; (-) strand; PAM type: NRG; PAM sequence: CAG
ttgtaaaatggaccaatcag

SEQ ID NO: 75829 - DNA, 20 bp, Artificial Sequence
  Description of Artificial Sequence: Synthetic oligonucleotide
  Target: ATXN1; (-) strand; PAM type: NRG; PAM sequence: CAG
actttgtaaaatggaccaat

SEQ ID NO: 75830 - DNA, 20 bp, Artificial Sequence
  Description of Artificial Sequence: Synthetic oligonucleotide
  Target: ATXN1; (-) strand; PAM type: NRG; PAM sequence: TGG
ccaatcagtactttgtaaaa

SEQ ID NO: 75831 - DNA, 20 bp, Artificial Sequence
  Description of Artificial Sequence: Synthetic oligonucleotide
  Target: ATXN1; (-) strand; PAM type: NRG; PAM sequence: CAG
gatttgtaaaatgcaccaat

SEQ ID NO: 75832 - DNA, 20 bp, Artificial Sequence
  Description of Artificial Sequence: Synthetic oligonucleotide
  Target: ATXN1; (-) strand; PAM type: NRG; PAM sequence: GAG
cagtgctctgtagctagcaa

SEQ ID NO: 75833 - DNA, 20 bp, Artificial Sequence
  Description of Artificial Sequence: Synthetic oligonucleotide
  Target: ATXN1; (-) strand; PAM type: NRG; PAM sequence: AAG
gtcagtgctctgtagctagc

SEQ ID NO: 75834 - DNA, 20 bp, Artificial Sequence
  Description of Artificial Sequence: Synthetic oligonucleotide
  Target: ATXN1; (-) strand; PAM type: NRG; PAM sequence: TAG
accagtcagtgctctgtagc

SEQ ID NO: 75835 - DNA, 20 bp, Artificial Sequence
  Description of Artificial Sequence: Synthetic oligonucleotide
  Target: ATXN1; (-) strand; PAM type: NRG; PAM sequence: TAG
atgcaccagtcagtgctctg

SEQ ID NO: 75836 - DNA, 20 bp, Artificial Sequence
  Description of Artificial Sequence: Synthetic oligonucleotide
  Target: ATXN1; (-) strand; PAM type: NRG; PAM sequence: CAG
ctctgtaaaaatgcaccagt

SEQ ID NO: 75837 - DNA, 20 bp, Artificial Sequence
  Description of Artificial Sequence: Synthetic oligonucleotide
  Target: ATXN1; (-) strand; PAM type: NRG; PAM sequence: CAG
agtgctctgtaaaaatgcac

SEQ ID NO: 75838 - DNA, 20 bp, Artificial Sequence
  Description of Artificial Sequence: Synthetic oligonucleotide
  Target: ATXN1; (-) strand; PAM type: NRG; PAM sequence: CAG
ggtttgtaaaatgcaccaat

SEQ ID NO: 75839 - DNA, 20 bp, Artificial Sequence
  Description of Artificial Sequence: Synthetic oligonucleotide
  Target: ATXN1; (-) strand; PAM type: NRG; PAM sequence: AGG
agtgctctgtagctagcaag

SEQ ID NO: 75840 - DNA, 20 bp, Artificial Sequence
  Description of Artificial Sequence: Synthetic oligonucleotide
  Target: ATXN1; (-) strand; PAM type: NRG; PAM sequence: GAG
cagtgctctgtagctagcaa

SEQ ID NO: 75841 - DNA, 20 bp, Artificial Sequence
  Description of Artificial Sequence: Synthetic oligonucleotide
  Target: ATXN1; (-) strand; PAM type: NRG; PAM sequence: AAG
gtcagtgctctgtagctagc

SEQ ID NO: 75842 - DNA, 20 bp, Artificial Sequence
  Description of Artificial Sequence: Synthetic oligonucleotide
  Target: ATXN1; (-) strand; PAM type: NRG; PAM sequence: TAG
agcagtcagtgctctgtagc

SEQ ID NO: 75843 - DNA, 20 bp, Artificial Sequence
  Description of Artificial Sequence: Synthetic oligonucleotide
  Target: ATXN1; (-) strand; PAM type: NRG; PAM sequence: TAG
atgcagcagtcagtgctctg

SEQ ID NO: 75844 - DNA, 20 bp, Artificial Sequence
  Description of Artificial Sequence: Synthetic oligonucleotide
  Target: ATXN1; (-) strand; PAM type: NRG; PAM sequence: CAG
gtattataaaatgcagcagt

SEQ ID NO: 75845 - DNA, 20 bp, Artificial Sequence
  Description of Artificial Sequence: Synthetic oligonucleotide
  Target: ATXN1; (-) strand; PAM type: NRG; PAM sequence: CAG
aagggtattataaaatgcag

SEQ ID NO: 75846 - DNA, 20 bp, Artificial Sequence
  Description of Artificial Sequence: Synthetic oligonucleotide
  Target: ATXN1; (-) strand; PAM type: NRG; PAM sequence: CAG
tccaagggtattataaaatg

SEQ ID NO: 75847 - DNA, 20 bp, Artificial Sequence
  Description of Artificial Sequence: Synthetic oligonucleotide
  Target: ATXN1; (-) strand; PAM type: NRG; PAM sequence: GGG
agaacttttctgtcttccaa

SEQ ID NO: 75848 - DNA, 20 bp, Artificial Sequence
  Description of Artificial Sequence: Synthetic oligonucleotide
  Target: ATXN1; (-) strand; PAM type: NRG; PAM sequence: AGG
gagaacttttctgtcttcca

SEQ ID NO: 75849 - DNA, 20 bp, Artificial Sequence
  Description of Artificial Sequence: Synthetic oligonucleotide
  Target: ATXN1; (-) strand; PAM type: NRG; PAM sequence: AAG
ggagaacttttctgtcttcc

SEQ ID NO: 75850 - DNA, 20 bp, Artificial Sequence
  Description of Artificial Sequence: Synthetic oligonucleotide
  Target: ATXN1; (-) strand; PAM type: NRG; PAM sequence: GAG
ctgggtcgagtggggacttg

SEQ ID NO: 75851 - DNA, 20 bp, Artificial Sequence
  Description of Artificial Sequence: Synthetic oligonucleotide
  Target: ATXN1; (-) strand; PAM type: NRG; PAM sequence: TGG
tcctgggtcgagtggggact

SEQ ID NO: 75852 - DNA, 20 bp, Artificial Sequence
  Description of Artificial Sequence: Synthetic oligonucleotide
  Target: ATXN1; (-) strand; PAM type: NRG; PAM sequence: GGG
tggacttcctgggtcgagtg

SEQ ID NO: 75853 - DNA, 20 bp, Artificial Sequence
  Description of Artificial Sequence: Synthetic oligonucleotide
  Target: ATXN1; (-) strand; PAM type: NRG; PAM sequence: GGG
ctggacttcctgggtcgagt

SEQ ID NO: 75854 - DNA, 20 bp, Artificial Sequence
  Description of Artificial Sequence: Synthetic oligonucleotide
  Target: ATXN1; (-) strand; PAM type: NRG; PAM sequence: TGG
gctggacttcctgggtcgag

SEQ ID NO: 75855 - DNA, 20 bp, Artificial Sequence
  Description of Artificial Sequence: Synthetic oligonucleotide
  Target: ATXN1; (-) strand; PAM type: NRG; PAM sequence: GAG
ccagctggacttcctgggtc

SEQ ID NO: 75856 - DNA, 20 bp, Artificial Sequence
  Description of Artificial Sequence: Synthetic oligonucleotide
  Target: ATXN1; (-) strand; PAM type: NRG; PAM sequence: GGG
tgaagccagctggacttcct

SEQ ID NO: 75857 - DNA, 20 bp, Artificial Sequence
  Description of Artificial Sequence: Synthetic oligonucleotide
  Target: ATXN1; (-) strand; PAM type: NRG; PAM sequence: TGG
gtgaagccagctggacttcc

SEQ ID NO: 75858 - DNA, 20 bp, Artificial Sequence
  Description of Artificial Sequence: Synthetic oligonucleotide
  Target: ATXN1; (-) strand; PAM type: NRG; PAM sequence: TGG
aattgagaggtgaagccagc

SEQ ID NO: 75859 - DNA, 20 bp, Artificial Sequence
  Description of Artificial Sequence: Synthetic oligonucleotide
  Target: ATXN1; (-) strand; PAM type: NRG; PAM sequence: CAG
gtggaattgagaggtgaagc

SEQ ID NO: 75860 - DNA, 20 bp, Artificial Sequence
  Description of Artificial Sequence: Synthetic oligonucleotide
  Target: ATXN1; (-) strand; PAM type: NRG; PAM sequence: AAG
ctgagtggaattgagaggtg

SEQ ID NO: 75861 - DNA, 20 bp, Artificial Sequence
  Description of Artificial Sequence: Synthetic oligonucleotide
  Target: ATXN1; (-) strand; PAM type: NRG; PAM sequence: AGG
aactactgagtggaattgag

SEQ ID NO: 75862 - DNA, 20 bp, Artificial Sequence
  Description of Artificial Sequence: Synthetic oligonucleotide
  Target: ATXN1; (-) strand; PAM type: NRG; PAM sequence: GAG
taactactgagtggaattga

SEQ ID NO: 75863 - DNA, 20 bp, Artificial Sequence
  Description of Artificial Sequence: Synthetic oligonucleotide
  Target: ATXN1; (-) strand; PAM type: NRG; PAM sequence: GAG
agtaactactgagtggaatt

SEQ ID NO: 75864 - DNA, 20 bp, Artificial Sequence
  Description of Artificial Sequence: Synthetic oligonucleotide
  Target: ATXN1; (-) strand; PAM type: NRG; PAM sequence: TGG
ggctgacagtaactactgag

SEQ ID NO: 75865 - DNA, 20 bp, Artificial Sequence
  Description of Artificial Sequence: Synthetic oligonucleotide
  Target: ATXN1; (-) strand; PAM type: NRG; PAM sequence: GAG
ggaggctgacagtaactact

SEQ ID NO: 75866 - DNA, 20 bp, Artificial Sequence
  Description of Artificial Sequence: Synthetic oligonucleotide
  Target: ATXN1; (-) strand; PAM type: NRG; PAM sequence: CAG
aggttttagggggaggctga

SEQ ID NO: 75867 - DNA, 20 bp, Artificial Sequence
  Description of Artificial Sequence: Synthetic oligonucleotide
  Target: ATXN1; (-) strand; PAM type: NRG; PAM sequence: AGG
gtggtggaggttttaggggg

SEQ ID NO: 75868 - DNA, 20 bp, Artificial Sequence
  Description of Artificial Sequence: Synthetic oligonucleotide
  Target: ATXN1; (-) strand; PAM type: NRG; PAM sequence: GAG
agtggtggaggttttagggg

SEQ ID NO: 75869 - DNA, 20 bp, Artificial Sequence
  Description of Artificial Sequence: Synthetic oligonucleotide
  Target: ATXN1; (-) strand; PAM type: NRG; PAM sequence: GGG
tgagtggtggaggttttagg

SEQ ID NO: 75870 - DNA, 20 bp, Artificial Sequence
  Description of Artificial Sequence: Synthetic oligonucleotide
  Target: ATXN1; (-) strand; PAM type: NRG; PAM sequence: GGG
ttgagtggtggaggttttag

SEQ ID NO: 75871 - DNA, 20 bp, Artificial Sequence
  Description of Artificial Sequence: Synthetic oligonucleotide
  Target: ATXN1; (-) strand; PAM type: NRG; PAM sequence: GGG
cttgagtggtggaggtttta

SEQ ID NO: 75872 - DNA, 20 bp, Artificial Sequence
  Description of Artificial Sequence: Synthetic oligonucleotide
  Target: ATXN1; (-) strand; PAM type: NRG; PAM sequence: AGG
ccttgagtggtggaggtttt

SEQ ID NO: 75873 - DNA, 20 bp, Artificial Sequence
  Description of Artificial Sequence: Synthetic oligonucleotide
  Target: ATXN1; (-) strand; PAM type: NRG; PAM sequence: TAG
tccttgagtggtggaggttt

SEQ ID NO: 75874 - DNA, 20 bp, Artificial Sequence
  Description of Artificial Sequence: Synthetic oligonucleotide
  Target: ATXN1; (-) strand; PAM type: NRG; PAM sequence: AGG
tgtcgctccttgagtggtgg

SEQ ID NO: 75875 - DNA, 20 bp, Artificial Sequence
  Description of Artificial Sequence: Synthetic oligonucleotide
  Target: ATXN1; (-) strand; PAM type: NRG; PAM sequence: GAG
gtgtcgctccttgagtggtg

SEQ ID NO: 75876 - DNA, 20 bp, Artificial Sequence
  Description of Artificial Sequence: Synthetic oligonucleotide
  Target: ATXN1; (-) strand; PAM type: NRG; PAM sequence: TGG
cagtgtcgctccttgagtgg

SEQ ID NO: 75877 - DNA, 20 bp, Artificial Sequence
  Description of Artificial Sequence: Synthetic oligonucleotide
  Target: ATXN1; (-) strand; PAM type: NRG; PAM sequence: TGG
tgacagtgtcgctccttgag

SEQ ID NO: 75878 - DNA, 20 bp, Artificial Sequence
  Description of Artificial Sequence: Synthetic oligonucleotide
  Target: ATXN1; (-) strand; PAM type: NRG; PAM sequence: GAG
ttctgacagtgtcgctcctt

SEQ ID NO: 75879 - DNA, 20 bp, Artificial Sequence
  Description of Artificial Sequence: Synthetic oligonucleotide
  Target: ATXN1; (-) strand; PAM type: NRG; PAM sequence: CAG
attagaaggtctgcttctga

SEQ ID NO: 75880 - DNA, 20 bp, Artificial Sequence
  Description of Artificial Sequence: Synthetic oligonucleotide
  Target: ATXN1; (-) strand; PAM type: NRG; PAM sequence: AGG
atcacacaggagtaattaga

SEQ ID NO: 75881 - DNA, 20 bp, Artificial Sequence
  Description of Artificial Sequence: Synthetic oligonucleotide
  Target: ATXN1; (-) strand; PAM type: NRG; PAM sequence: AAG
gatcacacaggagtaattag

SEQ ID NO: 75882 - DNA, 20 bp, Artificial Sequence
  Description of Artificial Sequence: Synthetic oligonucleotide
  Target: ATXN1; (-) strand; PAM type: NRG; PAM sequence: TAG
tgagatcacacaggagtaat

SEQ ID NO: 75883 - DNA, 20 bp, Artificial Sequence
  Description of Artificial Sequence: Synthetic oligonucleotide
  Target: ATXN1; (-) strand; PAM type: NRG; PAM sequence: GAG
gggggcttgagatcacacag

SEQ ID NO: 75884 - DNA, 20 bp, Artificial Sequence
  Description of Artificial Sequence: Synthetic oligonucleotide
  Target: ATXN1; (-) strand; PAM type: NRG; PAM sequence: AGG
gagggggcttgagatcacac

SEQ ID NO: 75885 - DNA, 20 bp, Artificial Sequence
  Description of Artificial Sequence: Synthetic oligonucleotide
  Target: ATXN1; (-) strand; PAM type: NRG; PAM sequence: CAG
ggagggggcttgagatcaca

SEQ ID NO: 75886 - DNA, 20 bp, Artificial Sequence
  Description of Artificial Sequence: Synthetic oligonucleotide
  Target: ATXN1; (-) strand; PAM type: NRG; PAM sequence: GAG
agtccccagggagggggctt

SEQ ID NO: 75887 - DNA, 20 bp, Artificial Sequence
  Description of Artificial Sequence: Synthetic oligonucleotide
  Target: ATXN1; (-) strand; PAM type: NRG; PAM sequence: GGG
ttccatagtccccagggagg

SEQ ID NO: 75888 - DNA, 20 bp, Artificial Sequence
  Description of Artificial Sequence: Synthetic oligonucleotide
  Target: ATXN1; (-) strand; PAM type: NRG; PAM sequence: GGG
tttccatagtccccagggag

SEQ ID NO: 75889 - DNA, 20 bp, Artificial Sequence
  Description of Artificial Sequence: Synthetic oligonucleotide
  Target: ATXN1; (-) strand; PAM type: NRG; PAM sequence: GGG
ctttccatagtccccaggga

SEQ ID NO: 75890 - DNA, 20 bp, Artificial Sequence
  Description of Artificial Sequence: Synthetic oligonucleotide
  Target: ATXN1; (-) strand; PAM type: NRG; PAM sequence: AGG
tctttccatagtccccaggg

SEQ ID NO: 75891 - DNA, 20 bp, Artificial Sequence
  Description of Artificial Sequence: Synthetic oligonucleotide
  Target: ATXN1; (-) strand; PAM type: NRG; PAM sequence: GAG
ctctttccatagtccccagg

SEQ ID NO: 75892 - DNA, 20 bp, Artificial Sequence
  Description of Artificial Sequence: Synthetic oligonucleotide
  Target: ATXN1; (-) strand; PAM type: NRG; PAM sequence: GGG
ttctctttccatagtcccca

SEQ ID NO: 75893 - DNA, 20 bp, Artificial Sequence
  Description of Artificial Sequence: Synthetic oligonucleotide
  Target: ATXN1; (-) strand; PAM type: NRG; PAM sequence: AGG
attctctttccatagtcccc

SEQ ID NO: 75894 - DNA, 20 bp, Artificial Sequence
  Description of Artificial Sequence: Synthetic oligonucleotide
  Target: ATXN1; (-) strand; PAM type: NRG; PAM sequence: CAG
cattctctttccatagtccc

SEQ ID NO: 75895 - DNA, 20 bp, Artificial Sequence
  Description of Artificial Sequence: Synthetic oligonucleotide
  Target: ATXN1; (-) strand; PAM type: NRG; PAM sequence: TAG
ttcctaacattctctttcca

SEQ ID NO: 75896 - DNA, 20 bp, Artificial Sequence
  Description of Artificial Sequence: Synthetic oligonucleotide
  Target: ATXN1; (-) strand; PAM type: NRG; PAM sequence: TGG
gtgatagcatgtcagaatta

SEQ ID NO: 75897 - DNA, 20 bp, Artificial Sequence
  Description of Artificial Sequence: Synthetic oligonucleotide
  Target: ATXN1; (-) strand; PAM type: NRG; PAM sequence: CAG
tttttaaagtgatagcatgt

SEQ ID NO: 75898 - DNA, 20 bp, Artificial Sequence
  Description of Artificial Sequence: Synthetic oligonucleotide
  Target: ATXN1; (-) strand; PAM type: NRG; PAM sequence: TAG
tagaaatatttttaaagtga

SEQ ID NO: 75899 - DNA, 20 bp, Artificial Sequence
  Description of Artificial Sequence: Synthetic oligonucleotide
  Target: ATXN1; (-) strand; PAM type: NRG; PAM sequence: AAG
gcatgatagaaatattttta

SEQ ID NO: 75900 - DNA, 20 bp, Artificial Sequence
  Description of Artificial Sequence: Synthetic oligonucleotide
  Target: ATXN1; (-) strand; PAM type: NRG; PAM sequence: TAG
gggttacaaacattgcatga

SEQ ID NO: 75901 - DNA, 20 bp, Artificial Sequence
  Description of Artificial Sequence: Synthetic oligonucleotide
  Target: ATXN1; (-) strand; PAM type: NRG; PAM sequence: GGG
atgttagtgcattcttttgt

SEQ ID NO: 75902 - DNA, 20 bp, Artificial Sequence
  Description of Artificial Sequence: Synthetic oligonucleotide
  Target: ATXN1; (-) strand; PAM type: NRG; PAM sequence: TGG
catgttagtgcattcttttg

SEQ ID NO: 75903 - DNA, 20 bp, Artificial Sequence
  Description of Artificial Sequence: Synthetic oligonucleotide
  Target: ATXN1; (-) strand; PAM type: NRG; PAM sequence: TAG
ttcacaggttacgtacatgt

SEQ ID NO: 75904 - DNA, 20 bp, Artificial Sequence
  Description of Artificial Sequence: Synthetic oligonucleotide
  Target: ATXN1; (-) strand; PAM type: NRG; PAM sequence: AGG
attttattcttatgcttcac

SEQ ID NO: 75905 - DNA, 20 bp, Artificial Sequence
  Description of Artificial Sequence: Synthetic oligonucleotide
  Target: ATXN1; (-) strand; PAM type: NRG; PAM sequence: CAG
cattttattcttatgcttca

SEQ ID NO: 75906 - DNA, 20 bp, Artificial Sequence
  Description of Artificial Sequence: Synthetic oligonucleotide
  Target: ATXN1; (-) strand; PAM type: NRG; PAM sequence: CGG
tagttctcaaatagggtggt

SEQ ID NO: 75907 - DNA, 20 bp, Artificial Sequence
  Description of Artificial Sequence: Synthetic oligonucleotide
  Target: ATXN1; (-) strand; PAM type: NRG; PAM sequence: TGG
tgtctagttctcaaataggg

SEQ ID NO: 75908 - DNA, 20 bp, Artificial Sequence
  Description of Artificial Sequence: Synthetic oligonucleotide
  Target: ATXN1; (-) strand; PAM type: NRG; PAM sequence: GGG
aaatgtctagttctcaaata

SEQ ID NO: 75909 - DNA, 20 bp, Artificial Sequence
  Description of Artificial Sequence: Synthetic oligonucleotide
  Target: ATXN1; (-) strand; PAM type: NRG; PAM sequence: AGG
taaatgtctagttctcaaat

SEQ ID NO: 75910 - DNA, 20 bp, Artificial Sequence
  Description of Artificial Sequence: Synthetic oligonucleotide
  Target: ATXN1; (-) strand; PAM type: NRG; PAM sequence: TAG
ctaaatgtctagttctcaaa

SEQ ID NO: 75911 - DNA, 20 bp, Artificial Sequence
  Description of Artificial Sequence: Synthetic oligonucleotide
  Target: ATXN1; (-) strand; PAM type: NRG; PAM sequence: TAG
tcaaaatacccctaaatgtc

SEQ ID NO: 75912 - DNA, 20 bp, Artificial Sequence
  Description of Artificial Sequence: Synthetic oligonucleotide
  Target: ATXN1; (-) strand; PAM type: NRG; PAM sequence: TGG
ggaaatagcaaataggtaga

SEQ ID NO: 75913 - DNA, 20 bp, Artificial Sequence
  Description of Artificial Sequence: Synthetic oligonucleotide
  Target: ATXN1; (-) strand; PAM type: NRG; PAM sequence: TAG
ttagggaaatagcaaatagg

SEQ ID NO: 75914 - DNA, 20 bp, Artificial Sequence
  Description of Artificial Sequence: Synthetic oligonucleotide
  Target: ATXN1; (-) strand; PAM type: NRG; PAM sequence: AGG
ggcttagggaaatagcaaat

SEQ ID NO: 75915 - DNA, 20 bp, Artificial Sequence
  Description of Artificial Sequence: Synthetic oligonucleotide
  Target: ATXN1; (-) strand; PAM type: NRG; PAM sequence: TAG
tggcttagggaaatagcaaa

SEQ ID NO: 75916 - DNA, 20 bp, Artificial Sequence
  Description of Artificial Sequence: Synthetic oligonucleotide
  Target: ATXN1; (-) strand; PAM type: NRG; PAM sequence: TAG
aggaggatggcttagggaaa

SEQ ID NO: 75917 - DNA, 20 bp, Artificial Sequence
  Description of Artificial Sequence: Synthetic oligonucleotide
  Target: ATXN1; (-) strand; PAM type: NRG; PAM sequence: GGG
gaaggcaggaggatggctta

SEQ ID NO: 75918 - DNA, 20 bp, Artificial Sequence
  Description of Artificial Sequence: Synthetic oligonucleotide
  Target: ATXN1; (-) strand; PAM type: NRG; PAM sequence: AGG
agaaggcaggaggatggctt

SEQ ID NO: 75919 - DNA, 20 bp, Artificial Sequence
  Description of Artificial Sequence: Synthetic oligonucleotide
  Target: ATXN1; (-) strand; PAM type: NRG; PAM sequence: TAG
gagaaggcaggaggatggct

SEQ ID NO: 75920 - DNA, 20 bp, Artificial Sequence
  Description of Artificial Sequence: Synthetic oligonucleotide
  Target: ATXN1; (-) strand; PAM type: NRG; PAM sequence: TGG
ctggagagaaggcaggagga

SEQ ID NO: 75921 - DNA, 20 bp, Artificial Sequence
  Description of Artificial Sequence: Synthetic oligonucleotide
  Target: ATXN1; (-) strand; PAM type: NRG; PAM sequence: AGG
acccctggagagaaggcagg

SEQ ID NO: 75922 - DNA, 20 bp, Artificial Sequence
  Description of Artificial Sequence: Synthetic oligonucleotide
  Target: ATXN1; (-) strand; PAM type: NRG; PAM sequence: GAG
tacccctggagagaaggcag

SEQ ID NO: 75923 - DNA, 20 bp, Artificial Sequence
  Description of Artificial Sequence: Synthetic oligonucleotide
  Target: ATXN1; (-) strand; PAM type: NRG; PAM sequence: AGG
gttacccctggagagaaggc

SEQ ID NO: 75924 - DNA, 20 bp, Artificial Sequence
  Description of Artificial Sequence: Synthetic oligonucleotide
  Target: ATXN1; (-) strand; PAM type: NRG; PAM sequence: CAG
ggttacccctggagagaagg

SEQ ID NO: 75925 - DNA, 20 bp, Artificial Sequence
  Description of Artificial Sequence: Synthetic oligonucleotide
  Target: ATXN1; (-) strand; PAM type: NRG; PAM sequence: AGG
agtggttacccctggagaga

SEQ ID NO: 75926 - DNA, 20 bp, Artificial Sequence
  Description of Artificial Sequence: Synthetic oligonucleotide
  Target: ATXN1; (-) strand; PAM type: NRG; PAM sequence: AAG
tagtggttacccctggagag

SEQ ID NO: 75927 - DNA, 20 bp, Artificial Sequence
  Description of Artificial Sequence: Synthetic oligonucleotide
  Target: ATXN1; (-) strand; PAM type: NRG; PAM sequence: GAG
agatagtggttacccctgga

SEQ ID NO: 75928 - DNA, 20 bp, Artificial Sequence
  Description of Artificial Sequence: Synthetic oligonucleotide
  Target: ATXN1; (-) strand; PAM type: NRG; PAM sequence: GAG
taagatagtggttacccctg

SEQ ID NO: 75929 - DNA, 20 bp, Artificial Sequence
  Description of Artificial Sequence: Synthetic oligonucleotide
  Target: ATXN1; (-) strand; PAM type: NRG; PAM sequence: TGG
tttaagatagtggttacccc

SEQ ID NO: 75930 - DNA, 20 bp, Artificial Sequence
  Description of Artificial Sequence: Synthetic oligonucleotide
  Target: ATXN1; (-) strand; PAM type: NRG; PAM sequence: TGG
agatagaaaatttaagatag

SEQ ID NO: 75931 - DNA, 20 bp, Artificial Sequence
  Description of Artificial Sequence: Synthetic oligonucleotide
  Target: ATXN1; (-) strand; PAM type: NRG; PAM sequence: TAG
gatagatagaaaatttaaga

SEQ ID NO: 75932 - DNA, 20 bp, Artificial Sequence
  Description of Artificial Sequence: Synthetic oligonucleotide
  Target: ATXN1; (-) strand; PAM type: NRG; PAM sequence: AAG
gagtgatagatagaaaattt

SEQ ID NO: 75933 - DNA, 20 bp, Artificial Sequence
  Description of Artificial Sequence: Synthetic oligonucleotide
  Target: ATXN1; (-) strand; PAM type: NRG; PAM sequence: TAG
gtattttagagagtgataga

SEQ ID NO: 75934 - DNA, 20 bp, Artificial Sequence
  Description of Artificial Sequence: Synthetic oligonucleotide
  Target: ATXN1; (-) strand; PAM type: NRG; PAM sequence: TAG
ctatgtattttagagagtga

SEQ ID NO: 75935 - DNA, 20 bp, Artificial Sequence
  Description of Artificial Sequence: Synthetic oligonucleotide
  Target: ATXN1; (-) strand; PAM type: NRG; PAM sequence: GAG
attaaactatgtattttaga

SEQ ID NO: 75936 - DNA, 20 bp, Artificial Sequence
  Description of Artificial Sequence: Synthetic oligonucleotide
  Target: ATXN1; (-) strand; PAM type: NRG; PAM sequence: GAG
caattaaactatgtatttta

SEQ ID NO: 75937 - DNA, 20 bp, Artificial Sequence
  Description of Artificial Sequence: Synthetic oligonucleotide
  Target: ATXN1; (-) strand; PAM type: NRG; PAM sequence: TAG
cacaattaaactatgtattt

SEQ ID NO: 75938 - DNA, 20 bp, Artificial Sequence
  Description of Artificial Sequence: Synthetic oligonucleotide
  Target: ATXN1; (-) strand; PAM type: NRG; PAM sequence: AAG
gtattataaagtttaaaatc

SEQ ID NO: 75939 - DNA, 20 bp, Artificial Sequence
  Description of Artificial Sequence: Synthetic oligonucleotide
  Target: ATXN1; (-) strand; PAM type: NRG; PAM sequence: AAG
tacagtatgatagtattata

SEQ ID NO: 75940 - DNA, 20 bp, Artificial Sequence
  Description of Artificial Sequence: Synthetic oligonucleotide
  Target: ATXN1; (-) strand; PAM type: NRG; PAM sequence: TAG
aaagactatatacagtatga

SEQ ID NO: 75941 - DNA, 20 bp, Artificial Sequence
  Description of Artificial Sequence: Synthetic oligonucleotide
  Target: ATXN1; (-) strand; PAM type: NRG; PAM sequence: CAG
tagtcacaaaagactatata

SEQ ID NO: 75942 - DNA, 20 bp, Artificial Sequence
  Description of Artificial Sequence: Synthetic oligonucleotide
  Target: ATXN1; (-) strand; PAM type: NRG; PAM sequence: AAG
gtgaaaaaaactagtcacaa

SEQ ID NO: 75943 - DNA, 20 bp, Artificial Sequence
  Description of Artificial Sequence: Synthetic oligonucleotide
  Target: ATXN1; (-) strand; PAM type: NRG; PAM sequence: TAG
caatattgtgtgaaaaaaac

SEQ ID NO: 75944 - DNA, 20 bp, Artificial Sequence
  Description of Artificial Sequence: Synthetic oligonucleotide
  Target: ATXN1; (-) strand; PAM type: NRG; PAM sequence: TAG
gtaacaacatggctaaatct

SEQ ID NO: 75945 - DNA, 20 bp, Artificial Sequence
  Description of Artificial Sequence: Synthetic oligonucleotide
  Target: ATXN1; (-) strand; PAM type: NRG; PAM sequence: TGG
agtagctacctgtaacaaca

SEQ ID NO: 75946 - DNA, 20 bp, Artificial Sequence
  Description of Artificial Sequence: Synthetic oligonucleotide
  Target: ATXN1; (-) strand; PAM type: NRG; PAM sequence: TAG
tgaatatgaaggaactatag

SEQ ID NO: 75947 - DNA, 20 bp, Artificial Sequence
  Description of Artificial Sequence: Synthetic oligonucleotide
  Target: ATXN1; (-) strand; PAM type: NRG; PAM sequence: TAG
cagtgaatatgaaggaacta

SEQ ID NO: 75948 - DNA, 20 bp, Artificial Sequence
  Description of Artificial Sequence: Synthetic oligonucleotide
  Target: ATXN1; (-) strand; PAM type: NRG; PAM sequence: AGG
ttatacagcagtgaatatga

SEQ ID NO: 75949 - DNA, 20 bp, Artificial Sequence
  Description of Artificial Sequence: Synthetic oligonucleotide
  Target: ATXN1; (-) strand; PAM type: NRG; PAM sequence: AAG
attatacagcagtgaatatg

SEQ ID NO: 75950 - DNA, 20 bp, Artificial Sequence
  Description of Artificial Sequence: Synthetic oligonucleotide
  Target: ATXN1; (-) strand; PAM type: NRG; PAM sequence: CAG
cagaatggaatattatacag

SEQ ID NO: 75951 - DNA, 20 bp, Artificial Sequence
  Description of Artificial Sequence: Synthetic oligonucleotide
  Target: ATXN1; (-) strand; PAM type: NRG; PAM sequence: CAG
tcacagaatggaatattata

SEQ ID NO: 75952 - DNA, 20 bp, Artificial Sequence
  Description of Artificial Sequence: Synthetic oligonucleotide
  Target: ATXN1; (-) strand; PAM type: NRG; PAM sequence: TGG
taattttttgcttcacagaa

SEQ ID NO: 75953 - DNA, 20 bp, Artificial Sequence
  Description of Artificial Sequence: Synthetic oligonucleotide
  Target: ATXN1; (-) strand; PAM type: NRG; PAM sequence: CAG
atatataattttttgcttca

SEQ ID NO: 75954 - DNA, 20 bp, Artificial Sequence
  Description of Artificial Sequence: Synthetic oligonucleotide
  Target: ATXN1; (-) strand; PAM type: NRG; PAM sequence: GAG
tatatatatattagtctatt

SEQ ID NO: 75955 - DNA, 20 bp, Artificial Sequence
  Description of Artificial Sequence: Synthetic oligonucleotide
  Target: ATXN1; (-) strand; PAM type: NRG; PAM sequence: TAG
agactaatatatatatatat

SEQ ID NO: 75956 - DNA, 20 bp, Artificial Sequence
  Description of Artificial Sequence: Synthetic oligonucleotide
  Target: ATXN1; (-) strand; PAM type: NRG; PAM sequence: CAG
tgtattagcttctatctctc

SEQ ID NO: 75957 - DNA, 20 bp, Artificial Sequence
  Description of Artificial Sequence: Synthetic oligonucleotide
  Target: ATXN1; (-) strand; PAM type: NRG; PAM sequence: TAG
aattggactaatatatgtat

SEQ ID NO: 75958 - DNA, 20 bp, Artificial Sequence
  Description of Artificial Sequence: Synthetic oligonucleotide
  Target: ATXN1; (-) strand; PAM type: NRG; PAM sequence: TGG
agactaatatgtataataat

SEQ ID NO: 75959 - DNA, 20 bp, Artificial Sequence
  Description of Artificial Sequence: Synthetic oligonucleotide
  Target: ATXN1; (-) strand; PAM type: NRG; PAM sequence: TAG
ttagtctaatatataataat

SEQ ID NO: 75960 - DNA, 20 bp, Artificial Sequence
  Description of Artificial Sequence: Synthetic oligonucleotide
  Target: ATXN1; (-) strand; PAM type: NRG; PAM sequence: TAG
ctatctctatagacatatat

SEQ ID NO: 75961 - DNA, 20 bp, Artificial Sequence
  Description of Artificial Sequence: Synthetic oligonucleotide
  Target: ATXN1; (-) strand; PAM type: NRG; PAM sequence: TAG
tatattagcttctatctcta

SEQ ID NO: 75962 - DNA, 20 bp, Artificial Sequence
  Description of Artificial Sequence: Synthetic oligonucleotide
  Target: ATXN1; (-) strand; PAM type: NRG; PAM sequence: TAG
aatttgactaatatgtatat

SEQ ID NO: 75963 - DNA, 20 bp, Artificial Sequence
  Description of Artificial Sequence: Synthetic oligonucleotide
  Target: ATXN1; (-) strand; PAM type: NRG; PAM sequence: TAG
ccctgtagactaatatatat

SEQ ID NO: 75964 - DNA, 20 bp, Artificial Sequence
  Description of Artificial Sequence: Synthetic oligonucleotide
  Target: ATXN1; (-) strand; PAM type: NRG; PAM sequence: TAG
tatattagcttctatccctg

SEQ ID NO: 75965 - DNA, 20 bp, Artificial Sequence
  Description of Artificial Sequence: Synthetic oligonucleotide
  Target: ATXN1; (-) strand; PAM type: NRG; PAM sequence: TAG
ttaattagactaatatatat

SEQ ID NO: 75966 - DNA, 20 bp, Artificial Sequence
  Description of Artificial Sequence: Synthetic oligonucleotide
  Target: ATXN1; (-) strand; PAM type: NRG; PAM sequence: TAG
agactaatatatatattaat

SEQ ID NO: 75967 - DNA, 20 bp, Artificial Sequence
  Description of Artificial Sequence: Synthetic oligonucleotide
  Target: ATXN1; (-) strand; PAM type: NRG; PAM sequence: TAG
ttagtctaatatatgacaat

SEQ ID NO: 75968 - DNA, 20 bp, Artificial Sequence
  Description of Artificial Sequence: Synthetic oligonucleotide
  Target: ATXN1; (-) strand; PAM type: NRG; PAM sequence: TAG
acagacatatatatatatat

SEQ ID NO: 75969 - DNA, 20 bp, Artificial Sequence
  Description of Artificial Sequence: Synthetic oligonucleotide
  Target: ATXN1; (-) strand; PAM type: NRG; PAM sequence: CAG
aaaattttaaaggtcgtcaa

SEQ ID NO: 75970 - DNA, 20 bp, Artificial Sequence
  Description of Artificial Sequence: Synthetic oligonucleotide
  Target: ATXN1; (-) strand; PAM type: NRG; PAM sequence: AGG
cgaagctgaaaaaattttaa

SEQ ID NO: 75971 - DNA, 20 bp, Artificial Sequence
  Description of Artificial Sequence: Synthetic oligonucleotide
  Target: ATXN1; (-) strand; PAM type: NRG; PAM sequence: AAG
acgaagctgaaaaaatttta

SEQ ID NO: 75972 - DNA, 20 bp, Artificial Sequence
  Description of Artificial Sequence: Synthetic oligonucleotide
  Target: ATXN1; (-) strand; PAM type: NRG; PAM sequence: AAG
ttctaatagaaaaaaaaacg

SEQ ID NO: 75973 - DNA, 20 bp, Artificial Sequence
  Description of Artificial Sequence: Synthetic oligonucleotide
  Target: ATXN1; (-) strand; PAM type: NRG; PAM sequence: TAG
ggacacagcattgtttctaa

SEQ ID NO: 75974 - DNA, 20 bp, Artificial Sequence
  Description of Artificial Sequence: Synthetic oligonucleotide
  Target: ATXN1; (-) strand; PAM type: NRG; PAM sequence: CAG
ggtattgttcctaatggaca

SEQ ID NO: 75975 - DNA, 20 bp, Artificial Sequence
  Description of Artificial Sequence: Synthetic oligonucleotide
  Target: ATXN1; (-) strand; PAM type: NRG; PAM sequence: TGG
ctgatgggtattgttcctaa

SEQ ID NO: 75976 - DNA, 20 bp, Artificial Sequence
  Description of Artificial Sequence: Synthetic oligonucleotide
  Target: ATXN1; (-) strand; PAM type: NRG; PAM sequence: GGG
ccagggaaacttatgctgat

SEQ ID NO: 75977 - DNA, 20 bp, Artificial Sequence
  Description of Artificial Sequence: Synthetic oligonucleotide
  Target: ATXN1; (-) strand; PAM type: NRG; PAM sequence: TGG
cccagggaaacttatgctga

SEQ ID NO: 75978 - DNA, 20 bp, Artificial Sequence
  Description of Artificial Sequence: Synthetic oligonucleotide
  Target: ATXN1; (-) strand; PAM type: NRG; PAM sequence: GGG
cattcctaggcaataaccca

SEQ ID NO: 75979 - DNA, 20 bp, Artificial Sequence
  Description of Artificial Sequence: Synthetic oligonucleotide
  Target: ATXN1; (-) strand; PAM type: NRG; PAM sequence: AGG
ccattcctaggcaataaccc

SEQ ID NO: 75980 - DNA, 20 bp, Artificial Sequence
  Description of Artificial Sequence: Synthetic oligonucleotide
  Target: ATXN1; (-) strand; PAM type: NRG; PAM sequence: CAG
cccattcctaggcaataacc

SEQ ID NO: 75981 - DNA, 20 bp, Artificial Sequence
  Description of Artificial Sequence: Synthetic oligonucleotide
  Target: ATXN1; (-) strand; PAM type: NRG; PAM sequence: AGG
atattcatagacccattcct

SEQ ID NO: 75982 - DNA, 20 bp, Artificial Sequence
  Description of Artificial Sequence: Synthetic oligonucleotide
  Target: ATXN1; (-) strand; PAM type: NRG; PAM sequence: TAG
aatattcatagacccattcc

SEQ ID NO: 75983 - DNA, 20 bp, Artificial Sequence
  Description of Artificial Sequence: Synthetic oligonucleotide
  Target: ATXN1; (-) strand; PAM type: NRG; PAM sequence: TAG
tgtttaacagtgaatattca

SEQ ID NO: 75984 - DNA, 20 bp, Artificial Sequence
  Description of Artificial Sequence: Synthetic oligonucleotide
  Target: ATXN1; (-) strand; PAM type: NRG; PAM sequence: CAG
aatttggcactattgtttaa

SEQ ID NO: 75985 - DNA, 20 bp, Artificial Sequence
  Description of Artificial Sequence: Synthetic oligonucleotide
  Target: ATXN1; (-) strand; PAM type: NRG; PAM sequence: TGG
agtcatttgggaaagcaatt

SEQ ID NO: 75986 - DNA, 20 bp, Artificial Sequence
  Description of Artificial Sequence: Synthetic oligonucleotide
  Target: ATXN1; (-) strand; PAM type: NRG; PAM sequence: AAG
gttgatatagtcatttggga

SEQ ID NO: 75987 - DNA, 20 bp, Artificial Sequence
  Description of Artificial Sequence: Synthetic oligonucleotide
  Target: ATXN1; (-) strand; PAM type: NRG; PAM sequence: GGG
gtaggttgatatagtcattt

SEQ ID NO: 75988 - DNA, 20 bp, Artificial Sequence
  Description of Artificial Sequence: Synthetic oligonucleotide
  Target: ATXN1; (-) strand; PAM type: NRG; PAM sequence: TGG
tgtaggttgatatagtcatt

SEQ ID NO: 75989 - DNA, 20 bp, Artificial Sequence
  Description of Artificial Sequence: Synthetic oligonucleotide
  Target: ATXN1; (-) strand; PAM type: NRG; PAM sequence: TAG
ggtgggagtgtaggttgata

SEQ ID NO: 75990 - DNA, 20 bp, Artificial Sequence
  Description of Artificial Sequence: Synthetic oligonucleotide
  Target: ATXN1; (-) strand; PAM type: NRG; PAM sequence: AGG
tgcactgctggtgggagtgt

SEQ ID NO: 75991 - DNA, 20 bp, Artificial Sequence
  Description of Artificial Sequence: Synthetic oligonucleotide
  Target: ATXN1; (-) strand; PAM type: NRG; PAM sequence: TAG
gtgcactgctggtgggagtg

SEQ ID NO: 75992 - DNA, 20 bp, Artificial Sequence
  Description of Artificial Sequence: Synthetic oligonucleotide
  Target: ATXN1; (-) strand; PAM type: NRG; PAM sequence: GAG
gtggggtgcactgctggtgg

SEQ ID NO: 75993 - DNA, 20 bp, Artificial Sequence
  Description of Artificial Sequence: Synthetic oligonucleotide
  Target: ATXN1; (-) strand; PAM type: NRG; PAM sequence: GGG
tggtggggtgcactgctggt

SEQ ID NO: 75994 - DNA, 20 bp, Artificial Sequence
  Description of Artificial Sequence: Synthetic oligonucleotide
  Target: ATXN1; (-) strand; PAM type: NRG; PAM sequence: TGG
atggtggggtgcactgctgg

SEQ ID NO: 75995 - DNA, 20 bp, Artificial Sequence
  Description of Artificial Sequence: Synthetic oligonucleotide
  Target: ATXN1; (-) strand; PAM type: NRG; PAM sequence: TGG
aaaatggtggggtgcactgc

SEQ ID NO: 75996 - DNA, 20 bp, Artificial Sequence
  Description of Artificial Sequence: Synthetic oligonucleotide
  Target: ATXN1; (-) strand; PAM type: NRG; PAM sequence: GGG
atcagttttaaaaaatggtg

SEQ ID NO: 75997 - DNA, 20 bp, Artificial Sequence
  Description of Artificial Sequence: Synthetic oligonucleotide
  Target: ATXN1; (-) strand; PAM type: NRG; PAM sequence: GGG
tatcagttttaaaaaatggt

SEQ ID NO: 75998 - DNA, 20 bp, Artificial Sequence
  Description of Artificial Sequence: Synthetic oligonucleotide
  Target: ATXN1; (-) strand; PAM type: NRG; PAM sequence: TGG
ttatcagttttaaaaaatgg

SEQ ID NO: 75999 - DNA, 20 bp, Artificial Sequence
  Description of Artificial Sequence: Synthetic oligonucleotide
  Target: ATXN1; (-) strand; PAM type: NRG; PAM sequence: TGG
gatttatcagttttaaaaaa

SEQ ID NO: 76000 - DNA, 20 bp, Artificial Sequence
  Description of Artificial Sequence: Synthetic oligonucleotide
  Target: ATXN1; (-) strand; PAM type: NRG; PAM sequence: CAG
ttgattctgaaatgatttat

SEQ ID NO: 76001 - DNA, 20 bp, Artificial Sequence
  Description of Artificial Sequence: Synthetic oligonucleotide
  Target: ATXN1; (-) strand; PAM type: NRG; PAM sequence: TAG
aacaccaacttcagcacaaa

SEQ ID NO: 76002 - DNA, 20 bp, Artificial Sequence
  Description of Artificial Sequence: Synthetic oligonucleotide
  Target: ATXN1; (-) strand; PAM type: NRG; PAM sequence: CAG
tgagcctgtaacaccaactt

SEQ ID NO: 76003 - DNA, 20 bp, Artificial Sequence
  Description of Artificial Sequence: Synthetic oligonucleotide
  Target: ATXN1; (-) strand; PAM type: NRG; PAM sequence: GAG
aaaaggaaaaaaaggaattt

SEQ ID NO: 76004 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaaggaaaaaa

SEQ ID NO: 76005 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaggaaaaa

SEQ ID NO: 76006 - DNA, 20 bp, Artificial Sequence
  Description of Artificial Sequence: Synthetic oligonucleotide
  Target: ATXN1; (-) strand; PAM type: NRG; PAM sequence: AGG
aaataaataaaaaaaaaaaa

SEQ ID NO: 76007 - DNA, 20 bp, Artificial Sequence
  Description of Artificial Sequence: Synthetic oligonucleotide
  Target: ATXN1; (-) strand; PAM type: NRG; PAM sequence: AAG
taaataaataaaaaaaaaaa

SEQ ID NO: 76008 - DNA, 20 bp, Artificial Sequence
  Description of Artificial Sequence: Synthetic oligonucleotide
  Target: ATXN1; (-) strand; PAM type: NRG; PAM sequence: GAG
ctccagcctggcgacagaat

SEQ ID NO: 76009 - DNA, 20 bp, Artificial Sequence
  Description of Artificial Sequence: Synthetic oligonucleotide
  Target: ATXN1; (-) strand; PAM type: NRG; PAM sequence: CAG
actgcactccagcctggcga

SEQ ID NO: 76010 - DNA, 20 bp, Artificial Sequence
  Description of Artificial Sequence: Synthetic oligonucleotide
  Target: ATXN1; (-) strand; PAM type: NRG; PAM sequence: TGG
cgtgccactgcactccagcc

SEQ ID NO: 76011 - DNA, 20 bp, Artificial Sequence
  Description of Artificial Sequence: Synthetic oligonucleotide
  Target: ATXN1; (-) strand; PAM type: NRG; PAM sequence: CAG
gagatcgtgccactgcactc

SEQ ID NO: 76012 - DNA, 20 bp, Artificial Sequence
  Description of Artificial Sequence: Synthetic oligonucleotide
  Target: ATXN1; (-) strand; PAM type: NRG; PAM sequence: GAG
ggtggaggctgtagtgagcc

SEQ ID NO: 76013 - DNA, 20 bp, Artificial Sequence
  Description of Artificial Sequence: Synthetic oligonucleotide
  Target: ATXN1; (-) strand; PAM type: NRG; PAM sequence: GAG
caggaggtggaggctgtagt

SEQ ID NO: 76014 - DNA, 20 bp, Artificial Sequence
  Description of Artificial Sequence: Synthetic oligonucleotide
  Target: ATXN1; (-) strand; PAM type: NRG; PAM sequence: TAG
aacccaggaggtggaggctg

SEQ ID NO: 76015 - DNA, 20 bp, Artificial Sequence
  Description of Artificial Sequence: Synthetic oligonucleotide
  Target: ATXN1; (-) strand; PAM type: NRG; PAM sequence: AGG
cacttgaacccaggaggtgg

SEQ ID NO: 76016 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacccaggaggtg

SEQ ID NO: 76017 - DNA, 20 bp, Artificial Sequence
  Description of Artificial Sequence: Synthetic oligonucleotide
  Target: ATXN1; (-) strand; PAM type: NRG; PAM sequence: TGG
aatcacttgaacccaggagg

SEQ ID NO: 76018 - DNA, 20 bp, Artificial Sequence
  Description of Artificial Sequence: Synthetic oligonucleotide
  Target: ATXN1; (-) strand; PAM type: NRG; PAM sequence: AGG
gagaatcacttgaacccagg

SEQ ID NO: 76019 - DNA, 20 bp, Artificial Sequence
  Description of Artificial Sequence: Synthetic oligonucleotide
  Target: ATXN1; (-) strand; PAM type: NRG; PAM sequence: GAG
ggagaatcacttgaacccag

SEQ ID NO: 76020 - DNA, 20 bp, Artificial Sequence
  Description of Artificial Sequence: Synthetic oligonucleotide
  Target: ATXN1; (-) strand; PAM type: NRG; PAM sequence: AGG
caggagaatcacttgaaccc

SEQ ID NO: 76021 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatcacttgaacc

SEQ ID NO: 76022 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgaggcag

SEQ ID NO: 76023 - DNA, 20 bp, Artificial Sequence
  Description of Artificial Sequence: Synthetic oligonucleotide
  Target: ATXN1; (-) strand; PAM type: NRG; PAM sequence: AGG
gatactcgggaggctgaggc

SEQ ID NO: 76024 - DNA, 20 bp, Artificial Sequence
  Description of Artificial Sequence: Synthetic oligonucleotide
  Target: ATXN1; (-) strand; PAM type: NRG; PAM sequence: CAG
agatactcgggaggctgagg

SEQ ID NO: 76025 - DNA, 20 bp, Artificial Sequence
  Description of Artificial Sequence: Synthetic oligonucleotide
  Target: ATXN1; (-) strand; PAM type: NRG; PAM sequence: AGG
cccagatactcgggaggctg

SEQ ID NO: 76026 - DNA, 20 bp, Artificial Sequence
  Description of Artificial Sequence: Synthetic oligonucleotide
  Target: ATXN1; (-) strand; PAM type: NRG; PAM sequence: GAG
tcccagatactcgggaggct

SEQ ID NO: 76027 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagatactcggg

SEQ ID NO: 76028 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagatactcgg

SEQ ID NO: 76029 - DNA, 20 bp, Artificial Sequence
  Description of Artificial Sequence: Synthetic oligonucleotide
  Target: ATXN1; (-) strand; PAM type: NRG; PAM sequence: GGG
acctgtagtcccagatactc

SEQ ID NO: 76030 - DNA, 20 bp, Artificial Sequence
  Description of Artificial Sequence: Synthetic oligonucleotide
  Target: ATXN1; (-) strand; PAM type: NRG; PAM sequence: CGG
cacctgtagtcccagatact

SEQ ID NO: 76031 - DNA, 20 bp, Artificial Sequence
  Description of Artificial Sequence: Synthetic oligonucleotide
  Target: ATXN1; (-) strand; PAM type: NRG; PAM sequence: CAG
gtggtgcgcacctgtagtcc

SEQ ID NO: 76032 - DNA, 20 bp, Artificial Sequence
  Description of Artificial Sequence: Synthetic oligonucleotide
  Target: ATXN1; (-) strand; PAM type: NRG; PAM sequence: TAG
ggggtggtggtgcgcacctg

SEQ ID NO: 76033 - DNA, 20 bp, Artificial Sequence
  Description of Artificial Sequence: Synthetic oligonucleotide
  Target: ATXN1; (-) strand; PAM type: NRG; PAM sequence: TGG
caaaaattaggtgggggtgg

SEQ ID NO: 76034 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattaggtggggg

SEQ ID NO: 76035 - DNA, 20 bp, Artificial Sequence
  Description of Artificial Sequence: Synthetic oligonucleotide
  Target: ATXN1; (-) strand; PAM type: NRG; PAM sequence: GGG
aaaatacaaaaattaggtgg

SEQ ID NO: 76036 - DNA, 20 bp, Artificial Sequence
  Description of Artificial Sequence: Synthetic oligonucleotide
  Target: ATXN1; (-) strand; PAM type: NRG; PAM sequence: GGG
aaaaatacaaaaattaggtg

SEQ ID NO: 76037 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaattaggt

SEQ ID NO: 76038 - DNA, 20 bp, Artificial Sequence
  Description of Artificial Sequence: Synthetic oligonucleotide
  Target: ATXN1; (-) strand; PAM type: NRG; PAM sequence: TGG
ctaaaaatacaaaaattagg

SEQ ID NO: 76039 - DNA, 20 bp, Artificial Sequence
  Description of Artificial Sequence: Synthetic oligonucleotide
  Target: ATXN1; (-) strand; PAM type: NRG; PAM sequence: AGG
cttctaaaaatacaaaaatt

SEQ ID NO: 76040 - DNA, 20 bp, Artificial Sequence
  Description of Artificial Sequence: Synthetic oligonucleotide
  Target: ATXN1; (-) strand; PAM type: NRG; PAM sequence: TAG
tcttctaaaaatacaaaaat

SEQ ID NO: 76041 - DNA, 20 bp, Artificial Sequence
  Description of Artificial Sequence: Synthetic oligonucleotide
  Target: ATXN1; (-) strand; PAM type: NRG; PAM sequence: TAG
ccagaccgtcctggccaaca

SEQ ID NO: 76042 - DNA, 20 bp, Artificial Sequence
  Description of Artificial Sequence: Synthetic oligonucleotide
  Target: ATXN1; (-) strand; PAM type: NRG; PAM sequence: TGG
tcaagagatccagaccgtcc

SEQ ID NO: 76043 - DNA, 20 bp, Artificial Sequence
  Description of Artificial Sequence: Synthetic oligonucleotide
  Target: ATXN1; (-) strand; PAM type: NRG; PAM sequence: CAG
gatcacgaggtcaagagatc

SEQ ID NO: 76044 - DNA, 20 bp, Artificial Sequence
  Description of Artificial Sequence: Synthetic oligonucleotide
  Target: ATXN1; (-) strand; PAM type: NRG; PAM sequence: GAG
caggcggatcacgaggtcaa

SEQ ID NO: 76045 - DNA, 20 bp, Artificial Sequence
  Description of Artificial Sequence: Synthetic oligonucleotide
  Target: ATXN1; (-) strand; PAM type: NRG; PAM sequence: AAG
ggcaggcggatcacgaggtc

SEQ ID NO: 76046 - DNA, 20 bp, Artificial Sequence
  Description of Artificial Sequence: Synthetic oligonucleotide
  Target: ATXN1; (-) strand; PAM type: NRG; PAM sequence: AGG
gccgaggcaggcggatcacg

SEQ ID NO: 76047 - DNA, 20 bp, Artificial Sequence
  Description of Artificial Sequence: Synthetic oligonucleotide
  Target: ATXN1; (-) strand; PAM type: NRG; PAM sequence: GAG
ggccgaggcaggcggatcac

SEQ ID NO: 76048 - DNA, 20 bp, Artificial Sequence
  Description of Artificial Sequence: Synthetic oligonucleotide
  Target: ATXN1; (-) strand; PAM type: NRG; PAM sequence: CGG
ctttgggaggccgaggcagg

SEQ ID NO: 76049 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggccgaggc

SEQ ID NO: 76050 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggccgagg

SEQ ID NO: 76051 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 76052 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 76053 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 76054 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 76055 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 76056 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 76057 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 76058 - DNA, 20 bp, Artificial Sequence
  Description of Artificial Sequence: Synthetic oligonucleotide
  Target: ATXN1; (-) strand; PAM type: NRG; PAM sequence: TGG
agcctgtaggctgggcacgg

SEQ ID NO: 76059 - DNA, 20 bp, Artificial Sequence
  Description of Artificial Sequence: Synthetic oligonucleotide
  Target: ATXN1; (-) strand; PAM type: NRG; PAM sequence: CGG
ttgagcctgtaggctgggca

SEQ ID NO: 76060 - DNA, 20 bp, Artificial Sequence
  Description of Artificial Sequence: Synthetic oligonucleotide
  Target: ATXN1; (-) strand; PAM type: NRG; PAM sequence: GGG
agaatttgagcctgtaggct

SEQ ID NO: 76061 - DNA, 20 bp, Artificial Sequence
  Description of Artificial Sequence: Synthetic oligonucleotide
  Target: ATXN1; (-) strand; PAM type: NRG; PAM sequence: TGG
tagaatttgagcctgtaggc

SEQ ID NO: 76062 - DNA, 20 bp, Artificial Sequence
  Description of Artificial Sequence: Synthetic oligonucleotide
  Target: ATXN1; (-) strand; PAM type: NRG; PAM sequence: AGG
tatttagaatttgagcctgt

SEQ ID NO: 76063 - DNA, 20 bp, Artificial Sequence
  Description of Artificial Sequence: Synthetic oligonucleotide
  Target: ATXN1; (-) strand; PAM type: NRG; PAM sequence: TAG
atatttagaatttgagcctg

SEQ ID NO: 76064 - DNA, 20 bp, Artificial Sequence
  Description of Artificial Sequence: Synthetic oligonucleotide
  Target: ATXN1; (-) strand; PAM type: NRG; PAM sequence: GAG
tttatggatatttagaattt

SEQ ID NO: 76065 - DNA, 20 bp, Artificial Sequence
  Description of Artificial Sequence: Synthetic oligonucleotide
  Target: ATXN1; (-) strand; PAM type: NRG; PAM sequence: TAG
cttatttctttatggatatt

SEQ ID NO: 76066 - DNA, 20 bp, Artificial Sequence
  Description of Artificial Sequence: Synthetic oligonucleotide
  Target: ATXN1; (-) strand; PAM type: NRG; PAM sequence: TGG
acaggatgcttatttcttta

SEQ ID NO: 76067 - DNA, 20 bp, Artificial Sequence
  Description of Artificial Sequence: Synthetic oligonucleotide
  Target: ATXN1; (-) strand; PAM type: NRG; PAM sequence: AGG
ccaatgtgagagacagggac

SEQ ID NO: 76068 - DNA, 20 bp, Artificial Sequence
  Description of Artificial Sequence: Synthetic oligonucleotide
  Target: ATXN1; (-) strand; PAM type: NRG; PAM sequence: CAG
accaatgtgagagacaggga

SEQ ID NO: 76069 - DNA, 20 bp, Artificial Sequence
  Description of Artificial Sequence: Synthetic oligonucleotide
  Target: ATXN1; (-) strand; PAM type: NRG; PAM sequence: GGG
actcaccaatgtgagagaca

SEQ ID NO: 76070 - DNA, 20 bp, Artificial Sequence
  Description of Artificial Sequence: Synthetic oligonucleotide
  Target: ATXN1; (-) strand; PAM type: NRG; PAM sequence: AGG
aactcaccaatgtgagagac

SEQ ID NO: 76071 - DNA, 20 bp, Artificial Sequence
  Description of Artificial Sequence: Synthetic oligonucleotide
  Target: ATXN1; (-) strand; PAM type: NRG; PAM sequence: CAG
aaactcaccaatgtgagaga

SEQ ID NO: 76072 - DNA, 20 bp, Artificial Sequence
  Description of Artificial Sequence: Synthetic oligonucleotide
  Target: ATXN1; (-) strand; PAM type: NRG; PAM sequence: GAG
gtataaactcaccaatgtga

SEQ ID NO: 76073 - DNA, 20 bp, Artificial Sequence
  Description of Artificial Sequence: Synthetic oligonucleotide
  Target: ATXN1; (-) strand; PAM type: NRG; PAM sequence: GAG
aagtataaactcaccaatgt

SEQ ID NO: 76074 - DNA, 20 bp, Artificial Sequence
  Description of Artificial Sequence: Synthetic oligonucleotide
  Target: ATXN1; (-) strand; PAM type: NRG; PAM sequence: AAG
gttatgcttagtgctgaaca

SEQ ID NO: 76075 - DNA, 20 bp, Artificial Sequence
  Description of Artificial Sequence: Synthetic oligonucleotide
  Target: ATXN1; (-) strand; PAM type: NRG; PAM sequence: TAG
taactctcgtttgttatgct

SEQ ID NO: 76076 - DNA, 20 bp, Artificial Sequence
  Description of Artificial Sequence: Synthetic oligonucleotide
  Target: ATXN1; (-) strand; PAM type: NRG; PAM sequence: AAG
aaagtaaccgtcatcttacg

SEQ ID NO: 76077 - DNA, 20 bp, Artificial Sequence
  Description of Artificial Sequence: Synthetic oligonucleotide
  Target: ATXN1; (-) strand; PAM type: NRG; PAM sequence: AAG
tgccatgtttgaaggtggta

SEQ ID NO: 76078 - DNA, 20 bp, Artificial Sequence
  Description of Artificial Sequence: Synthetic oligonucleotide
  Target: ATXN1; (-) strand; PAM type: NRG; PAM sequence: TGG
gttaatgccatgtttgaagg

SEQ ID NO: 76079 - DNA, 20 bp, Artificial Sequence
  Description of Artificial Sequence: Synthetic oligonucleotide
  Target: ATXN1; (-) strand; PAM type: NRG; PAM sequence: AGG
ttagttaatgccatgtttga

SEQ ID NO: 76080 - DNA, 20 bp, Artificial Sequence
  Description of Artificial Sequence: Synthetic oligonucleotide
  Target: ATXN1; (-) strand; PAM type: NRG; PAM sequence: AAG
attagttaatgccatgtttg

SEQ ID NO: 76081 - DNA, 20 bp, Artificial Sequence
  Description of Artificial Sequence: Synthetic oligonucleotide
  Target: ATXN1; (-) strand; PAM type: NRG; PAM sequence: TAG
ctcagtccaatctaagtcat

SEQ ID NO: 76082 - DNA, 20 bp, Artificial Sequence
  Description of Artificial Sequence: Synthetic oligonucleotide
  Target: ATXN1; (-) strand; PAM type: NRG; PAM sequence: AAG
attaaccctcagtccaatct

SEQ ID NO: 76083 - DNA, 20 bp, Artificial Sequence
  Description of Artificial Sequence: Synthetic oligonucleotide
  Target: ATXN1; (-) strand; PAM type: NRG; PAM sequence: CAG
gtcttcaaattattaaccct

SEQ ID NO: 76084 - DNA, 20 bp, Artificial Sequence
  Description of Artificial Sequence: Synthetic oligonucleotide
  Target: ATXN1; (-) strand; PAM type: NRG; PAM sequence: GAG
ctaggaaagaaggtcatggg

SEQ ID NO: 76085 - DNA, 20 bp, Artificial Sequence
  Description of Artificial Sequence: Synthetic oligonucleotide
  Target: ATXN1; (-) strand; PAM type: NRG; PAM sequence: GGG
gactaggaaagaaggtcatg

SEQ ID NO: 76086 - DNA, 20 bp, Artificial Sequence
  Description of Artificial Sequence: Synthetic oligonucleotide
  Target: ATXN1; (-) strand; PAM type: NRG; PAM sequence: GGG
tgactaggaaagaaggtcat

SEQ ID NO: 76087 - DNA, 20 bp, Artificial Sequence
  Description of Artificial Sequence: Synthetic oligonucleotide
  Target: ATXN1; (-) strand; PAM type: NRG; PAM sequence: TGG
atgactaggaaagaaggtca

SEQ ID NO: 76088 - DNA, 20 bp, Artificial Sequence
  Description of Artificial Sequence: Synthetic oligonucleotide
  Target: ATXN1; (-) strand; PAM type: NRG; PAM sequence: AGG
aattgaatgactaggaaaga

SEQ ID NO: 76089 - DNA, 20 bp, Artificial Sequence
  Description of Artificial Sequence: Synthetic oligonucleotide
  Target: ATXN1; (-) strand; PAM type: NRG; PAM sequence: AAG
gaattgaatgactaggaaag

SEQ ID NO: 76090 - DNA, 20 bp, Artificial Sequence
  Description of Artificial Sequence: Synthetic oligonucleotide
  Target: ATXN1; (-) strand; PAM type: NRG; PAM sequence: AAG
taagaattgaatgactagga

SEQ ID NO: 76091 - DNA, 20 bp, Artificial Sequence
  Description of Artificial Sequence: Synthetic oligonucleotide
  Target: ATXN1; (-) strand; PAM type: NRG; PAM sequence: AGG
tgcttaagaattgaatgact

SEQ ID NO: 76092 - DNA, 20 bp, Artificial Sequence
  Description of Artificial Sequence: Synthetic oligonucleotide
  Target: ATXN1; (-) strand; PAM type: NRG; PAM sequence: TAG
ttgcttaagaattgaatgac

SEQ ID NO: 76093 - DNA, 20 bp, Artificial Sequence
  Description of Artificial Sequence: Synthetic oligonucleotide
  Target: ATXN1; (-) strand; PAM type: NRG; PAM sequence: AAG
ttttggtatccaccttgctt

SEQ ID NO: 76094 - DNA, 20 bp, Artificial Sequence
  Description of Artificial Sequence: Synthetic oligonucleotide
  Target: ATXN1; (-) strand; PAM type: NRG; PAM sequence: TGG
agggcatttttggacacttt

SEQ ID NO: 76095 - DNA, 20 bp, Artificial Sequence
  Description of Artificial Sequence: Synthetic oligonucleotide
  Target: ATXN1; (-) strand; PAM type: NRG; PAM sequence: TGG
catgtacgctagggcatttt

SEQ ID NO: 76096 - DNA, 20 bp, Artificial Sequence
  Description of Artificial Sequence: Synthetic oligonucleotide
  Target: ATXN1; (-) strand; PAM type: NRG; PAM sequence: GGG
ctggcacttcatgtacgcta

SEQ ID NO: 76097 - DNA, 20 bp, Artificial Sequence
  Description of Artificial Sequence: Synthetic oligonucleotide
  Target: ATXN1; (-) strand; PAM type: NRG; PAM sequence: AGG
cctggcacttcatgtacgct

SEQ ID NO: 76098 - DNA, 20 bp, Artificial Sequence
  Description of Artificial Sequence: Synthetic oligonucleotide
  Target: ATXN1; (-) strand; PAM type: NRG; PAM sequence: TAG
ccctggcacttcatgtacgc

SEQ ID NO: 76099 - DNA, 20 bp, Artificial Sequence
  Description of Artificial Sequence: Synthetic oligonucleotide
  Target: ATXN1; (-) strand; PAM type: NRG; PAM sequence: TGG
aagtgggtggttttggcccc

SEQ ID NO: 76100 - DNA, 20 bp, Artificial Sequence
  Description of Artificial Sequence: Synthetic oligonucleotide
  Target: ATXN1; (-) strand; PAM type: NRG; PAM sequence: TGG
ctgttctaagtgggtggttt

SEQ ID NO: 76101 - DNA, 20 bp, Artificial Sequence
  Description of Artificial Sequence: Synthetic oligonucleotide
  Target: ATXN1; (-) strand; PAM type: NRG; PAM sequence: TGG
gatttcctgttctaagtggg

SEQ ID NO: 76102 - DNA, 20 bp, Artificial Sequence
  Description of Artificial Sequence: Synthetic oligonucleotide
  Target: ATXN1; (-) strand; PAM type: NRG; PAM sequence: GGG
catgatttcctgttctaagt

SEQ ID NO: 76103 - DNA, 20 bp, Artificial Sequence
  Description of Artificial Sequence: Synthetic oligonucleotide
  Target: ATXN1; (-) strand; PAM type: NRG; PAM sequence: TGG
acatgatttcctgttctaag

SEQ ID NO: 76104 - DNA, 20 bp, Artificial Sequence
  Description of Artificial Sequence: Synthetic oligonucleotide
  Target: ATXN1; (-) strand; PAM type: NRG; PAM sequence: AAG
tgtacatgatttcctgttct

SEQ ID NO: 76105 - DNA, 20 bp, Artificial Sequence
  Description of Artificial Sequence: Synthetic oligonucleotide
  Target: ATXN1; (-) strand; PAM type: NRG; PAM sequence: AGG
ctctcaatttcacaagcttg

SEQ ID NO: 76106 - DNA, 20 bp, Artificial Sequence
  Description of Artificial Sequence: Synthetic oligonucleotide
  Target: ATXN1; (-) strand; PAM type: NRG; PAM sequence: GAG
tctctcaatttcacaagctt

SEQ ID NO: 76107 - DNA, 20 bp, Artificial Sequence
  Description of Artificial Sequence: Synthetic oligonucleotide
  Target: ATXN1; (-) strand; PAM type: NRG; PAM sequence: AAG
aagaagtctctcaatttcac

SEQ ID NO: 76108 - DNA, 20 bp, Artificial Sequence
  Description of Artificial Sequence: Synthetic oligonucleotide
  Target: ATXN1; (-) strand; PAM type: NRG; PAM sequence: AAG
taatagtgaaggaaataaag

SEQ ID NO: 76109 - DNA, 20 bp, Artificial Sequence
  Description of Artificial Sequence: Synthetic oligonucleotide
  Target: ATXN1; (-) strand; PAM type: NRG; PAM sequence: AAG
ttctaatagtgaaggaaata

SEQ ID NO: 76110 - DNA, 20 bp, Artificial Sequence
  Description of Artificial Sequence: Synthetic oligonucleotide
  Target: ATXN1; (-) strand; PAM type: NRG; PAM sequence: AGG
tcctctgcttctaatagtga

SEQ ID NO: 76111 - DNA, 20 bp, Artificial Sequence
  Description of Artificial Sequence: Synthetic oligonucleotide
  Target: ATXN1; (-) strand; PAM type: NRG; PAM sequence: AAG
ttcctctgcttctaatagtg

SEQ ID NO: 76112 - DNA, 20 bp, Artificial Sequence
  Description of Artificial Sequence: Synthetic oligonucleotide
  Target: ATXN1; (-) strand; PAM type: NRG; PAM sequence: TAG
ctctcttcctctgcttctaa

SEQ ID NO: 76113 - DNA, 20 bp, Artificial Sequence
  Description of Artificial Sequence: Synthetic oligonucleotide
  Target: ATXN1; (-) strand; PAM type: NRG; PAM sequence: CAG
aagccttccccccatctaat

SEQ ID NO: 76114 - DNA, 20 bp, Artificial Sequence
  Description of Artificial Sequence: Synthetic oligonucleotide
  Target: ATXN1; (-) strand; PAM type: NRG; PAM sequence: AAG
gctattttaaaataaaagct

SEQ ID NO: 76115 - DNA, 20 bp, Artificial Sequence
  Description of Artificial Sequence: Synthetic oligonucleotide
  Target: ATXN1; (-) strand; PAM type: NRG; PAM sequence: AAG
attttgctattttaaaataa

SEQ ID NO: 76116 - DNA, 20 bp, Artificial Sequence
  Description of Artificial Sequence: Synthetic oligonucleotide
  Target: ATXN1; (-) strand; PAM type: NRG; PAM sequence: AAG
tctggcaaaatctaattaca

SEQ ID NO: 76117 - DNA, 20 bp, Artificial Sequence
  Description of Artificial Sequence: Synthetic oligonucleotide
  Target: ATXN1; (-) strand; PAM type: NRG; PAM sequence: TGG
ttttcctttaagcctaagtc

SEQ ID NO: 76118 - DNA, 20 bp, Artificial Sequence
  Description of Artificial Sequence: Synthetic oligonucleotide
  Target: ATXN1; (-) strand; PAM type: NRG; PAM sequence: AAG
aatcattttcctttaagcct

SEQ ID NO: 76119 - DNA, 20 bp, Artificial Sequence
  Description of Artificial Sequence: Synthetic oligonucleotide
  Target: ATXN1; (-) strand; PAM type: NRG; PAM sequence: AAG
ggaaagaatcattttccttt

SEQ ID NO: 76120 - DNA, 20 bp, Artificial Sequence
  Description of Artificial Sequence: Synthetic oligonucleotide
  Target: ATXN1; (-) strand; PAM type: NRG; PAM sequence: AAG
ccttattcttttggagagga

SEQ ID NO: 76121 - DNA, 20 bp, Artificial Sequence
  Description of Artificial Sequence: Synthetic oligonucleotide
  Target: ATXN1; (-) strand; PAM type: NRG; PAM sequence: AGG
ctgaccttattcttttggag

SEQ ID NO: 76122 - DNA, 20 bp, Artificial Sequence
  Description of Artificial Sequence: Synthetic oligonucleotide
  Target: ATXN1; (-) strand; PAM type: NRG; PAM sequence: GAG
tctgaccttattcttttgga

SEQ ID NO: 76123 - DNA, 20 bp, Artificial Sequence
  Description of Artificial Sequence: Synthetic oligonucleotide
  Target: ATXN1; (-) strand; PAM type: NRG; PAM sequence: GAG
gctctgaccttattcttttg

SEQ ID NO: 76124 - DNA, 20 bp, Artificial Sequence
  Description of Artificial Sequence: Synthetic oligonucleotide
  Target: ATXN1; (-) strand; PAM type: NRG; PAM sequence: TGG
aggctctgaccttattcttt

SEQ ID NO: 76125 - DNA, 20 bp, Artificial Sequence
  Description of Artificial Sequence: Synthetic oligonucleotide
  Target: ATXN1; (-) strand; PAM type: NRG; PAM sequence: AGG
accaaaggtttgggagtctt

SEQ ID NO: 76126 - DNA, 20 bp, Artificial Sequence
  Description of Artificial Sequence: Synthetic oligonucleotide
  Target: ATXN1; (-) strand; PAM type: NRG; PAM sequence: TAG
gaccaaaggtttgggagtct

SEQ ID NO: 76127 - DNA, 20 bp, Artificial Sequence
  Description of Artificial Sequence: Synthetic oligonucleotide
  Target: ATXN1; (-) strand; PAM type: NRG; PAM sequence: GAG
agccaggaccaaaggtttgg

SEQ ID NO: 76128 - DNA, 20 bp, Artificial Sequence
  Description of Artificial Sequence: Synthetic oligonucleotide
  Target: ATXN1; (-) strand; PAM type: NRG; PAM sequence: GGG
tgagccaggaccaaaggttt

SEQ ID NO: 76129 - DNA, 20 bp, Artificial Sequence
  Description of Artificial Sequence: Synthetic oligonucleotide
  Target: ATXN1; (-) strand; PAM type: NRG; PAM sequence: TGG
ttgagccaggaccaaaggtt

SEQ ID NO: 76130 - DNA, 20 bp, Artificial Sequence
  Description of Artificial Sequence: Synthetic oligonucleotide
  Target: ATXN1; (-) strand; PAM type: NRG; PAM sequence: AGG
accctttgagccaggaccaa

SEQ ID NO: 76131 - DNA, 20 bp, Artificial Sequence
  Description of Artificial Sequence: Synthetic oligonucleotide
  Target: ATXN1; (-) strand; PAM type: NRG; PAM sequence: AAG
caccctttgagccaggacca

SEQ ID NO: 76132 - DNA, 20 bp, Artificial Sequence
  Description of Artificial Sequence: Synthetic oligonucleotide
  Target: ATXN1; (-) strand; PAM type: NRG; PAM sequence: AGG
cgtagctcaccctttgagcc

SEQ ID NO: 76133 - DNA, 20 bp, Artificial Sequence
  Description of Artificial Sequence: Synthetic oligonucleotide
  Target: ATXN1; (-) strand; PAM type: NRG; PAM sequence: CAG
tcgtagctcaccctttgagc

SEQ ID NO: 76134 - DNA, 20 bp, Artificial Sequence
  Description of Artificial Sequence: Synthetic oligonucleotide
  Target: ATXN1; (-) strand; PAM type: NRG; PAM sequence: GAG
cgattcgtagctcacccttt

SEQ ID NO: 76135 - DNA, 20 bp, Artificial Sequence
  Description of Artificial Sequence: Synthetic oligonucleotide
  Target: ATXN1; (-) strand; PAM type: NRG; PAM sequence: TAG
atgaagaacgggccgattcg

SEQ ID NO: 76136 - DNA, 20 bp, Artificial Sequence
  Description of Artificial Sequence: Synthetic oligonucleotide
  Target: ATXN1; (-) strand; PAM type: NRG; PAM sequence: GGG
gtaggaggatgatgaagaac

SEQ ID NO: 76137 - DNA, 20 bp, Artificial Sequence
  Description of Artificial Sequence: Synthetic oligonucleotide
  Target: ATXN1; (-) strand; PAM type: NRG; PAM sequence: CGG
tgtaggaggatgatgaagaa

SEQ ID NO: 76138 - DNA, 20 bp, Artificial Sequence
  Description of Artificial Sequence: Synthetic oligonucleotide
  Target: ATXN1; (-) strand; PAM type: NRG; PAM sequence: AAG
gtatatgtaggaggatgatg

SEQ ID NO: 76139 - DNA, 20 bp, Artificial Sequence
  Description of Artificial Sequence: Synthetic oligonucleotide
  Target: ATXN1; (-) strand; PAM type: NRG; PAM sequence: AGG
gatctataggtatatgtagg

SEQ ID NO: 76140 - DNA, 20 bp, Artificial Sequence
  Description of Artificial Sequence: Synthetic oligonucleotide
  Target: ATXN1; (-) strand; PAM type: NRG; PAM sequence: GAG
agatctataggtatatgtag

SEQ ID NO: 76141 - DNA, 20 bp, Artificial Sequence
  Description of Artificial Sequence: Synthetic oligonucleotide
  Target: ATXN1; (-) strand; PAM type: NRG; PAM sequence: AGG
acagatctataggtatatgt

SEQ ID NO: 76142 - DNA, 20 bp, Artificial Sequence
  Description of Artificial Sequence: Synthetic oligonucleotide
  Target: ATXN1; (-) strand; PAM type: NRG; PAM sequence: TAG
gacagatctataggtatatg

SEQ ID NO: 76143 - DNA, 20 bp, Artificial Sequence
  Description of Artificial Sequence: Synthetic oligonucleotide
  Target: ATXN1; (-) strand; PAM type: NRG; PAM sequence: AGG
tcatgcccagacagatctat

SEQ ID NO: 76144 - DNA, 20 bp, Artificial Sequence
  Description of Artificial Sequence: Synthetic oligonucleotide
  Target: ATXN1; (-) strand; PAM type: NRG; PAM sequence: TAG
ctcatgcccagacagatcta

SEQ ID NO: 76145 - DNA, 20 bp, Artificial Sequence
  Description of Artificial Sequence: Synthetic oligonucleotide
  Target: ATXN1; (-) strand; PAM type: NRG; PAM sequence: CAG
attctgtactcatgcccaga

SEQ ID NO: 76146 - DNA, 20 bp, Artificial Sequence
  Description of Artificial Sequence: Synthetic oligonucleotide
  Target: ATXN1; (-) strand; PAM type: NRG; PAM sequence: CAG
gccaattctgtactcatgcc

SEQ ID NO: 76147 - DNA, 20 bp, Artificial Sequence
  Description of Artificial Sequence: Synthetic oligonucleotide
  Target: ATXN1; (-) strand; PAM type: NRG; PAM sequence: CAG
gacacttcttaacatttgaa

SEQ ID NO: 76148 - DNA, 20 bp, Artificial Sequence
  Description of Artificial Sequence: Synthetic oligonucleotide
  Target: ATXN1; (-) strand; PAM type: NRG; PAM sequence: TGG
attaacttcagcgtcagctg

SEQ ID NO: 76149 - DNA, 20 bp, Artificial Sequence
  Description of Artificial Sequence: Synthetic oligonucleotide
  Target: ATXN1; (-) strand; PAM type: NRG; PAM sequence: CAG
ctccagattaacttcagcgt

SEQ ID NO: 76150 - DNA, 20 bp, Artificial Sequence
  Description of Artificial Sequence: Synthetic oligonucleotide
  Target: ATXN1; (-) strand; PAM type: NRG; PAM sequence: CAG
gttcccctccagattaactt

SEQ ID NO: 76151 - DNA, 20 bp, Artificial Sequence
  Description of Artificial Sequence: Synthetic oligonucleotide
  Target: ATXN1; (-) strand; PAM type: NRG; PAM sequence: CAG
aaggtaaattagttcccctc

SEQ ID NO: 76152 - DNA, 20 bp, Artificial Sequence
  Description of Artificial Sequence: Synthetic oligonucleotide
  Target: ATXN1; (-) strand; PAM type: NRG; PAM sequence: TAG
ttgtgttaaagaaggtaaat

SEQ ID NO: 76153 - DNA, 20 bp, Artificial Sequence
  Description of Artificial Sequence: Synthetic oligonucleotide
  Target: ATXN1; (-) strand; PAM type: NRG; PAM sequence: AGG
atctccacttgtgttaaaga

SEQ ID NO: 76154 - DNA, 20 bp, Artificial Sequence
  Description of Artificial Sequence: Synthetic oligonucleotide
  Target: ATXN1; (-) strand; PAM type: NRG; PAM sequence: AAG
catctccacttgtgttaaag

SEQ ID NO: 76155 - DNA, 20 bp, Artificial Sequence
  Description of Artificial Sequence: Synthetic oligonucleotide
  Target: ATXN1; (-) strand; PAM type: NRG; PAM sequence: AAG
cctcatctccacttgtgtta

SEQ ID NO: 76156 - DNA, 20 bp, Artificial Sequence
  Description of Artificial Sequence: Synthetic oligonucleotide
  Target: ATXN1; (-) strand; PAM type: NRG; PAM sequence: CAG
aacacactgactgtgtttca

SEQ ID NO: 76157 - DNA, 20 bp, Artificial Sequence
  Description of Artificial Sequence: Synthetic oligonucleotide
  Target: ATXN1; (-) strand; PAM type: NRG; PAM sequence: AAG
gaaagagaccataatggaga

SEQ ID NO: 76158 - DNA, 20 bp, Artificial Sequence
  Description of Artificial Sequence: Synthetic oligonucleotide
  Target: ATXN1; (-) strand; PAM type: NRG; PAM sequence: GAG
gtaagaaagagaccataatg

SEQ ID NO: 76159 - DNA, 20 bp, Artificial Sequence
  Description of Artificial Sequence: Synthetic oligonucleotide
  Target: ATXN1; (-) strand; PAM type: NRG; PAM sequence: TGG
cagtaagaaagagaccataa

SEQ ID NO: 76160 - DNA, 20 bp, Artificial Sequence
  Description of Artificial Sequence: Synthetic oligonucleotide
  Target: ATXN1; (-) strand; PAM type: NRG; PAM sequence: GAG
tgtagttaaccagtaagaaa

SEQ ID NO: 76161 - DNA, 20 bp, Artificial Sequence
  Description of Artificial Sequence: Synthetic oligonucleotide
  Target: ATXN1; (-) strand; PAM type: NRG; PAM sequence: AAG
tttgtagttaaccagtaaga

SEQ ID NO: 76162 - DNA, 20 bp, Artificial Sequence
  Description of Artificial Sequence: Synthetic oligonucleotide
  Target: ATXN1; (-) strand; PAM type: NRG; PAM sequence: AAG
gctttttgtagttaaccagt

SEQ ID NO: 76163 - DNA, 20 bp, Artificial Sequence
  Description of Artificial Sequence: Synthetic oligonucleotide
  Target: ATXN1; (-) strand; PAM type: NRG; PAM sequence: CAG
ccttgctttttgtagttaac

SEQ ID NO: 76164 - DNA, 20 bp, Artificial Sequence
  Description of Artificial Sequence: Synthetic oligonucleotide
  Target: ATXN1; (-) strand; PAM type: NRG; PAM sequence: TAG
agccatttccttgctttttg

SEQ ID NO: 76165 - DNA, 20 bp, Artificial Sequence
  Description of Artificial Sequence: Synthetic oligonucleotide
  Target: ATXN1; (-) strand; PAM type: NRG; PAM sequence: CAG
tcccctcactgcctgccttt

SEQ ID NO: 76166 - DNA, 20 bp, Artificial Sequence
  Description of Artificial Sequence: Synthetic oligonucleotide
  Target: ATXN1; (-) strand; PAM type: NRG; PAM sequence: AAG
gacatccttcgtacaggtga

SEQ ID NO: 76167 - DNA, 20 bp, Artificial Sequence
  Description of Artificial Sequence: Synthetic oligonucleotide
  Target: ATXN1; (-) strand; PAM type: NRG; PAM sequence: AGG
tccagagacatccttcgtac

SEQ ID NO: 76168 - DNA, 20 bp, Artificial Sequence
  Description of Artificial Sequence: Synthetic oligonucleotide
  Target: ATXN1; (-) strand; PAM type: NRG; PAM sequence: CAG
ttccagagacatccttcgta

SEQ ID NO: 76169 - DNA, 20 bp, Artificial Sequence
  Description of Artificial Sequence: Synthetic oligonucleotide
  Target: ATXN1; (-) strand; PAM type: NRG; PAM sequence: GAG
tgtcaacattccgttttcca

SEQ ID NO: 76170 - DNA, 20 bp, Artificial Sequence
  Description of Artificial Sequence: Synthetic oligonucleotide
  Target: ATXN1; (-) strand; PAM type: NRG; PAM sequence: CAG
tctgtcaacattccgttttc

SEQ ID NO: 76171 - DNA, 20 bp, Artificial Sequence
  Description of Artificial Sequence: Synthetic oligonucleotide
  Target: ATXN1; (-) strand; PAM type: NRG; PAM sequence: TAG
ggtgacttaacaggcattaa

SEQ ID NO: 76172 - DNA, 20 bp, Artificial Sequence
  Description of Artificial Sequence: Synthetic oligonucleotide
  Target: ATXN1; (-) strand; PAM type: NRG; PAM sequence: AGG
tctcaaaaaggtgacttaac

SEQ ID NO: 76173 - DNA, 20 bp, Artificial Sequence
  Description of Artificial Sequence: Synthetic oligonucleotide
  Target: ATXN1; (-) strand; PAM type: NRG; PAM sequence: CAG
atctcaaaaaggtgacttaa

SEQ ID NO: 76174 - DNA, 20 bp, Artificial Sequence
  Description of Artificial Sequence: Synthetic oligonucleotide
  Target: ATXN1; (-) strand; PAM type: NRG; PAM sequence: AGG
gtcaccaaaaaatctcaaaa

SEQ ID NO: 76175 - DNA, 20 bp, Artificial Sequence
  Description of Artificial Sequence: Synthetic oligonucleotide
  Target: ATXN1; (-) strand; PAM type: NRG; PAM sequence: AAG
agtcaccaaaaaatctcaaa

SEQ ID NO: 76176 - DNA, 20 bp, Artificial Sequence
  Description of Artificial Sequence: Synthetic oligonucleotide
  Target: ATXN1; (-) strand; PAM type: NRG; PAM sequence: TAG
gaggcataagacttcactga

SEQ ID NO: 76177 - DNA, 20 bp, Artificial Sequence
  Description of Artificial Sequence: Synthetic oligonucleotide
  Target: ATXN1; (-) strand; PAM type: NRG; PAM sequence: AAG
gagaatttaataagaggcat

SEQ ID NO: 76178 - DNA, 20 bp, Artificial Sequence
  Description of Artificial Sequence: Synthetic oligonucleotide
  Target: ATXN1; (-) strand; PAM type: NRG; PAM sequence: AGG
cagtgtgagaatttaataag

SEQ ID NO: 76179 - DNA, 20 bp, Artificial Sequence
  Description of Artificial Sequence: Synthetic oligonucleotide
  Target: ATXN1; (-) strand; PAM type: NRG; PAM sequence: GAG
acagtgtgagaatttaataa

SEQ ID NO: 76180 - DNA, 20 bp, Artificial Sequence
  Description of Artificial Sequence: Synthetic oligonucleotide
  Target: ATXN1; (-) strand; PAM type: NRG; PAM sequence: AAG
aaacagtgtgagaatttaat

SEQ ID NO: 76181 - DNA, 20 bp, Artificial Sequence
  Description of Artificial Sequence: Synthetic oligonucleotide
  Target: ATXN1; (-) strand; PAM type: NRG; PAM sequence: GAG
ctacttaattaaaacagtgt

SEQ ID NO: 76182 - DNA, 20 bp, Artificial Sequence
  Description of Artificial Sequence: Synthetic oligonucleotide
  Target: ATXN1; (-) strand; PAM type: NRG; PAM sequence: CAG
aaggccctacttaattaaaa

SEQ ID NO: 76183 - DNA, 20 bp, Artificial Sequence
  Description of Artificial Sequence: Synthetic oligonucleotide
  Target: ATXN1; (-) strand; PAM type: NRG; PAM sequence: AGG
ccaccactgtgattaaaata

SEQ ID NO: 76184 - DNA, 20 bp, Artificial Sequence
  Description of Artificial Sequence: Synthetic oligonucleotide
  Target: ATXN1; (-) strand; PAM type: NRG; PAM sequence: AAG
accaccactgtgattaaaat

SEQ ID NO: 76185 - DNA, 20 bp, Artificial Sequence
  Description of Artificial Sequence: Synthetic oligonucleotide
  Target: ATXN1; (-) strand; PAM type: NRG; PAM sequence: AGG
ctcactagcttaaaacgaga

SEQ ID NO: 76186 - DNA, 20 bp, Artificial Sequence
  Description of Artificial Sequence: Synthetic oligonucleotide
  Target: ATXN1; (-) strand; PAM type: NRG; PAM sequence: AAG
gctcactagcttaaaacgag

SEQ ID NO: 76187 - DNA, 20 bp, Artificial Sequence
  Description of Artificial Sequence: Synthetic oligonucleotide
  Target: ATXN1; (-) strand; PAM type: NRG; PAM sequence: GAG
ccagctcactagcttaaaac

SEQ ID NO: 76188 - DNA, 20 bp, Artificial Sequence
  Description of Artificial Sequence: Synthetic oligonucleotide
  Target: ATXN1; (-) strand; PAM type: NRG; PAM sequence: TAG
ctggctgggttccagctcac

SEQ ID NO: 76189 - DNA, 20 bp, Artificial Sequence
  Description of Artificial Sequence: Synthetic oligonucleotide
  Target: ATXN1; (-) strand; PAM type: NRG; PAM sequence: CAG
aacactgcctggctgggttc

SEQ ID NO: 76190 - DNA, 20 bp, Artificial Sequence
  Description of Artificial Sequence: Synthetic oligonucleotide
  Target: ATXN1; (-) strand; PAM type: NRG; PAM sequence: GGG
ctgtttaacactgcctggct

SEQ ID NO: 76191 - DNA, 20 bp, Artificial Sequence
  Description of Artificial Sequence: Synthetic oligonucleotide
  Target: ATXN1; (-) strand; PAM type: NRG; PAM sequence: TGG
cctgtttaacactgcctggc

SEQ ID NO: 76192 - DNA, 20 bp, Artificial Sequence
  Description of Artificial Sequence: Synthetic oligonucleotide
  Target: ATXN1; (-) strand; PAM type: NRG; PAM sequence: TGG
cgctcctgtttaacactgcc

SEQ ID NO: 76193 - DNA, 20 bp, Artificial Sequence
  Description of Artificial Sequence: Synthetic oligonucleotide
  Target: ATXN1; (-) strand; PAM type: NRG; PAM sequence: AAG
gcttccttgacgaagaagga

SEQ ID NO: 76194 - DNA, 20 bp, Artificial Sequence
  Description of Artificial Sequence: Synthetic oligonucleotide
  Target: ATXN1; (-) strand; PAM type: NRG; PAM sequence: AGG
aaaagcttccttgacgaaga

SEQ ID NO: 76195 - DNA, 20 bp, Artificial Sequence
  Description of Artificial Sequence: Synthetic oligonucleotide
  Target: ATXN1; (-) strand; PAM type: NRG; PAM sequence: AAG
caaaagcttccttgacgaag

SEQ ID NO: 76196 - DNA, 20 bp, Artificial Sequence
  Description of Artificial Sequence: Synthetic oligonucleotide
  Target: ATXN1; (-) strand; PAM type: NRG; PAM sequence: AAG
ctgcaaaagcttccttgacg

SEQ ID NO: 76197 - DNA, 20 bp, Artificial Sequence
  Description of Artificial Sequence: Synthetic oligonucleotide
  Target: ATXN1; (-) strand; PAM type: NRG; PAM sequence: AAG
acaaaataacggggctgcaa

SEQ ID NO: 76198 - DNA, 20 bp, Artificial Sequence
  Description of Artificial Sequence: Synthetic oligonucleotide
  Target: ATXN1; (-) strand; PAM type: NRG; PAM sequence: GGG
aataaaaaaacaaaataacg

SEQ ID NO: 76199 - DNA, 20 bp, Artificial Sequence
  Description of Artificial Sequence: Synthetic oligonucleotide
  Target: ATXN1; (-) strand; PAM type: NRG; PAM sequence: GGG
aaataaaaaaacaaaataac

SEQ ID NO: 76200 - DNA, 20 bp, Artificial Sequence
  Description of Artificial Sequence: Synthetic oligonucleotide
  Target: ATXN1; (-) strand; PAM type: NRG; PAM sequence: CGG
aaaataaaaaaacaaaataa

SEQ ID NO: 76201 - DNA, 20 bp, Artificial Sequence
  Description of Artificial Sequence: Synthetic oligonucleotide
  Target: ATXN1; (-) strand; PAM type: NRG; PAM sequence: CAG
ctgggtgacagagctagatt

SEQ ID NO: 76202 - DNA, 20 bp, Artificial Sequence
  Description of Artificial Sequence: Synthetic oligonucleotide
  Target: ATXN1; (-) strand; PAM type: NRG; PAM sequence: TAG
cacagcctgggtgacagagc

SEQ ID NO: 76203 - DNA, 20 bp, Artificial Sequence
  Description of Artificial Sequence: Synthetic oligonucleotide
  Target: ATXN1; (-) strand; PAM type: NRG; PAM sequence: GAG
attgcacagcctgggtgaca

SEQ ID NO: 76204 - DNA, 20 bp, Artificial Sequence
  Description of Artificial Sequence: Synthetic oligonucleotide
  Target: ATXN1; (-) strand; PAM type: NRG; PAM sequence: CAG
ccattgcacagcctgggtga

SEQ ID NO: 76205 - DNA, 20 bp, Artificial Sequence
  Description of Artificial Sequence: Synthetic oligonucleotide
  Target: ATXN1; (-) strand; PAM type: NRG; PAM sequence: GGG
atcgtgccattgcacagcct

SEQ ID NO: 76206 - DNA, 20 bp, Artificial Sequence
  Description of Artificial Sequence: Synthetic oligonucleotide
  Target: ATXN1; (-) strand; PAM type: NRG; PAM sequence: TGG
gatcgtgccattgcacagcc

SEQ ID NO: 76207 - DNA, 20 bp, Artificial Sequence
  Description of Artificial Sequence: Synthetic oligonucleotide
  Target: ATXN1; (-) strand; PAM type: NRG; PAM sequence: CAG
gctatgatcgtgccattgca

SEQ ID NO: 76208 - DNA, 20 bp, Artificial Sequence
  Description of Artificial Sequence: Synthetic oligonucleotide
  Target: ATXN1; (-) strand; PAM type: NRG; PAM sequence: GAG
caggagttagaggctgcagt

SEQ ID NO: 76209 - DNA, 20 bp, Artificial Sequence
  Description of Artificial Sequence: Synthetic oligonucleotide
  Target: ATXN1; (-) strand; PAM type: NRG; PAM sequence: CAG
agcccaggagttagaggctg

SEQ ID NO: 76210 - DNA, 20 bp, Artificial Sequence
  Description of Artificial Sequence: Synthetic oligonucleotide
  Target: ATXN1; (-) strand; PAM type: NRG; PAM sequence: AGG
tgcttgagcccaggagttag

SEQ ID NO: 76211 - DNA, 20 bp, Artificial Sequence
  Description of Artificial Sequence: Synthetic oligonucleotide
  Target: ATXN1; (-) strand; PAM type: NRG; PAM sequence: GAG
ttgcttgagcccaggagtta

SEQ ID NO: 76212 - DNA, 20 bp, Artificial Sequence
  Description of Artificial Sequence: Synthetic oligonucleotide
  Target: ATXN1; (-) strand; PAM type: NRG; PAM sequence: TAG
gattgcttgagcccaggagt

SEQ ID NO: 76213 - DNA, 20 bp, Artificial Sequence
  Description of Artificial Sequence: Synthetic oligonucleotide
  Target: ATXN1; (-) strand; PAM type: NRG; PAM sequence: GAG
ggaggattgcttgagcccag

SEQ ID NO: 76214 - DNA, 20 bp, Artificial Sequence
  Description of Artificial Sequence: Synthetic oligonucleotide
  Target: ATXN1; (-) strand; PAM type: NRG; PAM sequence: AGG
caggaggattgcttgagccc

SEQ ID NO: 76215 - DNA, 20 bp, Artificial Sequence
  Description of Artificial Sequence: Synthetic oligonucleotide
  Target: ATXN1; (-) strand; PAM type: NRG; PAM sequence: CAG
gcaggaggattgcttgagcc

SEQ ID NO: 76216 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggaggattgctt

SEQ ID NO: 76217 - DNA, 20 bp, Artificial Sequence
  Description of Artificial Sequence: Synthetic oligonucleotide
  Target: ATXN1; (-) strand; PAM type: NRG; PAM sequence: AGG
cctctggaggctgaggcagg

SEQ ID NO: 76218 - DNA, 20 bp, Artificial Sequence
  Description of Artificial Sequence: Synthetic oligonucleotide
  Target: ATXN1; (-) strand; PAM type: NRG; PAM sequence: GAG
tcctctggaggctgaggcag

SEQ ID NO: 76219 - DNA, 20 bp, Artificial Sequence
  Description of Artificial Sequence: Synthetic oligonucleotide
  Target: ATXN1; (-) strand; PAM type: NRG; PAM sequence: AGG
gctcctctggaggctgaggc

SEQ ID NO: 76220 - DNA, 20 bp, Artificial Sequence
  Description of Artificial Sequence: Synthetic oligonucleotide
  Target: ATXN1; (-) strand; PAM type: NRG; PAM sequence: CAG
agctcctctggaggctgagg

SEQ ID NO: 76221 - DNA, 20 bp, Artificial Sequence
  Description of Artificial Sequence: Synthetic oligonucleotide
  Target: ATXN1; (-) strand; PAM type: NRG; PAM sequence: AGG
cccagctcctctggaggctg

SEQ ID NO: 76222 - DNA, 20 bp, Artificial Sequence
  Description of Artificial Sequence: Synthetic oligonucleotide
  Target: ATXN1; (-) strand; PAM type: NRG; PAM sequence: GAG
tcccagctcctctggaggct

SEQ ID NO: 76223 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctcctctgg

SEQ ID NO: 76224 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctcctctg

SEQ ID NO: 76225 - DNA, 20 bp, Artificial Sequence
  Description of Artificial Sequence: Synthetic oligonucleotide
  Target: ATXN1; (-) strand; PAM type: NRG; PAM sequence: TGG
atctgtagtcccagctcctc

SEQ ID NO: 76226 - DNA, 20 bp, Artificial Sequence
  Description of Artificial Sequence: Synthetic oligonucleotide
  Target: ATXN1; (-) strand; PAM type: NRG; PAM sequence: CAG
gaggcgtgcatctgtagtcc

SEQ ID NO: 76227 - DNA, 20 bp, Artificial Sequence
  Description of Artificial Sequence: Synthetic oligonucleotide
  Target: ATXN1; (-) strand; PAM type: NRG; PAM sequence: TAG
agcatggaggcgtgcatctg

SEQ ID NO: 76228 - DNA, 20 bp, Artificial Sequence
  Description of Artificial Sequence: Synthetic oligonucleotide
  Target: ATXN1; (-) strand; PAM type: NRG; PAM sequence: AGG
taaaaattagccaagcatgg

SEQ ID NO: 76229 - DNA, 20 bp, Artificial Sequence
  Description of Artificial Sequence: Synthetic oligonucleotide
  Target: ATXN1; (-) strand; PAM type: NRG; PAM sequence: GAG
gtaaaaattagccaagcatg

SEQ ID NO: 76230 - DNA, 20 bp, Artificial Sequence
  Description of Artificial Sequence: Synthetic oligonucleotide
  Target: ATXN1; (-) strand; PAM type: NRG; PAM sequence: TGG
aagtaaaaattagccaagca

SEQ ID NO: 76231 - DNA, 20 bp, Artificial Sequence
  Description of Artificial Sequence: Synthetic oligonucleotide
  Target: ATXN1; (-) strand; PAM type: NRG; PAM sequence: AAG
aaaataagtaaaaattagcc

SEQ ID NO: 76232 - DNA, 20 bp, Artificial Sequence
  Description of Artificial Sequence: Synthetic oligonucleotide
  Target: ATXN1; (-) strand; PAM type: NRG; PAM sequence: TAG
tacaaaaaataagtaaaaat

SEQ ID NO: 76233 - DNA, 20 bp, Artificial Sequence
  Description of Artificial Sequence: Synthetic oligonucleotide
  Target: ATXN1; (-) strand; PAM type: NRG; PAM sequence: AAG
acctcgtctttacaaaaaat

SEQ ID NO: 76234 - DNA, 20 bp, Artificial Sequence
  Description of Artificial Sequence: Synthetic oligonucleotide
  Target: ATXN1; (-) strand; PAM type: NRG; PAM sequence: GAG
agatcagctttggcaagata

SEQ ID NO: 76235 - DNA, 20 bp, Artificial Sequence
  Description of Artificial Sequence: Synthetic oligonucleotide
  Target: ATXN1; (-) strand; PAM type: NRG; PAM sequence: TAG
caagatcagctttggcaaga

SEQ ID NO: 76236 - DNA, 20 bp, Artificial Sequence
  Description of Artificial Sequence: Synthetic oligonucleotide
  Target: ATXN1; (-) strand; PAM type: NRG; PAM sequence: AAG
agttcaagatcagctttggc

SEQ ID NO: 76237 - DNA, 20 bp, Artificial Sequence
  Description of Artificial Sequence: Synthetic oligonucleotide
  Target: ATXN1; (-) strand; PAM type: NRG; PAM sequence: TGG
caggagttcaagatcagctt

SEQ ID NO: 76238 - DNA, 20 bp, Artificial Sequence
  Description of Artificial Sequence: Synthetic oligonucleotide
  Target: ATXN1; (-) strand; PAM type: NRG; PAM sequence: CAG
tgaggccaggagttcaagat

SEQ ID NO: 76239 - DNA, 20 bp, Artificial Sequence
  Description of Artificial Sequence: Synthetic oligonucleotide
  Target: ATXN1; (-) strand; PAM type: NRG; PAM sequence: AAG
ttgcttgaggccaggagttc

SEQ ID NO: 76240 - DNA, 20 bp, Artificial Sequence
  Description of Artificial Sequence: Synthetic oligonucleotide
  Target: ATXN1; (-) strand; PAM type: NRG; PAM sequence: GAG
agaggattgcttgaggccag

SEQ ID NO: 76241 - DNA, 20 bp, Artificial Sequence
  Description of Artificial Sequence: Synthetic oligonucleotide
  Target: ATXN1; (-) strand; PAM type: NRG; PAM sequence: AGG
tgagaggattgcttgaggcc

SEQ ID NO: 76242 - DNA, 20 bp, Artificial Sequence
  Description of Artificial Sequence: Synthetic oligonucleotide
  Target: ATXN1; (-) strand; PAM type: NRG; PAM sequence: CAG
atgagaggattgcttgaggc

SEQ ID NO: 76243 - DNA, 20 bp, Artificial Sequence
  Description of Artificial Sequence: Synthetic oligonucleotide
  Target: ATXN1; (-) strand; PAM type: NRG; PAM sequence: AGG
caagatgagaggattgcttg

SEQ ID NO: 76244 - DNA, 20 bp, Artificial Sequence
  Description of Artificial Sequence: Synthetic oligonucleotide
  Target: ATXN1; (-) strand; PAM type: NRG; PAM sequence: GAG
ccaagatgagaggattgctt

SEQ ID NO: 76245 - DNA, 20 bp, Artificial Sequence
  Description of Artificial Sequence: Synthetic oligonucleotide
  Target: ATXN1; (-) strand; PAM type: NRG; PAM sequence: AGG
ctttgggaggccaagatgag

SEQ ID NO: 76246 - DNA, 20 bp, Artificial Sequence
  Description of Artificial Sequence: Synthetic oligonucleotide
  Target: ATXN1; (-) strand; PAM type: NRG; PAM sequence: GAG
actttgggaggccaagatga

SEQ ID NO: 76247 - DNA, 20 bp, Artificial Sequence
  Description of Artificial Sequence: Synthetic oligonucleotide
  Target: ATXN1; (-) strand; PAM type: NRG; PAM sequence: GAG
gcactttgggaggccaagat

SEQ ID NO: 76248 - DNA, 20 bp, Artificial Sequence
  Description of Artificial Sequence: Synthetic oligonucleotide
  Target: ATXN1; (-) strand; PAM type: NRG; PAM sequence: AAG
atccagcactttgggaggcc

SEQ ID NO: 76249 - DNA, 20 bp, Artificial Sequence
  Description of Artificial Sequence: Synthetic oligonucleotide
  Target: ATXN1; (-) strand; PAM type: NRG; PAM sequence: AGG
ctgttatccagcactttggg

SEQ ID NO: 76250 - DNA, 20 bp, Artificial Sequence
  Description of Artificial Sequence: Synthetic oligonucleotide
  Target: ATXN1; (-) strand; PAM type: NRG; PAM sequence: GAG
cctgttatccagcactttgg

SEQ ID NO: 76251 - DNA, 20 bp, Artificial Sequence
  Description of Artificial Sequence: Synthetic oligonucleotide
  Target: ATXN1; (-) strand; PAM type: NRG; PAM sequence: GGG
cacctgttatccagcacttt

SEQ ID NO: 76252 - DNA, 20 bp, Artificial Sequence
  Description of Artificial Sequence: Synthetic oligonucleotide
  Target: ATXN1; (-) strand; PAM type: NRG; PAM sequence: TGG
acacctgttatccagcactt

SEQ ID NO: 76253 - DNA, 20 bp, Artificial Sequence
  Description of Artificial Sequence: Synthetic oligonucleotide
  Target: ATXN1; (-) strand; PAM type: NRG; PAM sequence: CAG
cggtggccacacctgttatc

SEQ ID NO: 76254 - DNA, 20 bp, Artificial Sequence
  Description of Artificial Sequence: Synthetic oligonucleotide
  Target: ATXN1; (-) strand; PAM type: NRG; PAM sequence: TGG
aggtctgaggctgggcacgg

SEQ ID NO: 76255 - DNA, 20 bp, Artificial Sequence
  Description of Artificial Sequence: Synthetic oligonucleotide
  Target: ATXN1; (-) strand; PAM type: NRG; PAM sequence: CGG
aggaggtctgaggctgggca

SEQ ID NO: 76256 - DNA, 20 bp, Artificial Sequence
  Description of Artificial Sequence: Synthetic oligonucleotide
  Target: ATXN1; (-) strand; PAM type: NRG; PAM sequence: GGG
agaaaaggaggtctgaggct

SEQ ID NO: 76257 - DNA, 20 bp, Artificial Sequence
  Description of Artificial Sequence: Synthetic oligonucleotide
  Target: ATXN1; (-) strand; PAM type: NRG; PAM sequence: TGG
gagaaaaggaggtctgaggc

SEQ ID NO: 76258 - DNA, 20 bp, Artificial Sequence
  Description of Artificial Sequence: Synthetic oligonucleotide
  Target: ATXN1; (-) strand; PAM type: NRG; PAM sequence: AGG
aggggagaaaaggaggtctg

SEQ ID NO: 76259 - DNA, 20 bp, Artificial Sequence
  Description of Artificial Sequence: Synthetic oligonucleotide
  Target: ATXN1; (-) strand; PAM type: NRG; PAM sequence: GAG
taggggagaaaaggaggtct

SEQ ID NO: 76260 - DNA, 20 bp, Artificial Sequence
  Description of Artificial Sequence: Synthetic oligonucleotide
  Target: ATXN1; (-) strand; PAM type: NRG; PAM sequence: AGG
tttggataggggagaaaagg

SEQ ID NO: 76261 - DNA, 20 bp, Artificial Sequence
  Description of Artificial Sequence: Synthetic oligonucleotide
  Target: ATXN1; (-) strand; PAM type: NRG; PAM sequence: GAG
ctttggataggggagaaaag

SEQ ID NO: 76262 - DNA, 20 bp, Artificial Sequence
  Description of Artificial Sequence: Synthetic oligonucleotide
  Target: ATXN1; (-) strand; PAM type: NRG; PAM sequence: AGG
ggctttggataggggagaaa

SEQ ID NO: 76263 - DNA, 20 bp, Artificial Sequence
  Description of Artificial Sequence: Synthetic oligonucleotide
  Target: ATXN1; (-) strand; PAM type: NRG; PAM sequence: AAG
aggctttggataggggagaa

SEQ ID NO: 76264 - DNA, 20 bp, Artificial Sequence
  Description of Artificial Sequence: Synthetic oligonucleotide
  Target: ATXN1; (-) strand; PAM type: NRG; PAM sequence: GAG
ttaccaggctttggataggg

SEQ ID NO: 76265 - DNA, 20 bp, Artificial Sequence
  Description of Artificial Sequence: Synthetic oligonucleotide
  Target: ATXN1; (-) strand; PAM type: NRG; PAM sequence: GGG
gtttaccaggctttggatag

SEQ ID NO: 76266 - DNA, 20 bp, Artificial Sequence
  Description of Artificial Sequence: Synthetic oligonucleotide
  Target: ATXN1; (-) strand; PAM type: NRG; PAM sequence: GGG
tgtttaccaggctttggata

SEQ ID NO: 76267 - DNA, 20 bp, Artificial Sequence
  Description of Artificial Sequence: Synthetic oligonucleotide
  Target: ATXN1; (-) strand; PAM type: NRG; PAM sequence: AGG
ttgtttaccaggctttggat

SEQ ID NO: 76268 - DNA, 20 bp, Artificial Sequence
  Description of Artificial Sequence: Synthetic oligonucleotide
  Target: ATXN1; (-) strand; PAM type: NRG; PAM sequence: TAG
tttgtttaccaggctttgga

SEQ ID NO: 76269 - DNA, 20 bp, Artificial Sequence
  Description of Artificial Sequence: Synthetic oligonucleotide
  Target: ATXN1; (-) strand; PAM type: NRG; PAM sequence: TGG
tcactttgtttaccaggctt

SEQ ID NO: 76270 - DNA, 20 bp, Artificial Sequence
  Description of Artificial Sequence: Synthetic oligonucleotide
  Target: ATXN1; (-) strand; PAM type: NRG; PAM sequence: AGG
atcagctcactttgtttacc

SEQ ID NO: 76271 - DNA, 20 bp, Artificial Sequence
  Description of Artificial Sequence: Synthetic oligonucleotide
  Target: ATXN1; (-) strand; PAM type: NRG; PAM sequence: CAG
aatcagctcactttgtttac

SEQ ID NO: 76272 - DNA, 20 bp, Artificial Sequence
  Description of Artificial Sequence: Synthetic oligonucleotide
  Target: ATXN1; (-) strand; PAM type: NRG; PAM sequence: CAG
ccgattttagatatgcaaat

SEQ ID NO: 76273 - DNA, 20 bp, Artificial Sequence
  Description of Artificial Sequence: Synthetic oligonucleotide
  Target: ATXN1; (-) strand; PAM type: NRG; PAM sequence: TAG
aggcatccagcacccgattt

SEQ ID NO: 76274 - DNA, 20 bp, Artificial Sequence
  Description of Artificial Sequence: Synthetic oligonucleotide
  Target: ATXN1; (-) strand; PAM type: NRG; PAM sequence: CAG
ctatcatatttgcaggcatc

SEQ ID NO: 76275 - DNA, 20 bp, Artificial Sequence
  Description of Artificial Sequence: Synthetic oligonucleotide
  Target: ATXN1; (-) strand; PAM type: NRG; PAM sequence: AGG
tatttccctatcatatttgc

SEQ ID NO: 76276 - DNA, 20 bp, Artificial Sequence
  Description of Artificial Sequence: Synthetic oligonucleotide
  Target: ATXN1; (-) strand; PAM type: NRG; PAM sequence: CAG
atatttccctatcatatttg

SEQ ID NO: 76277 - DNA, 20 bp, Artificial Sequence
  Description of Artificial Sequence: Synthetic oligonucleotide
  Target: ATXN1; (-) strand; PAM type: NRG; PAM sequence: AGG
ttttgctggggtttcacctg

SEQ ID NO: 76278 - DNA, 20 bp, Artificial Sequence
  Description of Artificial Sequence: Synthetic oligonucleotide
  Target: ATXN1; (-) strand; PAM type: NRG; PAM sequence: GAG
tttttgctggggtttcacct

SEQ ID NO: 76279 - DNA, 20 bp, Artificial Sequence
  Description of Artificial Sequence: Synthetic oligonucleotide
  Target: ATXN1; (-) strand; PAM type: NRG; PAM sequence: GGG
tgattttaatgtttttgctg

SEQ ID NO: 76280 - DNA, 20 bp, Artificial Sequence
  Description of Artificial Sequence: Synthetic oligonucleotide
  Target: ATXN1; (-) strand; PAM type: NRG; PAM sequence: GGG
atgattttaatgtttttgct

SEQ ID NO: 76281 - DNA, 20 bp, Artificial Sequence
  Description of Artificial Sequence: Synthetic oligonucleotide
  Target: ATXN1; (-) strand; PAM type: NRG; PAM sequence: TGG
gatgattttaatgtttttgc

SEQ ID NO: 76282 - DNA, 20 bp, Artificial Sequence
  Description of Artificial Sequence: Synthetic oligonucleotide
  Target: ATXN1; (-) strand; PAM type: NRG; PAM sequence: GGG
ttacatatcagcattacaaa

SEQ ID NO: 76283 - DNA, 20 bp, Artificial Sequence
  Description of Artificial Sequence: Synthetic oligonucleotide
  Target: ATXN1; (-) strand; PAM type: NRG; PAM sequence: AGG
tttacatatcagcattacaa

SEQ ID NO: 76284 - DNA, 20 bp, Artificial Sequence
  Description of Artificial Sequence: Synthetic oligonucleotide
  Target: ATXN1; (-) strand; PAM type: NRG; PAM sequence: AAG
ctttacatatcagcattaca

SEQ ID NO: 76285 - DNA, 20 bp, Artificial Sequence
  Description of Artificial Sequence: Synthetic oligonucleotide
  Target: ATXN1; (-) strand; PAM type: NRG; PAM sequence: CAG
ttaatgggatctttacatat

SEQ ID NO: 76286 - DNA, 20 bp, Artificial Sequence
  Description of Artificial Sequence: Synthetic oligonucleotide
  Target: ATXN1; (-) strand; PAM type: NRG; PAM sequence: GGG
gagaatggctgtgttttaat

SEQ ID NO: 76287 - DNA, 20 bp, Artificial Sequence
  Description of Artificial Sequence: Synthetic oligonucleotide
  Target: ATXN1; (-) strand; PAM type: NRG; PAM sequence: TGG
ggagaatggctgtgttttaa

SEQ ID NO: 76288 - DNA, 20 bp, Artificial Sequence
  Description of Artificial Sequence: Synthetic oligonucleotide
  Target: ATXN1; (-) strand; PAM type: NRG; PAM sequence: TGG
atttttgtagttgtggagaa

SEQ ID NO: 76289 - DNA, 20 bp, Artificial Sequence
  Description of Artificial Sequence: Synthetic oligonucleotide
  Target: ATXN1; (-) strand; PAM type: NRG; PAM sequence: GAG
caaagatttttgtagttgtg

SEQ ID NO: 76290 - DNA, 20 bp, Artificial Sequence
  Description of Artificial Sequence: Synthetic oligonucleotide
  Target: ATXN1; (-) strand; PAM type: NRG; PAM sequence: TGG
atcaaagatttttgtagttg

SEQ ID NO: 76291 - DNA, 20 bp, Artificial Sequence
  Description of Artificial Sequence: Synthetic oligonucleotide
  Target: ATXN1; (-) strand; PAM type: NRG; PAM sequence: TAG
ttttaaatcaaagatttttg

SEQ ID NO: 76292 - DNA, 20 bp, Artificial Sequence
  Description of Artificial Sequence: Synthetic oligonucleotide
  Target: ATXN1; (-) strand; PAM type: NRG; PAM sequence: AAG
ccaaagtcatttttaaatca

SEQ ID NO: 76293 - DNA, 20 bp, Artificial Sequence
  Description of Artificial Sequence: Synthetic oligonucleotide
  Target: ATXN1; (-) strand; PAM type: NRG; PAM sequence: AAG
taacgtgacataggaatcca

SEQ ID NO: 76294 - DNA, 20 bp, Artificial Sequence
  Description of Artificial Sequence: Synthetic oligonucleotide
  Target: ATXN1; (-) strand; PAM type: NRG; PAM sequence: AGG
acacacttttaacgtgacat

SEQ ID NO: 76295 - DNA, 20 bp, Artificial Sequence
  Description of Artificial Sequence: Synthetic oligonucleotide
  Target: ATXN1; (-) strand; PAM type: NRG; PAM sequence: TAG
aacacacttttaacgtgaca

SEQ ID NO: 76296 - DNA, 20 bp, Artificial Sequence
  Description of Artificial Sequence: Synthetic oligonucleotide
  Target: ATXN1; (-) strand; PAM type: NRG; PAM sequence: TGG
gaaaggataatctaagtcac

SEQ ID NO: 76297 - DNA, 20 bp, Artificial Sequence
  Description of Artificial Sequence: Synthetic oligonucleotide
  Target: ATXN1; (-) strand; PAM type: NRG; PAM sequence: AAG
ttctcctgaaaggataatct

SEQ ID NO: 76298 - DNA, 20 bp, Artificial Sequence
  Description of Artificial Sequence: Synthetic oligonucleotide
  Target: ATXN1; (-) strand; PAM type: NRG; PAM sequence: AGG
agtacagtatttctcctgaa

SEQ ID NO: 76299 - DNA, 20 bp, Artificial Sequence
  Description of Artificial Sequence: Synthetic oligonucleotide
  Target: ATXN1; (-) strand; PAM type: NRG; PAM sequence: AAG
aagtacagtatttctcctga

SEQ ID NO: 76300 - DNA, 20 bp, Artificial Sequence
  Description of Artificial Sequence: Synthetic oligonucleotide
  Target: ATXN1; (-) strand; PAM type: NRG; PAM sequence: CAG
taaggacttacaatgaagta

SEQ ID NO: 76301 - DNA, 20 bp, Artificial Sequence
  Description of Artificial Sequence: Synthetic oligonucleotide
  Target: ATXN1; (-) strand; PAM type: NRG; PAM sequence: AAG
ctcattaaggacttacaatg

SEQ ID NO: 76302 - DNA, 20 bp, Artificial Sequence
  Description of Artificial Sequence: Synthetic oligonucleotide
  Target: ATXN1; (-) strand; PAM type: NRG; PAM sequence: AGG
gactaattggtccctcatta

SEQ ID NO: 76303 - DNA, 20 bp, Artificial Sequence
  Description of Artificial Sequence: Synthetic oligonucleotide
  Target: ATXN1; (-) strand; PAM type: NRG; PAM sequence: AAG
ggactaattggtccctcatt

SEQ ID NO: 76304 - DNA, 20 bp, Artificial Sequence
  Description of Artificial Sequence: Synthetic oligonucleotide
  Target: ATXN1; (-) strand; PAM type: NRG; PAM sequence: TGG
agtggaggggaaggactaat

SEQ ID NO: 76305 - DNA, 20 bp, Artificial Sequence
  Description of Artificial Sequence: Synthetic oligonucleotide
  Target: ATXN1; (-) strand; PAM type: NRG; PAM sequence: AGG
ggaatttgaagtggagggga

SEQ ID NO: 76306 - DNA, 20 bp, Artificial Sequence
  Description of Artificial Sequence: Synthetic oligonucleotide
  Target: ATXN1; (-) strand; PAM type: NRG; PAM sequence: AAG
aggaatttgaagtggagggg

SEQ ID NO: 76307 - DNA, 20 bp, Artificial Sequence
  Description of Artificial Sequence: Synthetic oligonucleotide
  Target: ATXN1; (-) strand; PAM type: NRG; PAM sequence: GGG
cagaggaatttgaagtggag

SEQ ID NO: 76308 - DNA, 20 bp, Artificial Sequence
  Description of Artificial Sequence: Synthetic oligonucleotide
  Target: ATXN1; (-) strand; PAM type: NRG; PAM sequence: GGG
ccagaggaatttgaagtgga

SEQ ID NO: 76309 - DNA, 20 bp, Artificial Sequence
  Description of Artificial Sequence: Synthetic oligonucleotide
  Target: ATXN1; (-) strand; PAM type: NRG; PAM sequence: AGG
cccagaggaatttgaagtgg

SEQ ID NO: 76310 - DNA, 20 bp, Artificial Sequence
  Description of Artificial Sequence: Synthetic oligonucleotide
  Target: ATXN1; (-) strand; PAM type: NRG; PAM sequence: GAG
tcccagaggaatttgaagtg

SEQ ID NO: 76311 - DNA, 20 bp, Artificial Sequence
  Description of Artificial Sequence: Synthetic oligonucleotide
  Target: ATXN1; (-) strand; PAM type: NRG; PAM sequence: TGG
tttcccagaggaatttgaag

SEQ ID NO: 76312 - DNA, 20 bp, Artificial Sequence
  Description of Artificial Sequence: Synthetic oligonucleotide
  Target: ATXN1; (-) strand; PAM type: NRG; PAM sequence: AAG
tcatttcccagaggaatttg

SEQ ID NO: 76313 - DNA, 20 bp, Artificial Sequence
  Description of Artificial Sequence: Synthetic oligonucleotide
  Target: ATXN1; (-) strand; PAM type: NRG; PAM sequence: AGG
attctgacctcatttcccag

SEQ ID NO: 76314 - DNA, 20 bp, Artificial Sequence
  Description of Artificial Sequence: Synthetic oligonucleotide
  Target: ATXN1; (-) strand; PAM type: NRG; PAM sequence: GAG
gattctgacctcatttccca

SEQ ID NO: 76315 - DNA, 20 bp, Artificial Sequence
  Description of Artificial Sequence: Synthetic oligonucleotide
  Target: ATXN1; (-) strand; PAM type: NRG; PAM sequence: CAG
tggattctgacctcatttcc

SEQ ID NO: 76316 - DNA, 20 bp, Artificial Sequence
  Description of Artificial Sequence: Synthetic oligonucleotide
  Target: ATXN1; (-) strand; PAM type: NRG; PAM sequence: TGG
gaggtgctttgggtgggaag

SEQ ID NO: 76317 - DNA, 20 bp, Artificial Sequence
  Description of Artificial Sequence: Synthetic oligonucleotide
  Target: ATXN1; (-) strand; PAM type: NRG; PAM sequence: AAG
catgaggtgctttgggtggg

SEQ ID NO: 76318 - DNA, 20 bp, Artificial Sequence
  Description of Artificial Sequence: Synthetic oligonucleotide
  Target: ATXN1; (-) strand; PAM type: NRG; PAM sequence: GGG
ctccatgaggtgctttgggt

SEQ ID NO: 76319 - DNA, 20 bp, Artificial Sequence
  Description of Artificial Sequence: Synthetic oligonucleotide
  Target: ATXN1; (-) strand; PAM type: NRG; PAM sequence: TGG
cctccatgaggtgctttggg

SEQ ID NO: 76320 - DNA, 20 bp, Artificial Sequence
  Description of Artificial Sequence: Synthetic oligonucleotide
  Target: ATXN1; (-) strand; PAM type: NRG; PAM sequence: GGG
cagcctccatgaggtgcttt

SEQ ID NO: 76321 - DNA, 20 bp, Artificial Sequence
  Description of Artificial Sequence: Synthetic oligonucleotide
  Target: ATXN1; (-) strand; PAM type: NRG; PAM sequence: TGG
gcagcctccatgaggtgctt

SEQ ID NO: 76322 - DNA, 20 bp, Artificial Sequence
  Description of Artificial Sequence: Synthetic oligonucleotide
  Target: ATXN1; (-) strand; PAM type: NRG; PAM sequence: AGG
tatttgatgcagcctccatg

SEQ ID NO: 76323 - DNA, 20 bp, Artificial Sequence
  Description of Artificial Sequence: Synthetic oligonucleotide
  Target: ATXN1; (-) strand; PAM type: NRG; PAM sequence: GAG
gtatttgatgcagcctccat

SEQ ID NO: 76324 - DNA, 20 bp, Artificial Sequence
  Description of Artificial Sequence: Synthetic oligonucleotide
  Target: ATXN1; (-) strand; PAM type: NRG; PAM sequence: CAG
tgctgctgtagtatttgatg

SEQ ID NO: 76325 - DNA, 20 bp, Artificial Sequence
  Description of Artificial Sequence: Synthetic oligonucleotide
  Target: ATXN1; (-) strand; PAM type: NRG; PAM sequence: TAG
ccctttgacaaatgctgctg

SEQ ID NO: 76326 - DNA, 20 bp, Artificial Sequence
  Description of Artificial Sequence: Synthetic oligonucleotide
  Target: ATXN1; (-) strand; PAM type: NRG; PAM sequence: GGG
acccatcttgcctttggaaa

SEQ ID NO: 76327 - DNA, 20 bp, Artificial Sequence
  Description of Artificial Sequence: Synthetic oligonucleotide
  Target: ATXN1; (-) strand; PAM type: NRG; PAM sequence: AGG
tacccatcttgcctttggaa

SEQ ID NO: 76328 - DNA, 20 bp, Artificial Sequence
  Description of Artificial Sequence: Synthetic oligonucleotide
  Target: ATXN1; (-) strand; PAM type: NRG; PAM sequence: AAG
ctacccatcttgcctttgga

SEQ ID NO: 76329 - DNA, 20 bp, Artificial Sequence
  Description of Artificial Sequence: Synthetic oligonucleotide
  Target: ATXN1; (-) strand; PAM type: NRG; PAM sequence: TGG
ccttctacccatcttgcctt

SEQ ID NO: 76330 - DNA, 20 bp, Artificial Sequence
  Description of Artificial Sequence: Synthetic oligonucleotide
  Target: ATXN1; (-) strand; PAM type: NRG; PAM sequence: AAG
ggaaggcatagcccttgatg

SEQ ID NO: 76331 - DNA, 20 bp, Artificial Sequence
  Description of Artificial Sequence: Synthetic oligonucleotide
  Target: ATXN1; (-) strand; PAM type: NRG; PAM sequence: TAG
gtgcctgtcggtggaaggca

SEQ ID NO: 76332 - DNA, 20 bp, Artificial Sequence
  Description of Artificial Sequence: Synthetic oligonucleotide
  Target: ATXN1; (-) strand; PAM type: NRG; PAM sequence: AGG
gctctgtgcctgtcggtgga

SEQ ID NO: 76333 - DNA, 20 bp, Artificial Sequence
  Description of Artificial Sequence: Synthetic oligonucleotide
  Target: ATXN1; (-) strand; PAM type: NRG; PAM sequence: AAG
tgctctgtgcctgtcggtgg

SEQ ID NO: 76334 - DNA, 20 bp, Artificial Sequence
  Description of Artificial Sequence: Synthetic oligonucleotide
  Target: ATXN1; (-) strand; PAM type: NRG; PAM sequence: TGG
ttgtgctctgtgcctgtcgg

SEQ ID NO: 76335 - DNA, 20 bp, Artificial Sequence
  Description of Artificial Sequence: Synthetic oligonucleotide
  Target: ATXN1; (-) strand; PAM type: NRG; PAM sequence: CGG
tctttgtgctctgtgcctgt

SEQ ID NO: 76336 - DNA, 20 bp, Artificial Sequence
  Description of Artificial Sequence: Synthetic oligonucleotide
  Target: ATXN1; (-) strand; PAM type: NRG; PAM sequence: GAG
aagatcttatagtaaatgct

SEQ ID NO: 76337 - DNA, 20 bp, Artificial Sequence
  Description of Artificial Sequence: Synthetic oligonucleotide
  Target: ATXN1; (-) strand; PAM type: NRG; PAM sequence: TAG
agctcctgtgcaagatctta

SEQ ID NO: 76338 - DNA, 20 bp, Artificial Sequence
  Description of Artificial Sequence: Synthetic oligonucleotide
  Target: ATXN1; (-) strand; PAM type: NRG; PAM sequence: AAG
tgtttgaacagctcctgtgc

SEQ ID NO: 76339 - DNA, 20 bp, Artificial Sequence
  Description of Artificial Sequence: Synthetic oligonucleotide
  Target: ATXN1; (-) strand; PAM type: NRG; PAM sequence: CAG
tgtgcttcagcttgtttgaa

SEQ ID NO: 76340 - DNA, 20 bp, Artificial Sequence
  Description of Artificial Sequence: Synthetic oligonucleotide
  Target: ATXN1; (-) strand; PAM type: NRG; PAM sequence: CAG
aaattcgtgggtgtgtgctt

SEQ ID NO: 76341 - DNA, 20 bp, Artificial Sequence
  Description of Artificial Sequence: Synthetic oligonucleotide
  Target: ATXN1; (-) strand; PAM type: NRG; PAM sequence: GGG
gtcgctgagatgaaattcgt

SEQ ID NO: 76342 - DNA, 20 bp, Artificial Sequence
  Description of Artificial Sequence: Synthetic oligonucleotide
  Target: ATXN1; (-) strand; PAM type: NRG; PAM sequence: TGG
agtcgctgagatgaaattcg

SEQ ID NO: 76343 - DNA, 20 bp, Artificial Sequence
  Description of Artificial Sequence: Synthetic oligonucleotide
  Target: ATXN1; (-) strand; PAM type: NRG; PAM sequence: GAG
aggtaaaagagagagtcgct

SEQ ID NO: 76344 - DNA, 20 bp, Artificial Sequence
  Description of Artificial Sequence: Synthetic oligonucleotide
  Target: ATXN1; (-) strand; PAM type: NRG; PAM sequence: GAG
gtggcagcaggtaaaagaga

SEQ ID NO: 76345 - DNA, 20 bp, Artificial Sequence
  Description of Artificial Sequence: Synthetic oligonucleotide
  Target: ATXN1; (-) strand; PAM type: NRG; PAM sequence: GAG
ctgtggcagcaggtaaaaga

SEQ ID NO: 76346 - DNA, 20 bp, Artificial Sequence
  Description of Artificial Sequence: Synthetic oligonucleotide
  Target: ATXN1; (-) strand; PAM type: NRG; PAM sequence: GAG
ccctgtggcagcaggtaaaa

SEQ ID NO: 76347 - DNA, 20 bp, Artificial Sequence
  Description of Artificial Sequence: Synthetic oligonucleotide
  Target: ATXN1; (-) strand; PAM type: NRG; PAM sequence: AAG
gtccctgtggcagcaggtaa

SEQ ID NO: 76348 - DNA, 20 bp, Artificial Sequence
  Description of Artificial Sequence: Synthetic oligonucleotide
  Target: ATXN1; (-) strand; PAM type: NRG; PAM sequence: AGG
aaggctgtccctgtggcagc

SEQ ID NO: 76349 - DNA, 20 bp, Artificial Sequence
  Description of Artificial Sequence: Synthetic oligonucleotide
  Target: ATXN1; (-) strand; PAM type: NRG; PAM sequence: CAG
gaaggctgtccctgtggcag

SEQ ID NO: 76350 - DNA, 20 bp, Artificial Sequence
  Description of Artificial Sequence: Synthetic oligonucleotide
  Target: ATXN1; (-) strand; PAM type: NRG; PAM sequence: CAG
caggaaggctgtccctgtgg

SEQ ID NO: 76351 - DNA, 20 bp, Artificial Sequence
  Description of Artificial Sequence: Synthetic oligonucleotide
  Target: ATXN1; (-) strand; PAM type: NRG; PAM sequence: TGG
gagcaggaaggctgtccctg

SEQ ID NO: 76352 - DNA, 20 bp, Artificial Sequence
  Description of Artificial Sequence: Synthetic oligonucleotide
  Target: ATXN1; (-) strand; PAM type: NRG; PAM sequence: AGG
cacccaatcagggagcagga

SEQ ID NO: 76353 - DNA, 20 bp, Artificial Sequence
  Description of Artificial Sequence: Synthetic oligonucleotide
  Target: ATXN1; (-) strand; PAM type: NRG; PAM sequence: AAG
acacccaatcagggagcagg

SEQ ID NO: 76354 - DNA, 20 bp, Artificial Sequence
  Description of Artificial Sequence: Synthetic oligonucleotide
  Target: ATXN1; (-) strand; PAM type: NRG; PAM sequence: AGG
gagacacccaatcagggagc

SEQ ID NO: 76355 - DNA, 20 bp, Artificial Sequence
  Description of Artificial Sequence: Synthetic oligonucleotide
  Target: ATXN1; (-) strand; PAM type: NRG; PAM sequence: CAG
cgagacacccaatcagggag

SEQ ID NO: 76356 - DNA, 20 bp, Artificial Sequence
  Description of Artificial Sequence: Synthetic oligonucleotide
  Target: ATXN1; (-) strand; PAM type: NRG; PAM sequence: GAG
cagcgagacacccaatcagg

SEQ ID NO: 76357 - DNA, 20 bp, Artificial Sequence
  Description of Artificial Sequence: Synthetic oligonucleotide
  Target: ATXN1; (-) strand; PAM type: NRG; PAM sequence: GGG
gccagcgagacacccaatca

SEQ ID NO: 76358 - DNA, 20 bp, Artificial Sequence
  Description of Artificial Sequence: Synthetic oligonucleotide
  Target: ATXN1; (-) strand; PAM type: NRG; PAM sequence: AGG
agccagcgagacacccaatc

SEQ ID NO: 76359 - DNA, 20 bp, Artificial Sequence
  Description of Artificial Sequence: Synthetic oligonucleotide
  Target: ATXN1; (-) strand; PAM type: NRG; PAM sequence: CAG
cagccagcgagacacccaat

SEQ ID NO: 76360 - DNA, 20 bp, Artificial Sequence
  Description of Artificial Sequence: Synthetic oligonucleotide
  Target: ATXN1; (-) strand; PAM type: NRG; PAM sequence: GAG
caggtgagtgcacagccagc

SEQ ID NO: 76361 - DNA, 20 bp, Artificial Sequence
  Description of Artificial Sequence: Synthetic oligonucleotide
  Target: ATXN1; (-) strand; PAM type: NRG; PAM sequence: CAG
cctgcaggtgagtgcacagc

SEQ ID NO: 76362 - DNA, 20 bp, Artificial Sequence
  Description of Artificial Sequence: Synthetic oligonucleotide
  Target: ATXN1; (-) strand; PAM type: NRG; PAM sequence: CAG
gcgccctgcaggtgagtgca

SEQ ID NO: 76363 - DNA, 20 bp, Artificial Sequence
  Description of Artificial Sequence: Synthetic oligonucleotide
  Target: ATXN1; (-) strand; PAM type: NRG; PAM sequence: GAG
acaccctgcgccctgcaggt

SEQ ID NO: 76364 - DNA, 20 bp, Artificial Sequence
  Description of Artificial Sequence: Synthetic oligonucleotide
  Target: ATXN1; (-) strand; PAM type: NRG; PAM sequence: AGG
tgggacaccctgcgccctgc

SEQ ID NO: 76365 - DNA, 20 bp, Artificial Sequence
  Description of Artificial Sequence: Synthetic oligonucleotide
  Target: ATXN1; (-) strand; PAM type: NRG; PAM sequence: CAG
gtgggacaccctgcgccctg

SEQ ID NO: 76366 - DNA, 20 bp, Artificial Sequence
  Description of Artificial Sequence: Synthetic oligonucleotide
  Target: ATXN1; (-) strand; PAM type: NRG; PAM sequence: GGG
agcaggagggggatgcaggt

SEQ ID NO: 76367 - DNA, 20 bp, Artificial Sequence
  Description of Artificial Sequence: Synthetic oligonucleotide
  Target: ATXN1; (-) strand; PAM type: NRG; PAM sequence: TGG
gagcaggagggggatgcagg

SEQ ID NO: 76368 - DNA, 20 bp, Artificial Sequence
  Description of Artificial Sequence: Synthetic oligonucleotide
  Target: ATXN1; (-) strand; PAM type: NRG; PAM sequence: AGG
atggagcaggagggggatgc

SEQ ID NO: 76369 - DNA, 20 bp, Artificial Sequence
  Description of Artificial Sequence: Synthetic oligonucleotide
  Target: ATXN1; (-) strand; PAM type: NRG; PAM sequence: CAG
gatggagcaggagggggatg

SEQ ID NO: 76370 - DNA, 20 bp, Artificial Sequence
  Description of Artificial Sequence: Synthetic oligonucleotide
  Target: ATXN1; (-) strand; PAM type: NRG; PAM sequence: GGG
gatgcagatggagcaggagg

SEQ ID NO: 76371 - DNA, 20 bp, Artificial Sequence
  Description of Artificial Sequence: Synthetic oligonucleotide
  Target: ATXN1; (-) strand; PAM type: NRG; PAM sequence: GGG
tgatgcagatggagcaggag

SEQ ID NO: 76372 - DNA, 20 bp, Artificial Sequence
  Description of Artificial Sequence: Synthetic oligonucleotide
  Target: ATXN1; (-) strand; PAM type: NRG; PAM sequence: GGG
atgatgcagatggagcagga

SEQ ID NO: 76373 - DNA, 20 bp, Artificial Sequence
  Description of Artificial Sequence: Synthetic oligonucleotide
  Target: ATXN1; (-) strand; PAM type: NRG; PAM sequence: AGG
catgatgcagatggagcagg

SEQ ID NO: 76374 - DNA, 20 bp, Artificial Sequence
  Description of Artificial Sequence: Synthetic oligonucleotide
  Target: ATXN1; (-) strand; PAM type: NRG; PAM sequence: GAG
gcatgatgcagatggagcag

SEQ ID NO: 76375 - DNA, 20 bp, Artificial Sequence
  Description of Artificial Sequence: Synthetic oligonucleotide
  Target: ATXN1; (-) strand; PAM type: NRG; PAM sequence: AGG
gtgcatgatgcagatggagc

SEQ ID NO: 76376 - DNA, 20 bp, Artificial Sequence
  Description of Artificial Sequence: Synthetic oligonucleotide
  Target: ATXN1; (-) strand; PAM type: NRG; PAM sequence: CAG
agtgcatgatgcagatggag

SEQ ID NO: 76377 - DNA, 20 bp, Artificial Sequence
  Description of Artificial Sequence: Synthetic oligonucleotide
  Target: ATXN1; (-) strand; PAM type: NRG; PAM sequence: GAG
ctgagtgcatgatgcagatg

SEQ ID NO: 76378 - DNA, 20 bp, Artificial Sequence
  Description of Artificial Sequence: Synthetic oligonucleotide
  Target: ATXN1; (-) strand; PAM type: NRG; PAM sequence: TGG
ctctgagtgcatgatgcaga

SEQ ID NO: 76379 - DNA, 20 bp, Artificial Sequence
  Description of Artificial Sequence: Synthetic oligonucleotide
  Target: ATXN1; (-) strand; PAM type: NRG; PAM sequence: CAG
tcccctctgagtgcatgatg

SEQ ID NO: 76380 - DNA, 20 bp, Artificial Sequence
  Description of Artificial Sequence: Synthetic oligonucleotide
  Target: ATXN1; (-) strand; PAM type: NRG; PAM sequence: GAG
gagcagtggcactcccctct

SEQ ID NO: 76381 - DNA, 20 bp, Artificial Sequence
  Description of Artificial Sequence: Synthetic oligonucleotide
  Target: ATXN1; (-) strand; PAM type: NRG; PAM sequence: TGG
aggctggtgacccagagcag

SEQ ID NO: 76382 - DNA, 20 bp, Artificial Sequence
  Description of Artificial Sequence: Synthetic oligonucleotide
  Target: ATXN1; (-) strand; PAM type: NRG; PAM sequence: CAG
agcaggctggtgacccagag

SEQ ID NO: 76383 - DNA, 20 bp, Artificial Sequence
  Description of Artificial Sequence: Synthetic oligonucleotide
  Target: ATXN1; (-) strand; PAM type: NRG; PAM sequence: GAG
cagagcaggctggtgaccca

SEQ ID NO: 76384 - DNA, 20 bp, Artificial Sequence
  Description of Artificial Sequence: Synthetic oligonucleotide
  Target: ATXN1; (-) strand; PAM type: NRG; PAM sequence: CAG
gccagagcaggctggtgacc

SEQ ID NO: 76385 - DNA, 20 bp, Artificial Sequence
  Description of Artificial Sequence: Synthetic oligonucleotide
  Target: ATXN1; (-) strand; PAM type: NRG; PAM sequence: TGG
gcggcagagccagagcaggc

SEQ ID NO: 76386 - DNA, 20 bp, Artificial Sequence
  Description of Artificial Sequence: Synthetic oligonucleotide
  Target: ATXN1; (-) strand; PAM type: NRG; PAM sequence: AGG
ggctgcggcagagccagagc

SEQ ID NO: 76387 - DNA, 20 bp, Artificial Sequence
  Description of Artificial Sequence: Synthetic oligonucleotide
  Target: ATXN1; (-) strand; PAM type: NRG; PAM sequence: CAG
aggctgcggcagagccagag

SEQ ID NO: 76388 - DNA, 20 bp, Artificial Sequence
  Description of Artificial Sequence: Synthetic oligonucleotide
  Target: ATXN1; (-) strand; PAM type: NRG; PAM sequence: GAG
gggaggctgcggcagagcca

SEQ ID NO: 76389 - DNA, 20 bp, Artificial Sequence
  Description of Artificial Sequence: Synthetic oligonucleotide
  Target: ATXN1; (-) strand; PAM type: NRG; PAM sequence: CAG
ctgggaggctgcggcagagc

SEQ ID NO: 76390 - DNA, 20 bp, Artificial Sequence
  Description of Artificial Sequence: Synthetic oligonucleotide
  Target: ATXN1; (-) strand; PAM type: NRG; PAM sequence: GAG
tcccctgggaggctgcggca

SEQ ID NO: 76391 - DNA, 20 bp, Artificial Sequence
  Description of Artificial Sequence: Synthetic oligonucleotide
  Target: ATXN1; (-) strand; PAM type: NRG; PAM sequence: CAG
aatcccctgggaggctgcgg

SEQ ID NO: 76392 - DNA, 20 bp, Artificial Sequence
  Description of Artificial Sequence: Synthetic oligonucleotide
  Target: ATXN1; (-) strand; PAM type: NRG; PAM sequence: CGG
ctcaatcccctgggaggctg

SEQ ID NO: 76393 - DNA, 20 bp, Artificial Sequence
  Description of Artificial Sequence: Synthetic oligonucleotide
  Target: ATXN1; (-) strand; PAM type: NRG; PAM sequence: AGG
taggagctcaatcccctggg

SEQ ID NO: 76394 - DNA, 20 bp, Artificial Sequence
  Description of Artificial Sequence: Synthetic oligonucleotide
  Target: ATXN1; (-) strand; PAM type: NRG; PAM sequence: GAG
gtaggagctcaatcccctgg

SEQ ID NO: 76395 - DNA, 20 bp, Artificial Sequence
  Description of Artificial Sequence: Synthetic oligonucleotide
  Target: ATXN1; (-) strand; PAM type: NRG; PAM sequence: GGG
gagtaggagctcaatcccct

SEQ ID NO: 76396 - DNA, 20 bp, Artificial Sequence
  Description of Artificial Sequence: Synthetic oligonucleotide
  Target: ATXN1; (-) strand; PAM type: NRG; PAM sequence: TGG
ggagtaggagctcaatcccc

SEQ ID NO: 76397 - DNA, 20 bp, Artificial Sequence
  Description of Artificial Sequence: Synthetic oligonucleotide
  Target: ATXN1; (-) strand; PAM type: NRG; PAM sequence: GAG
gcttctagtggaaggagtag

SEQ ID NO: 76398 - DNA, 20 bp, Artificial Sequence
  Description of Artificial Sequence: Synthetic oligonucleotide
  Target: ATXN1; (-) strand; PAM type: NRG; PAM sequence: AGG
atgcttctagtggaaggagt

SEQ ID NO: 76399 - DNA, 20 bp, Artificial Sequence
  Description of Artificial Sequence: Synthetic oligonucleotide
  Target: ATXN1; (-) strand; PAM type: NRG; PAM sequence: TAG
catgcttctagtggaaggag

SEQ ID NO: 76400 - DNA, 20 bp, Artificial Sequence
  Description of Artificial Sequence: Synthetic oligonucleotide
  Target: ATXN1; (-) strand; PAM type: NRG; PAM sequence: GAG
caccatgcttctagtggaag

SEQ ID NO: 76401 - DNA, 20 bp, Artificial Sequence
  Description of Artificial Sequence: Synthetic oligonucleotide
  Target: ATXN1; (-) strand; PAM type: NRG; PAM sequence: AGG
ctcaccatgcttctagtgga

SEQ ID NO: 76402 - DNA, 20 bp, Artificial Sequence
  Description of Artificial Sequence: Synthetic oligonucleotide
  Target: ATXN1; (-) strand; PAM type: NRG; PAM sequence: AAG
gctcaccatgcttctagtgg

SEQ ID NO: 76403 - DNA, 20 bp, Artificial Sequence
  Description of Artificial Sequence: Synthetic oligonucleotide
  Target: ATXN1; (-) strand; PAM type: NRG; PAM sequence: TGG
tttgctcaccatgcttctag

SEQ ID NO: 76404 - DNA, 20 bp, Artificial Sequence
  Description of Artificial Sequence: Synthetic oligonucleotide
  Target: ATXN1; (-) strand; PAM type: NRG; PAM sequence: TAG
taatttgctcaccatgcttc

SEQ ID NO: 76405 - DNA, 20 bp, Artificial Sequence
  Description of Artificial Sequence: Synthetic oligonucleotide
  Target: ATXN1; (-) strand; PAM type: NRG; PAM sequence: AGG
aattctcctccttccaccgg

SEQ ID NO: 76406 - DNA, 20 bp, Artificial Sequence
  Description of Artificial Sequence: Synthetic oligonucleotide
  Target: ATXN1; (-) strand; PAM type: NRG; PAM sequence: GAG
gaattctcctccttccaccg

SEQ ID NO: 76407 - DNA, 20 bp, Artificial Sequence
  Description of Artificial Sequence: Synthetic oligonucleotide
  Target: ATXN1; (-) strand; PAM type: NRG; PAM sequence: CGG
aggaattctcctccttccac

SEQ ID NO: 76408 - DNA, 20 bp, Artificial Sequence
  Description of Artificial Sequence: Synthetic oligonucleotide
  Target: ATXN1; (-) strand; PAM type: NRG; PAM sequence: AGG
ggttcccttacaaagcccaa

SEQ ID NO: 76409 - DNA, 20 bp, Artificial Sequence
  Description of Artificial Sequence: Synthetic oligonucleotide
  Target: ATXN1; (-) strand; PAM type: NRG; PAM sequence: AAG
aggttcccttacaaagccca

SEQ ID NO: 76410 - DNA, 20 bp, Artificial Sequence
  Description of Artificial Sequence: Synthetic oligonucleotide
  Target: ATXN1; (-) strand; PAM type: NRG; PAM sequence: AAG
gctgacgaggttcccttaca

SEQ ID NO: 76411 - DNA, 20 bp, Artificial Sequence
  Description of Artificial Sequence: Synthetic oligonucleotide
  Target: ATXN1; (-) strand; PAM type: NRG; PAM sequence: AGG
ggagattcttgcggctgacg

SEQ ID NO: 76412 - DNA, 20 bp, Artificial Sequence
  Description of Artificial Sequence: Synthetic oligonucleotide
  Target: ATXN1; (-) strand; PAM type: NRG; PAM sequence: GAG
cggagattcttgcggctgac

SEQ ID NO: 76413 - DNA, 20 bp, Artificial Sequence
  Description of Artificial Sequence: Synthetic oligonucleotide
  Target: ATXN1; (-) strand; PAM type: NRG; PAM sequence: CGG
ttataccccggagattcttg

SEQ ID NO: 76414 - DNA, 20 bp, Artificial Sequence
  Description of Artificial Sequence: Synthetic oligonucleotide
  Target: ATXN1; (-) strand; PAM type: NRG; PAM sequence: GAG
tacctatgtcttataccccg

SEQ ID NO: 76415 - DNA, 20 bp, Artificial Sequence
  Description of Artificial Sequence: Synthetic oligonucleotide
  Target: ATXN1; (-) strand; PAM type: NRG; PAM sequence: CGG
tgtacctatgtcttataccc

SEQ ID NO: 76416 - DNA, 20 bp, Artificial Sequence
  Description of Artificial Sequence: Synthetic oligonucleotide
  Target: ATXN1; (-) strand; PAM type: NRG; PAM sequence: GAG
cagggccaaggggcaagggt

SEQ ID NO: 76417 - DNA, 20 bp, Artificial Sequence
  Description of Artificial Sequence: Synthetic oligonucleotide
  Target: ATXN1; (-) strand; PAM type: NRG; PAM sequence: GGG
ccaacagggccaaggggcaa

SEQ ID NO: 76418 - DNA, 20 bp, Artificial Sequence
  Description of Artificial Sequence: Synthetic oligonucleotide
  Target: ATXN1; (-) strand; PAM type: NRG; PAM sequence: AGG
cccaacagggccaaggggca

SEQ ID NO: 76419 - DNA, 20 bp, Artificial Sequence
  Description of Artificial Sequence: Synthetic oligonucleotide
  Target: ATXN1; (-) strand; PAM type: NRG; PAM sequence: AAG
gcccaacagggccaaggggc

SEQ ID NO: 76420 - DNA, 20 bp, Artificial Sequence
  Description of Artificial Sequence: Synthetic oligonucleotide
  Target: ATXN1; (-) strand; PAM type: NRG; PAM sequence: GGG
atatgcccaacagggccaag

SEQ ID NO: 76421 - DNA, 20 bp, Artificial Sequence
  Description of Artificial Sequence: Synthetic oligonucleotide
  Target: ATXN1; (-) strand; PAM type: NRG; PAM sequence: GGG
catatgcccaacagggccaa

SEQ ID NO: 76422 - DNA, 20 bp, Artificial Sequence
  Description of Artificial Sequence: Synthetic oligonucleotide
  Target: ATXN1; (-) strand; PAM type: NRG; PAM sequence: AGG
acatatgcccaacagggcca

SEQ ID NO: 76423 - DNA, 20 bp, Artificial Sequence
  Description of Artificial Sequence: Synthetic oligonucleotide
  Target: ATXN1; (-) strand; PAM type: NRG; PAM sequence: AAG
cacatatgcccaacagggcc

SEQ ID NO: 76424 - DNA, 20 bp, Artificial Sequence
  Description of Artificial Sequence: Synthetic oligonucleotide
  Target: ATXN1; (-) strand; PAM type: NRG; PAM sequence: GGG
tggtccacatatgcccaaca

SEQ ID NO: 76425 - DNA, 20 bp, Artificial Sequence
  Description of Artificial Sequence: Synthetic oligonucleotide
  Target: ATXN1; (-) strand; PAM type: NRG; PAM sequence: AGG
gtggtccacatatgcccaac

SEQ ID NO: 76426 - DNA, 20 bp, Artificial Sequence
  Description of Artificial Sequence: Synthetic oligonucleotide
  Target: ATXN1; (-) strand; PAM type: NRG; PAM sequence: CAG
tgtggtccacatatgcccaa

SEQ ID NO: 76427 - DNA, 20 bp, Artificial Sequence
  Description of Artificial Sequence: Synthetic oligonucleotide
  Target: ATXN1; (-) strand; PAM type: NRG; PAM sequence: TGG
attgtgggcagaaaaaggtg

SEQ ID NO: 76428 - DNA, 20 bp, Artificial Sequence
  Description of Artificial Sequence: Synthetic oligonucleotide
  Target: ATXN1; (-) strand; PAM type: NRG; PAM sequence: AGG
ccataattgtgggcagaaaa

SEQ ID NO: 76429 - DNA, 20 bp, Artificial Sequence
  Description of Artificial Sequence: Synthetic oligonucleotide
  Target: ATXN1; (-) strand; PAM type: NRG; PAM sequence: AAG
gccataattgtgggcagaaa

SEQ ID NO: 76430 - DNA, 20 bp, Artificial Sequence
  Description of Artificial Sequence: Synthetic oligonucleotide
  Target: ATXN1; (-) strand; PAM type: NRG; PAM sequence: CAG
atttctgccataattgtggg

SEQ ID NO: 76431 - DNA, 20 bp, Artificial Sequence
  Description of Artificial Sequence: Synthetic oligonucleotide
  Target: ATXN1; (-) strand; PAM type: NRG; PAM sequence: GGG
ggcatttctgccataattgt

SEQ ID NO: 76432 - DNA, 20 bp, Artificial Sequence
  Description of Artificial Sequence: Synthetic oligonucleotide
  Target: ATXN1; (-) strand; PAM type: NRG; PAM sequence: TGG
gggcatttctgccataattg

SEQ ID NO: 76433 - DNA, 20 bp, Artificial Sequence
  Description of Artificial Sequence: Synthetic oligonucleotide
  Target: ATXN1; (-) strand; PAM type: NRG; PAM sequence: GGG
gaagcagcattttcctggat

SEQ ID NO: 76434 - DNA, 20 bp, Artificial Sequence
  Description of Artificial Sequence: Synthetic oligonucleotide
  Target: ATXN1; (-) strand; PAM type: NRG; PAM sequence: TGG
tgaagcagcattttcctgga

SEQ ID NO: 76435 - DNA, 20 bp, Artificial Sequence
  Description of Artificial Sequence: Synthetic oligonucleotide
  Target: ATXN1; (-) strand; PAM type: NRG; PAM sequence: TGG
catgtgaagcagcattttcc

SEQ ID NO: 76436 - DNA, 20 bp, Artificial Sequence
  Description of Artificial Sequence: Synthetic oligonucleotide
  Target: ATXN1; (-) strand; PAM type: NRG; PAM sequence: CAG
cattcttcgaacatgtgaag

SEQ ID NO: 76437 - DNA, 20 bp, Artificial Sequence
  Description of Artificial Sequence: Synthetic oligonucleotide
  Target: ATXN1; (-) strand; PAM type: NRG; PAM sequence: AAG
aggcattcttcgaacatgtg

SEQ ID NO: 76438 - DNA, 20 bp, Artificial Sequence
  Description of Artificial Sequence: Synthetic oligonucleotide
  Target: ATXN1; (-) strand; PAM type: NRG; PAM sequence: AGG
gcagtattctcaaccatgtg

SEQ ID NO: 76439 - DNA, 20 bp, Artificial Sequence
  Description of Artificial Sequence: Synthetic oligonucleotide
  Target: ATXN1; (-) strand; PAM type: NRG; PAM sequence: GAG
agcagtattctcaaccatgt

SEQ ID NO: 76440 - DNA, 20 bp, Artificial Sequence
  Description of Artificial Sequence: Synthetic oligonucleotide
  Target: ATXN1; (-) strand; PAM type: NRG; PAM sequence: CAG
tgctgcttgttgaggaccag

SEQ ID NO: 76441 - DNA, 20 bp, Artificial Sequence
  Description of Artificial Sequence: Synthetic oligonucleotide
  Target: ATXN1; (-) strand; PAM type: NRG; PAM sequence: CAG
ttatgctgcttgttgaggac

SEQ ID NO: 76442 - DNA, 20 bp, Artificial Sequence
  Description of Artificial Sequence: Synthetic oligonucleotide
  Target: ATXN1; (-) strand; PAM type: NRG; PAM sequence: AGG
tagatttatgctgcttgttg

SEQ ID NO: 76443 - DNA, 20 bp, Artificial Sequence
  Description of Artificial Sequence: Synthetic oligonucleotide
  Target: ATXN1; (-) strand; PAM type: NRG; PAM sequence: GAG
atagatttatgctgcttgtt

SEQ ID NO: 76444 - DNA, 20 bp, Artificial Sequence
  Description of Artificial Sequence: Synthetic oligonucleotide
  Target: ATXN1; (-) strand; PAM type: NRG; PAM sequence: TAG
tctcaaaaaaaaaaaaaaaa

SEQ ID NO: 76445 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggtgacagagc

SEQ ID NO: 76446 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggtgaca

SEQ ID NO: 76447 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggtga

SEQ ID NO: 76448 - DNA, 20 bp, Artificial Sequence
  Description of Artificial Sequence: Synthetic oligonucleotide
  Target: ATXN1; (-) strand; PAM type: NRG; PAM sequence: GGG
gcgccactgcactccagcct

SEQ ID NO: 76449 - DNA, 20 bp, Artificial Sequence
  Description of Artificial Sequence: Synthetic oligonucleotide
  Target: ATXN1; (-) strand; PAM type: NRG; PAM sequence: TGG
tgcgccactgcactccagcc

SEQ ID NO: 76450 - DNA, 20 bp, Artificial Sequence
  Description of Artificial Sequence: Synthetic oligonucleotide
  Target: ATXN1; (-) strand; PAM type: NRG; PAM sequence: CAG
aagattgcgccactgcactc

SEQ ID NO: 76451 - DNA, 20 bp, Artificial Sequence
  Description of Artificial Sequence: Synthetic oligonucleotide
  Target: ATXN1; (-) strand; PAM type: NRG; PAM sequence: AAG
ggtagaggctgcagtgagcc

SEQ ID NO: 76452 - DNA, 20 bp, Artificial Sequence
  Description of Artificial Sequence: Synthetic oligonucleotide
  Target: ATXN1; (-) strand; PAM type: NRG; PAM sequence: GAG
tgagaggtagaggctgcagt

SEQ ID NO: 76453 - DNA, 20 bp, Artificial Sequence
  Description of Artificial Sequence: Synthetic oligonucleotide
  Target: ATXN1; (-) strand; PAM type: NRG; PAM sequence: CAG
aatctgagaggtagaggctg

SEQ ID NO: 76454 - DNA, 20 bp, Artificial Sequence
  Description of Artificial Sequence: Synthetic oligonucleotide
  Target: ATXN1; (-) strand; PAM type: NRG; PAM sequence: AGG
cgctagaatctgagaggtag

SEQ ID NO: 76455 - DNA, 20 bp, Artificial Sequence
  Description of Artificial Sequence: Synthetic oligonucleotide
  Target: ATXN1; (-) strand; PAM type: NRG; PAM sequence: GAG
tcgctagaatctgagaggta

SEQ ID NO: 76456 - DNA, 20 bp, Artificial Sequence
  Description of Artificial Sequence: Synthetic oligonucleotide
  Target: ATXN1; (-) strand; PAM type: NRG; PAM sequence: TAG
aatcgctagaatctgagagg

SEQ ID NO: 76457 - DNA, 20 bp, Artificial Sequence
  Description of Artificial Sequence: Synthetic oligonucleotide
  Target: ATXN1; (-) strand; PAM type: NRG; PAM sequence: AGG
gagaatcgctagaatctgag

SEQ ID NO: 76458 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgctagaatctga

SEQ ID NO: 76459 - DNA, 20 bp, Artificial Sequence
  Description of Artificial Sequence: Synthetic oligonucleotide
  Target: ATXN1; (-) strand; PAM type: NRG; PAM sequence: GAG
caggagaatcgctagaatct

SEQ ID NO: 76460 - DNA, 20 bp, Artificial Sequence
  Description of Artificial Sequence: Synthetic oligonucleotide
  Target: ATXN1; (-) strand; PAM type: NRG; PAM sequence: TAG
ggcagaggcaggagaatcgc

SEQ ID NO: 76461 - DNA, 20 bp, Artificial Sequence
  Description of Artificial Sequence: Synthetic oligonucleotide
  Target: ATXN1; (-) strand; PAM type: NRG; PAM sequence: GAG
tactggggaggcagaggcag

SEQ ID NO: 76462 - DNA, 20 bp, Artificial Sequence
  Description of Artificial Sequence: Synthetic oligonucleotide
  Target: ATXN1; (-) strand; PAM type: NRG; PAM sequence: AGG
gctactggggaggcagaggc

SEQ ID NO: 76463 - DNA, 20 bp, Artificial Sequence
  Description of Artificial Sequence: Synthetic oligonucleotide
  Target: ATXN1; (-) strand; PAM type: NRG; PAM sequence: CAG
agctactggggaggcagagg

SEQ ID NO: 76464 - DNA, 20 bp, Artificial Sequence
  Description of Artificial Sequence: Synthetic oligonucleotide
  Target: ATXN1; (-) strand; PAM type: NRG; PAM sequence: AGG
cccagctactggggaggcag

SEQ ID NO: 76465 - DNA, 20 bp, Artificial Sequence
  Description of Artificial Sequence: Synthetic oligonucleotide
  Target: ATXN1; (-) strand; PAM type: NRG; PAM sequence: GAG
gcccagctactggggaggca

SEQ ID NO: 76466 - DNA, 20 bp, Artificial Sequence
  Description of Artificial Sequence: Synthetic oligonucleotide
  Target: ATXN1; (-) strand; PAM type: NRG; PAM sequence: CAG
aagcccagctactggggagg

SEQ ID NO: 76467 - DNA, 20 bp, Artificial Sequence
  Description of Artificial Sequence: Synthetic oligonucleotide
  Target: ATXN1; (-) strand; PAM type: NRG; PAM sequence: AGG
tggaagcccagctactgggg

SEQ ID NO: 76468 - DNA, 20 bp, Artificial Sequence
  Description of Artificial Sequence: Synthetic oligonucleotide
  Target: ATXN1; (-) strand; PAM type: NRG; PAM sequence: GAG
ctggaagcccagctactggg

SEQ ID NO: 76469 - DNA, 20 bp, Artificial Sequence
  Description of Artificial Sequence: Synthetic oligonucleotide
  Target: ATXN1; (-) strand; PAM type: NRG; PAM sequence: GGG
gcctggaagcccagctactg

SEQ ID NO: 76470 - DNA, 20 bp, Artificial Sequence
  Description of Artificial Sequence: Synthetic oligonucleotide
  Target: ATXN1; (-) strand; PAM type: NRG; PAM sequence: GGG
tgcctggaagcccagctact

SEQ ID NO: 76471 - DNA, 20 bp, Artificial Sequence
  Description of Artificial Sequence: Synthetic oligonucleotide
  Target: ATXN1; (-) strand; PAM type: NRG; PAM sequence: TGG
gtgcctggaagcccagctac

SEQ ID NO: 76472 - DNA, 20 bp, Artificial Sequence
  Description of Artificial Sequence: Synthetic oligonucleotide
  Target: ATXN1; (-) strand; PAM type: NRG; PAM sequence: CAG
gtggcatgtgcctggaagcc

SEQ ID NO: 76473 - DNA, 20 bp, Artificial Sequence
  Description of Artificial Sequence: Synthetic oligonucleotide
  Target: ATXN1; (-) strand; PAM type: NRG; PAM sequence: AAG
gtgtggtggcatgtgcctgg

SEQ ID NO: 76474 - DNA, 20 bp, Artificial Sequence
  Description of Artificial Sequence: Synthetic oligonucleotide
  Target: ATXN1; (-) strand; PAM type: NRG; PAM sequence: TGG
caagtgtggtggcatgtgcc

SEQ ID NO: 76475 - DNA, 20 bp, Artificial Sequence
  Description of Artificial Sequence: Synthetic oligonucleotide
  Target: ATXN1; (-) strand; PAM type: NRG; PAM sequence: TGG
aaaaaaatagccaagtgtgg

SEQ ID NO: 76476 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaaatagccaagtg

SEQ ID NO: 76477 - DNA, 20 bp, Artificial Sequence
  Description of Artificial Sequence: Synthetic oligonucleotide
  Target: ATXN1; (-) strand; PAM type: NRG; PAM sequence: AAG
gaaaatacaaaaaaatagcc

SEQ ID NO: 76478 - DNA, 20 bp, Artificial Sequence
  Description of Artificial Sequence: Synthetic oligonucleotide
  Target: ATXN1; (-) strand; PAM type: NRG; PAM sequence: TAG
cgactgaaaatacaaaaaaa

SEQ ID NO: 76479 - DNA, 20 bp, Artificial Sequence
  Description of Artificial Sequence: Synthetic oligonucleotide
  Target: ATXN1; (-) strand; PAM type: NRG; PAM sequence: TGG
tgagatcagcctaaccaaca

SEQ ID NO: 76480 - DNA, 20 bp, Artificial Sequence
  Description of Artificial Sequence: Synthetic oligonucleotide
  Target: ATXN1; (-) strand; PAM type: NRG; PAM sequence: CAG
tgaggtcgggagtttgagat

SEQ ID NO: 76481 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcgggagttt

SEQ ID NO: 76482 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcgg

SEQ ID NO: 76483 - DNA, 20 bp, Artificial Sequence
  Description of Artificial Sequence: Synthetic oligonucleotide
  Target: ATXN1; (-) strand; PAM type: NRG; PAM sequence: GGG
cgggtggatcacctgaggtc

SEQ ID NO: 76484 - DNA, 20 bp, Artificial Sequence
  Description of Artificial Sequence: Synthetic oligonucleotide
  Target: ATXN1; (-) strand; PAM type: NRG; PAM sequence: CGG
gcgggtggatcacctgaggt

SEQ ID NO: 76485 - DNA, 20 bp, Artificial Sequence
  Description of Artificial Sequence: Synthetic oligonucleotide
  Target: ATXN1; (-) strand; PAM type: NRG; PAM sequence: AGG
cgaggcgggtggatcacctg

SEQ ID NO: 76486 - DNA, 20 bp, Artificial Sequence
  Description of Artificial Sequence: Synthetic oligonucleotide
  Target: ATXN1; (-) strand; PAM type: NRG; PAM sequence: GAG
ccgaggcgggtggatcacct

SEQ ID NO: 76487 - DNA, 20 bp, Artificial Sequence
  Description of Artificial Sequence: Synthetic oligonucleotide
  Target: ATXN1; (-) strand; PAM type: NRG; PAM sequence: TGG
ccttgggaggccgaggcggg

SEQ ID NO: 76488 - DNA, 20 bp, Artificial Sequence
  Description of Artificial Sequence: Synthetic oligonucleotide
  Target: ATXN1; (-) strand; PAM type: NRG; PAM sequence: GGG
gcaccttgggaggccgaggc

SEQ ID NO: 76489 - DNA, 20 bp, Artificial Sequence
  Description of Artificial Sequence: Synthetic oligonucleotide
  Target: ATXN1; (-) strand; PAM type: NRG; PAM sequence: CGG
agcaccttgggaggccgagg

SEQ ID NO: 76490 - DNA, 20 bp, Artificial Sequence
  Description of Artificial Sequence: Synthetic oligonucleotide
  Target: ATXN1; (-) strand; PAM type: NRG; PAM sequence: AGG
cccagcaccttgggaggccg

SEQ ID NO: 76491 - DNA, 20 bp, Artificial Sequence
  Description of Artificial Sequence: Synthetic oligonucleotide
  Target: ATXN1; (-) strand; PAM type: NRG; PAM sequence: GAG
tcccagcaccttgggaggcc

SEQ ID NO: 76492 - DNA, 20 bp, Artificial Sequence
  Description of Artificial Sequence: Synthetic oligonucleotide
  Target: ATXN1; (-) strand; PAM type: NRG; PAM sequence: AGG
gcaaatcccagcaccttggg

SEQ ID NO: 76493 - DNA, 20 bp, Artificial Sequence
  Description of Artificial Sequence: Synthetic oligonucleotide
  Target: ATXN1; (-) strand; PAM type: NRG; PAM sequence: GAG
tgcaaatcccagcaccttgg

SEQ ID NO: 76494 - DNA, 20 bp, Artificial Sequence
  Description of Artificial Sequence: Synthetic oligonucleotide
  Target: ATXN1; (-) strand; PAM type: NRG; PAM sequence: GGG
cctgcaaatcccagcacctt

SEQ ID NO: 76495 - DNA, 20 bp, Artificial Sequence
  Description of Artificial Sequence: Synthetic oligonucleotide
  Target: ATXN1; (-) strand; PAM type: NRG; PAM sequence: TGG
gcctgcaaatcccagcacct

SEQ ID NO: 76496 - DNA, 20 bp, Artificial Sequence
  Description of Artificial Sequence: Synthetic oligonucleotide
  Target: ATXN1; (-) strand; PAM type: NRG; PAM sequence: CAG
tggctcacgcctgcaaatcc

SEQ ID NO: 76497 - DNA, 20 bp, Artificial Sequence
  Description of Artificial Sequence: Synthetic oligonucleotide
  Target: ATXN1; (-) strand; PAM type: NRG; PAM sequence: TGG
tagttttaggccaggcatgg

SEQ ID NO: 76498 - DNA, 20 bp, Artificial Sequence
  Description of Artificial Sequence: Synthetic oligonucleotide
  Target: ATXN1; (-) strand; PAM type: NRG; PAM sequence: TGG
gaatagttttaggccaggca

SEQ ID NO: 76499 - DNA, 20 bp, Artificial Sequence
  Description of Artificial Sequence: Synthetic oligonucleotide
  Target: ATXN1; (-) strand; PAM type: NRG; PAM sequence: AGG
atcaagaatagttttaggcc

SEQ ID NO: 76500 - DNA, 20 bp, Artificial Sequence
  Description of Artificial Sequence: Synthetic oligonucleotide
  Target: ATXN1; (-) strand; PAM type: NRG; PAM sequence: CAG
catcaagaatagttttaggc

SEQ ID NO: 76501 - DNA, 20 bp, Artificial Sequence
  Description of Artificial Sequence: Synthetic oligonucleotide
  Target: ATXN1; (-) strand; PAM type: NRG; PAM sequence: AGG
cttacatcaagaatagtttt

SEQ ID NO: 76502 - DNA, 20 bp, Artificial Sequence
  Description of Artificial Sequence: Synthetic oligonucleotide
  Target: ATXN1; (-) strand; PAM type: NRG; PAM sequence: TAG
ccttacatcaagaatagttt

SEQ ID NO: 76503 - DNA, 20 bp, Artificial Sequence
  Description of Artificial Sequence: Synthetic oligonucleotide
  Target: ATXN1; (-) strand; PAM type: NRG; PAM sequence: TAG
gtttctccttacatcaagaa

SEQ ID NO: 76504 - DNA, 20 bp, Artificial Sequence
  Description of Artificial Sequence: Synthetic oligonucleotide
  Target: ATXN1; (-) strand; PAM type: NRG; PAM sequence: AAG
aatatgtttctccttacatc

SEQ ID NO: 76505 - DNA, 20 bp, Artificial Sequence
  Description of Artificial Sequence: Synthetic oligonucleotide
  Target: ATXN1; (-) strand; PAM type: NRG; PAM sequence: AGG
cagcactgcctttagcattt

SEQ ID NO: 76506 - DNA, 20 bp, Artificial Sequence
  Description of Artificial Sequence: Synthetic oligonucleotide
  Target: ATXN1; (-) strand; PAM type: NRG; PAM sequence: TAG
gcagcactgcctttagcatt

SEQ ID NO: 76507 - DNA, 20 bp, Artificial Sequence
  Description of Artificial Sequence: Synthetic oligonucleotide
  Target: ATXN1; (-) strand; PAM type: NRG; PAM sequence: TAG
ggatttggcagcactgcctt

SEQ ID NO: 76508 - DNA, 20 bp, Artificial Sequence
  Description of Artificial Sequence: Synthetic oligonucleotide
  Target: ATXN1; (-) strand; PAM type: NRG; PAM sequence: CAG
gctgggagccatggatttgg

SEQ ID NO: 76509 - DNA, 20 bp, Artificial Sequence
  Description of Artificial Sequence: Synthetic oligonucleotide
  Target: ATXN1; (-) strand; PAM type: NRG; PAM sequence: TGG
tatgctgggagccatggatt

SEQ ID NO: 76510 - DNA, 20 bp, Artificial Sequence
  Description of Artificial Sequence: Synthetic oligonucleotide
  Target: ATXN1; (-) strand; PAM type: NRG; PAM sequence: TGG
ttagcctatgctgggagcca

SEQ ID NO: 76511 - DNA, 20 bp, Artificial Sequence
  Description of Artificial Sequence: Synthetic oligonucleotide
  Target: ATXN1; (-) strand; PAM type: NRG; PAM sequence: GAG
aaaactttagcctatgctgg

SEQ ID NO: 76512 - DNA, 20 bp, Artificial Sequence
  Description of Artificial Sequence: Synthetic oligonucleotide
  Target: ATXN1; (-) strand; PAM type: NRG; PAM sequence: GGG
ataaaactttagcctatgct

SEQ ID NO: 76513 - DNA, 20 bp, Artificial Sequence
  Description of Artificial Sequence: Synthetic oligonucleotide
  Target: ATXN1; (-) strand; PAM type: NRG; PAM sequence: TGG
aataaaactttagcctatgc

SEQ ID NO: 76514 - DNA, 20 bp, Artificial Sequence
  Description of Artificial Sequence: Synthetic oligonucleotide
  Target: ATXN1; (-) strand; PAM type: NRG; PAM sequence: TAG
ctggtctcctaataaaactt

SEQ ID NO: 76515 - DNA, 20 bp, Artificial Sequence
  Description of Artificial Sequence: Synthetic oligonucleotide
  Target: ATXN1; (-) strand; PAM type: NRG; PAM sequence: TGG
gccagagatgtgtgcactcc

SEQ ID NO: 76516 - DNA, 20 bp, Artificial Sequence
  Description of Artificial Sequence: Synthetic oligonucleotide
  Target: ATXN1; (-) strand; PAM type: NRG; PAM sequence: GAG
ttctttgctgtccctggcca

SEQ ID NO: 76517 - DNA, 20 bp, Artificial Sequence
  Description of Artificial Sequence: Synthetic oligonucleotide
  Target: ATXN1; (-) strand; PAM type: NRG; PAM sequence: CAG
ctttctttgctgtccctggc

SEQ ID NO: 76518 - DNA, 20 bp, Artificial Sequence
  Description of Artificial Sequence: Synthetic oligonucleotide
  Target: ATXN1; (-) strand; PAM type: NRG; PAM sequence: TGG
ctgcctttctttgctgtccc

SEQ ID NO: 76519 - DNA, 20 bp, Artificial Sequence
  Description of Artificial Sequence: Synthetic oligonucleotide
  Target: ATXN1; (-) strand; PAM type: NRG; PAM sequence: CAG
tccagcagtgttgtaggact

SEQ ID NO: 76520 - DNA, 20 bp, Artificial Sequence
  Description of Artificial Sequence: Synthetic oligonucleotide
  Target: ATXN1; (-) strand; PAM type: NRG; PAM sequence: AGG
tctccttccagcagtgttgt

SEQ ID NO: 76521 - DNA, 20 bp, Artificial Sequence
  Description of Artificial Sequence: Synthetic oligonucleotide
  Target: ATXN1; (-) strand; PAM type: NRG; PAM sequence: TAG
ttctccttccagcagtgttg

SEQ ID NO: 76522 - DNA, 20 bp, Artificial Sequence
  Description of Artificial Sequence: Synthetic oligonucleotide
  Target: ATXN1; (-) strand; PAM type: NRG; PAM sequence: CAG
ctgttggcttctccttccag

SEQ ID NO: 76523 - DNA, 20 bp, Artificial Sequence
  Description of Artificial Sequence: Synthetic oligonucleotide
  Target: ATXN1; (-) strand; PAM type: NRG; PAM sequence: CAG
agactgttggcttctccttc

SEQ ID NO: 76524 - DNA, 20 bp, Artificial Sequence
  Description of Artificial Sequence: Synthetic oligonucleotide
  Target: ATXN1; (-) strand; PAM type: NRG; PAM sequence: TGG
ttttttaaatcctagactgt

SEQ ID NO: 76525 - DNA, 20 bp, Artificial Sequence
  Description of Artificial Sequence: Synthetic oligonucleotide
  Target: ATXN1; (-) strand; PAM type: NRG; PAM sequence: TAG
ttctttttttttttaaatcc

SEQ ID NO: 76526 - DNA, 20 bp, Artificial Sequence
  Description of Artificial Sequence: Synthetic oligonucleotide
  Target: ATXN1; (-) strand; PAM type: NRG; PAM sequence: CAG
ttcattcttaatggcagact

SEQ ID NO: 76527 - DNA, 20 bp, Artificial Sequence
  Description of Artificial Sequence: Synthetic oligonucleotide
  Target: ATXN1; (-) strand; PAM type: NRG; PAM sequence: CAG
atttacttcattcttaatgg

SEQ ID NO: 76528 - DNA, 20 bp, Artificial Sequence
  Description of Artificial Sequence: Synthetic oligonucleotide
  Target: ATXN1; (-) strand; PAM type: NRG; PAM sequence: TGG
gcaatttacttcattcttaa

SEQ ID NO: 76529 - DNA, 20 bp, Artificial Sequence
  Description of Artificial Sequence: Synthetic oligonucleotide
  Target: ATXN1; (-) strand; PAM type: NRG; PAM sequence: TAG
agaacattaaaaatctgtgt

SEQ ID NO: 76530 - DNA, 20 bp, Artificial Sequence
  Description of Artificial Sequence: Synthetic oligonucleotide
  Target: ATXN1; (-) strand; PAM type: NRG; PAM sequence: AAG
ttatcattttgtgtgtgtgt

SEQ ID NO: 76531 - DNA, 20 bp, Artificial Sequence
  Description of Artificial Sequence: Synthetic oligonucleotide
  Target: ATXN1; (-) strand; PAM type: NRG; PAM sequence: CAG
taatatattcatcacctcac

SEQ ID NO: 76532 - DNA, 20 bp, Artificial Sequence
  Description of Artificial Sequence: Synthetic oligonucleotide
  Target: ATXN1; (-) strand; PAM type: NRG; PAM sequence: TAG
ataacaagattcaatcaagc

SEQ ID NO: 76533 - DNA, 20 bp, Artificial Sequence
  Description of Artificial Sequence: Synthetic oligonucleotide
  Target: ATXN1; (-) strand; PAM type: NRG; PAM sequence: AAG
cattataacaagattcaatc

SEQ ID NO: 76534 - DNA, 20 bp, Artificial Sequence
  Description of Artificial Sequence: Synthetic oligonucleotide
  Target: ATXN1; (-) strand; PAM type: NRG; PAM sequence: AAG
tataatgcatacattataac

SEQ ID NO: 76535 - DNA, 20 bp, Artificial Sequence
  Description of Artificial Sequence: Synthetic oligonucleotide
  Target: ATXN1; (-) strand; PAM type: NRG; PAM sequence: CAG
ttatgtatatttatggggta

SEQ ID NO: 76536 - DNA, 20 bp, Artificial Sequence
  Description of Artificial Sequence: Synthetic oligonucleotide
  Target: ATXN1; (-) strand; PAM type: NRG; PAM sequence: GGG
aataattatgtatatttatg

SEQ ID NO: 76537 - DNA, 20 bp, Artificial Sequence
  Description of Artificial Sequence: Synthetic oligonucleotide
  Target: ATXN1; (-) strand; PAM type: NRG; PAM sequence: GGG
caataattatgtatatttat

SEQ ID NO: 76538 - DNA, 20 bp, Artificial Sequence
  Description of Artificial Sequence: Synthetic oligonucleotide
  Target: ATXN1; (-) strand; PAM type: NRG; PAM sequence: TGG
gcaataattatgtatattta

SEQ ID NO: 76539 - DNA, 20 bp, Artificial Sequence
  Description of Artificial Sequence: Synthetic oligonucleotide
  Target: ATXN1; (-) strand; PAM type: NRG; PAM sequence: AGG
ttttaactttttatatttat

SEQ ID NO: 76540 - DNA, 20 bp, Artificial Sequence
  Description of Artificial Sequence: Synthetic oligonucleotide
  Target: ATXN1; (-) strand; PAM type: NRG; PAM sequence: TAG
gttttaactttttatattta

SEQ ID NO: 76541 - DNA, 20 bp, Artificial Sequence
  Description of Artificial Sequence: Synthetic oligonucleotide
  Target: ATXN1; (-) strand; PAM type: NRG; PAM sequence: AAG
aagctatgtagcatgcatga

SEQ ID NO: 76542 - DNA, 20 bp, Artificial Sequence
  Description of Artificial Sequence: Synthetic oligonucleotide
  Target: ATXN1; (-) strand; PAM type: NRG; PAM sequence: TAG
gcaggttgtgacaagctatg

SEQ ID NO: 76543 - DNA, 20 bp, Artificial Sequence
  Description of Artificial Sequence: Synthetic oligonucleotide
  Target: ATXN1; (-) strand; PAM type: NRG; PAM sequence: AAG
ccgttccggcaggttgtgac

SEQ ID NO: 76544 - DNA, 20 bp, Artificial Sequence
  Description of Artificial Sequence: Synthetic oligonucleotide
  Target: ATXN1; (-) strand; PAM type: NRG; PAM sequence: AGG
cattggcaacccgttccggc

SEQ ID NO: 76545 - DNA, 20 bp, Artificial Sequence
  Description of Artificial Sequence: Synthetic oligonucleotide
  Target: ATXN1; (-) strand; PAM type: NRG; PAM sequence: CAG
acattggcaacccgttccgg

SEQ ID NO: 76546 - DNA, 20 bp, Artificial Sequence
  Description of Artificial Sequence: Synthetic oligonucleotide
  Target: ATXN1; (-) strand; PAM type: NRG; PAM sequence: CGG
gtcacattggcaacccgttc

SEQ ID NO: 76547 - DNA, 20 bp, Artificial Sequence
  Description of Artificial Sequence: Synthetic oligonucleotide
  Target: ATXN1; (-) strand; PAM type: NRG; PAM sequence: TGG
atcttaaaagcatgtcacat

SEQ ID NO: 76548 - DNA, 20 bp, Artificial Sequence
  Description of Artificial Sequence: Synthetic oligonucleotide
  Target: ATXN1; (-) strand; PAM type: NRG; PAM sequence: AAG
ctggagggctgtgatcttaa

SEQ ID NO: 76549 - DNA, 20 bp, Artificial Sequence
  Description of Artificial Sequence: Synthetic oligonucleotide
  Target: ATXN1; (-) strand; PAM type: NRG; PAM sequence: GGG
ggtatcaatgtgttgctgga

SEQ ID NO: 76550 - DNA, 20 bp, Artificial Sequence
  Description of Artificial Sequence: Synthetic oligonucleotide
  Target: ATXN1; (-) strand; PAM type: NRG; PAM sequence: AGG
aggtatcaatgtgttgctgg

SEQ ID NO: 76551 - DNA, 20 bp, Artificial Sequence
  Description of Artificial Sequence: Synthetic oligonucleotide
  Target: ATXN1; (-) strand; PAM type: NRG; PAM sequence: GAG
caggtatcaatgtgttgctg

SEQ ID NO: 76552 - DNA, 20 bp, Artificial Sequence
  Description of Artificial Sequence: Synthetic oligonucleotide
  Target: ATXN1; (-) strand; PAM type: NRG; PAM sequence: TGG
ttcaggtatcaatgtgttgc

SEQ ID NO: 76553 - DNA, 20 bp, Artificial Sequence
  Description of Artificial Sequence: Synthetic oligonucleotide
  Target: ATXN1; (-) strand; PAM type: NRG; PAM sequence: AGG
actcttaattatggagtttc

SEQ ID NO: 76554 - DNA, 20 bp, Artificial Sequence
  Description of Artificial Sequence: Synthetic oligonucleotide
  Target: ATXN1; (-) strand; PAM type: NRG; PAM sequence: CAG
aactcttaattatggagttt

SEQ ID NO: 76555 - DNA, 20 bp, Artificial Sequence
  Description of Artificial Sequence: Synthetic oligonucleotide
  Target: ATXN1; (-) strand; PAM type: NRG; PAM sequence: GAG
ggaaataactcttaattatg

SEQ ID NO: 76556 - DNA, 20 bp, Artificial Sequence
  Description of Artificial Sequence: Synthetic oligonucleotide
  Target: ATXN1; (-) strand; PAM type: NRG; PAM sequence: TGG
aaggaaataactcttaatta

SEQ ID NO: 76557 - DNA, 20 bp, Artificial Sequence
  Description of Artificial Sequence: Synthetic oligonucleotide
  Target: ATXN1; (-) strand; PAM type: NRG; PAM sequence: AGG
agaaaacatctttaaacaaa

SEQ ID NO: 76558 - DNA, 20 bp, Artificial Sequence
  Description of Artificial Sequence: Synthetic oligonucleotide
  Target: ATXN1; (-) strand; PAM type: NRG; PAM sequence: AAG
gagaaaacatctttaaacaa

SEQ ID NO: 76559 - DNA, 20 bp, Artificial Sequence
  Description of Artificial Sequence: Synthetic oligonucleotide
  Target: ATXN1; (-) strand; PAM type: NRG; PAM sequence: GAG
attatactgaaatttcaaaa

SEQ ID NO: 76560 - DNA, 20 bp, Artificial Sequence
  Description of Artificial Sequence: Synthetic oligonucleotide
  Target: ATXN1; (-) strand; PAM type: NRG; PAM sequence: AAG
atattatactgaaatttcaa

SEQ ID NO: 76561 - DNA, 20 bp, Artificial Sequence
  Description of Artificial Sequence: Synthetic oligonucleotide
  Target: ATXN1; (-) strand; PAM type: NRG; PAM sequence: TAG
tggatataccacttccaaag

SEQ ID NO: 76562 - DNA, 20 bp, Artificial Sequence
  Description of Artificial Sequence: Synthetic oligonucleotide
  Target: ATXN1; (-) strand; PAM type: NRG; PAM sequence: AAG
atctggatataccacttcca

SEQ ID NO: 76563 - DNA, 20 bp, Artificial Sequence
  Description of Artificial Sequence: Synthetic oligonucleotide
  Target: ATXN1; (-) strand; PAM type: NRG; PAM sequence: TGG
atgcatatattttggagatc

SEQ ID NO: 76564 - DNA, 20 bp, Artificial Sequence
  Description of Artificial Sequence: Synthetic oligonucleotide
  Target: ATXN1; (-) strand; PAM type: NRG; PAM sequence: GAG
atgcatatgcatatattttg

SEQ ID NO: 76565 - DNA, 20 bp, Artificial Sequence
  Description of Artificial Sequence: Synthetic oligonucleotide
  Target: ATXN1; (-) strand; PAM type: NRG; PAM sequence: TGG
atatgcatatgcatatattt

SEQ ID NO: 76566 - DNA, 20 bp, Artificial Sequence
  Description of Artificial Sequence: Synthetic oligonucleotide
  Target: ATXN1; (-) strand; PAM type: NRG; PAM sequence: CGG
gtaaagttaggatcaatact

SEQ ID NO: 76567 - DNA, 20 bp, Artificial Sequence
  Description of Artificial Sequence: Synthetic oligonucleotide
  Target: ATXN1; (-) strand; PAM type: NRG; PAM sequence: AGG
agctggaaagtggtaaagtt

SEQ ID NO: 76568 - DNA, 20 bp, Artificial Sequence
  Description of Artificial Sequence: Synthetic oligonucleotide
  Target: ATXN1; (-) strand; PAM type: NRG; PAM sequence: TAG
gagctggaaagtggtaaagt

SEQ ID NO: 76569 - DNA, 20 bp, Artificial Sequence
  Description of Artificial Sequence: Synthetic oligonucleotide
  Target: ATXN1; (-) strand; PAM type: NRG; PAM sequence: AAG
gacagagctggaaagtggta

SEQ ID NO: 76570 - DNA, 20 bp, Artificial Sequence
  Description of Artificial Sequence: Synthetic oligonucleotide
  Target: ATXN1; (-) strand; PAM type: NRG; PAM sequence: TGG
aaagtgacagagctggaaag

SEQ ID NO: 76571 - DNA, 20 bp, Artificial Sequence
  Description of Artificial Sequence: Synthetic oligonucleotide
  Target: ATXN1; (-) strand; PAM type: NRG; PAM sequence: AAG
ctcaaagtgacagagctgga

SEQ ID NO: 76572 - DNA, 20 bp, Artificial Sequence
  Description of Artificial Sequence: Synthetic oligonucleotide
  Target: ATXN1; (-) strand; PAM type: NRG; PAM sequence: TGG
tttcctcaaagtgacagagc

SEQ ID NO: 76573 - DNA, 20 bp, Artificial Sequence
  Description of Artificial Sequence: Synthetic oligonucleotide
  Target: ATXN1; (-) strand; PAM type: NRG; PAM sequence: GAG
ataatttcctcaaagtgaca

SEQ ID NO: 76574 - DNA, 20 bp, Artificial Sequence
  Description of Artificial Sequence: Synthetic oligonucleotide
  Target: ATXN1; (-) strand; PAM type: NRG; PAM sequence: CAG
aaataatttcctcaaagtga

SEQ ID NO: 76575 - DNA, 20 bp, Artificial Sequence
  Description of Artificial Sequence: Synthetic oligonucleotide
  Target: ATXN1; (-) strand; PAM type: NRG; PAM sequence: AAG
gccagtaaataatttcctca

SEQ ID NO: 76576 - DNA, 20 bp, Artificial Sequence
  Description of Artificial Sequence: Synthetic oligonucleotide
  Target: ATXN1; (-) strand; PAM type: NRG; PAM sequence: CAG
gatgaacttgagggtcaagc

SEQ ID NO: 76577 - DNA, 20 bp, Artificial Sequence
  Description of Artificial Sequence: Synthetic oligonucleotide
  Target: ATXN1; (-) strand; PAM type: NRG; PAM sequence: AAG
agcggatgaacttgagggtc

SEQ ID NO: 76578 - DNA, 20 bp, Artificial Sequence
  Description of Artificial Sequence: Synthetic oligonucleotide
  Target: ATXN1; (-) strand; PAM type: NRG; PAM sequence: GGG
tttacagcggatgaacttga

SEQ ID NO: 76579 - DNA, 20 bp, Artificial Sequence
  Description of Artificial Sequence: Synthetic oligonucleotide
  Target: ATXN1; (-) strand; PAM type: NRG; PAM sequence: AGG
ttttacagcggatgaacttg

SEQ ID NO: 76580 - DNA, 20 bp, Artificial Sequence
  Description of Artificial Sequence: Synthetic oligonucleotide
  Target: ATXN1; (-) strand; PAM type: NRG; PAM sequence: GAG
cttttacagcggatgaactt

SEQ ID NO: 76581 - DNA, 20 bp, Artificial Sequence
  Description of Artificial Sequence: Synthetic oligonucleotide
  Target: ATXN1; (-) strand; PAM type: NRG; PAM sequence: CGG
gttagtgactccttttacag

SEQ ID NO: 76582 - DNA, 20 bp, Artificial Sequence
  Description of Artificial Sequence: Synthetic oligonucleotide
  Target: ATXN1; (-) strand; PAM type: NRG; PAM sequence: CAG
agcgttagtgactcctttta

SEQ ID NO: 76583 - DNA, 20 bp, Artificial Sequence
  Description of Artificial Sequence: Synthetic oligonucleotide
  Target: ATXN1; (-) strand; PAM type: NRG; PAM sequence: TAG
caaccttctgagacaagcgt

SEQ ID NO: 76584 - DNA, 20 bp, Artificial Sequence
  Description of Artificial Sequence: Synthetic oligonucleotide
  Target: ATXN1; (-) strand; PAM type: NRG; PAM sequence: AAG
acgtaacaaccttctgagac

SEQ ID NO: 76585 - DNA, 20 bp, Artificial Sequence
  Description of Artificial Sequence: Synthetic oligonucleotide
  Target: ATXN1; (-) strand; PAM type: NRG; PAM sequence: GAG
tatatacgtaacaaccttct

SEQ ID NO: 76586 - DNA, 20 bp, Artificial Sequence
  Description of Artificial Sequence: Synthetic oligonucleotide
  Target: ATXN1; (-) strand; PAM type: NRG; PAM sequence: TAG
tgggtgtggtctgggccgcg

SEQ ID NO: 76587 - DNA, 20 bp, Artificial Sequence
  Description of Artificial Sequence: Synthetic oligonucleotide
  Target: ATXN1; (-) strand; PAM type: NRG; PAM sequence: GGG
ggctgctgtgggtgtggtct

SEQ ID NO: 76588 - DNA, 20 bp, Artificial Sequence
  Description of Artificial Sequence: Synthetic oligonucleotide
  Target: ATXN1; (-) strand; PAM type: NRG; PAM sequence: TGG
tggctgctgtgggtgtggtc

SEQ ID NO: 76589 - DNA, 20 bp, Artificial Sequence
  Description of Artificial Sequence: Synthetic oligonucleotide
  Target: ATXN1; (-) strand; PAM type: NRG; PAM sequence: TGG
ccgagtggctgctgtgggtg

SEQ ID NO: 76590 - DNA, 20 bp, Artificial Sequence
  Description of Artificial Sequence: Synthetic oligonucleotide
  Target: ATXN1; (-) strand; PAM type: NRG; PAM sequence: GGG
agtgtccgagtggctgctgt

SEQ ID NO: 76591 - DNA, 20 bp, Artificial Sequence
  Description of Artificial Sequence: Synthetic oligonucleotide
  Target: ATXN1; (-) strand; PAM type: NRG; PAM sequence: TGG
cagtgtccgagtggctgctg

SEQ ID NO: 76592 - DNA, 20 bp, Artificial Sequence
  Description of Artificial Sequence: Synthetic oligonucleotide
  Target: ATXN1; (-) strand; PAM type: NRG; PAM sequence: TGG
ggggaaaaccagtgtccgag

SEQ ID NO: 76593 - DNA, 20 bp, Artificial Sequence
  Description of Artificial Sequence: Synthetic oligonucleotide
  Target: ATXN1; (-) strand; PAM type: NRG; PAM sequence: GAG
agaggggaaaaccagtgtcc

SEQ ID NO: 76594 - DNA, 20 bp, Artificial Sequence
  Description of Artificial Sequence: Synthetic oligonucleotide
  Target: ATXN1; (-) strand; PAM type: NRG; PAM sequence: CAG
gtagaaagagaggggaaaac

SEQ ID NO: 76595 - DNA, 20 bp, Artificial Sequence
  Description of Artificial Sequence: Synthetic oligonucleotide
  Target: ATXN1; (-) strand; PAM type: NRG; PAM sequence: GGG
cctgctgtgtagaaagagag

SEQ ID NO: 76596 - DNA, 20 bp, Artificial Sequence
  Description of Artificial Sequence: Synthetic oligonucleotide
  Target: ATXN1; (-) strand; PAM type: NRG; PAM sequence: GGG
acctgctgtgtagaaagaga

SEQ ID NO: 76597 - DNA, 20 bp, Artificial Sequence
  Description of Artificial Sequence: Synthetic oligonucleotide
  Target: ATXN1; (-) strand; PAM type: NRG; PAM sequence: AGG
gacctgctgtgtagaaagag

SEQ ID NO: 76598 - DNA, 20 bp, Artificial Sequence
  Description of Artificial Sequence: Synthetic oligonucleotide
  Target: ATXN1; (-) strand; PAM type: NRG; PAM sequence: GAG
tgacctgctgtgtagaaaga

SEQ ID NO: 76599 - DNA, 20 bp, Artificial Sequence
  Description of Artificial Sequence: Synthetic oligonucleotide
  Target: ATXN1; (-) strand; PAM type: NRG; PAM sequence: GAG
tatgacctgctgtgtagaaa

SEQ ID NO: 76600 - DNA, 20 bp, Artificial Sequence
  Description of Artificial Sequence: Synthetic oligonucleotide
  Target: ATXN1; (-) strand; PAM type: NRG; PAM sequence: AAG
cttatgacctgctgtgtaga

SEQ ID NO: 76601 - DNA, 20 bp, Artificial Sequence
  Description of Artificial Sequence: Synthetic oligonucleotide
  Target: ATXN1; (-) strand; PAM type: NRG; PAM sequence: TAG
acttcttatgacctgctgtg

SEQ ID NO: 76602 - DNA, 20 bp, Artificial Sequence
  Description of Artificial Sequence: Synthetic oligonucleotide
  Target: ATXN1; (-) strand; PAM type: NRG; PAM sequence: GAG
accaggaagccagcatcctt

SEQ ID NO: 76603 - DNA, 20 bp, Artificial Sequence
  Description of Artificial Sequence: Synthetic oligonucleotide
  Target: ATXN1; (-) strand; PAM type: NRG; PAM sequence: CAG
atcattccacaccaggaagc

SEQ ID NO: 76604 - DNA, 20 bp, Artificial Sequence
  Description of Artificial Sequence: Synthetic oligonucleotide
  Target: ATXN1; (-) strand; PAM type: NRG; PAM sequence: AAG
ccttatcattccacaccagg

SEQ ID NO: 76605 - DNA, 20 bp, Artificial Sequence
  Description of Artificial Sequence: Synthetic oligonucleotide
  Target: ATXN1; (-) strand; PAM type: NRG; PAM sequence: AGG
ccgccttatcattccacacc

SEQ ID NO: 76606 - DNA, 20 bp, Artificial Sequence
  Description of Artificial Sequence: Synthetic oligonucleotide
  Target: ATXN1; (-) strand; PAM type: NRG; PAM sequence: CAG
gccgccttatcattccacac

SEQ ID NO: 76607 - DNA, 20 bp, Artificial Sequence
  Description of Artificial Sequence: Synthetic oligonucleotide
  Target: ATXN1; (-) strand; PAM type: NRG; PAM sequence: TGG
ccacccccactccagcttgc

SEQ ID NO: 76608 - DNA, 20 bp, Artificial Sequence
  Description of Artificial Sequence: Synthetic oligonucleotide
  Target: ATXN1; (-) strand; PAM type: NRG; PAM sequence: CAG
ttctcctgccacccccactc

SEQ ID NO: 76609 - DNA, 20 bp, Artificial Sequence
  Description of Artificial Sequence: Synthetic oligonucleotide
  Target: ATXN1; (-) strand; PAM type: NRG; PAM sequence: AGG
caggttctgtcatggggccc

SEQ ID NO: 76610 - DNA, 20 bp, Artificial Sequence
  Description of Artificial Sequence: Synthetic oligonucleotide
  Target: ATXN1; (-) strand; PAM type: NRG; PAM sequence: CAG
acaggttctgtcatggggcc

SEQ ID NO: 76611 - DNA, 20 bp, Artificial Sequence
  Description of Artificial Sequence: Synthetic oligonucleotide
  Target: ATXN1; (-) strand; PAM type: NRG; PAM sequence: GGG
gtgaaacaggttctgtcatg

SEQ ID NO: 76612 - DNA, 20 bp, Artificial Sequence
  Description of Artificial Sequence: Synthetic oligonucleotide
  Target: ATXN1; (-) strand; PAM type: NRG; PAM sequence: GGG
tgtgaaacaggttctgtcat

SEQ ID NO: 76613 - DNA, 20 bp, Artificial Sequence
  Description of Artificial Sequence: Synthetic oligonucleotide
  Target: ATXN1; (-) strand; PAM type: NRG; PAM sequence: TGG
ttgtgaaacaggttctgtca

SEQ ID NO: 76614 - DNA, 20 bp, Artificial Sequence
  Description of Artificial Sequence: Synthetic oligonucleotide
  Target: ATXN1; (-) strand; PAM type: NRG; PAM sequence: AGG
cctcaccacatttgtgaaac

SEQ ID NO: 76615 - DNA, 20 bp, Artificial Sequence
  Description of Artificial Sequence: Synthetic oligonucleotide
  Target: ATXN1; (-) strand; PAM type: NRG; PAM sequence: CAG
ccctcaccacatttgtgaaa

SEQ ID NO: 76616 - DNA, 20 bp, Artificial Sequence
  Description of Artificial Sequence: Synthetic oligonucleotide
  Target: ATXN1; (-) strand; PAM type: NRG; PAM sequence: GAG
cctttttgtgcactggagca

SEQ ID NO: 76617 - DNA, 20 bp, Artificial Sequence
  Description of Artificial Sequence: Synthetic oligonucleotide
  Target: ATXN1; (-) strand; PAM type: NRG; PAM sequence: CAG
agcctttttgtgcactggag

SEQ ID NO: 76618 - DNA, 20 bp, Artificial Sequence
  Description of Artificial Sequence: Synthetic oligonucleotide
  Target: ATXN1; (-) strand; PAM type: NRG; PAM sequence: GAG
tgcagcctttttgtgcactg

SEQ ID NO: 76619 - DNA, 20 bp, Artificial Sequence
  Description of Artificial Sequence: Synthetic oligonucleotide
  Target: ATXN1; (-) strand; PAM type: NRG; PAM sequence: TGG
cctgcagcctttttgtgcac

SEQ ID NO: 76620 - DNA, 20 bp, Artificial Sequence
  Description of Artificial Sequence: Synthetic oligonucleotide
  Target: ATXN1; (-) strand; PAM type: NRG; PAM sequence: CAG
tgcaaaatggtgtcagcctg

SEQ ID NO: 76621 - DNA, 20 bp, Artificial Sequence
  Description of Artificial Sequence: Synthetic oligonucleotide
  Target: ATXN1; (-) strand; PAM type: NRG; PAM sequence: CAG
tgaacactgcaaaatggtgt

SEQ ID NO: 76622 - DNA, 20 bp, Artificial Sequence
  Description of Artificial Sequence: Synthetic oligonucleotide
  Target: ATXN1; (-) strand; PAM type: NRG; PAM sequence: TGG
tgccagtgaacactgcaaaa

SEQ ID NO: 76623 - DNA, 20 bp, Artificial Sequence
  Description of Artificial Sequence: Synthetic oligonucleotide
  Target: ATXN1; (-) strand; PAM type: NRG; PAM sequence: CAG
ttctatgtcagcagccttgc

SEQ ID NO: 76624 - DNA, 20 bp, Artificial Sequence
  Description of Artificial Sequence: Synthetic oligonucleotide
  Target: ATXN1; (-) strand; PAM type: NRG; PAM sequence: CAG
gaggccagtttctatgtcag

SEQ ID NO: 76625 - DNA, 20 bp, Artificial Sequence
  Description of Artificial Sequence: Synthetic oligonucleotide
  Target: ATXN1; (-) strand; PAM type: NRG; PAM sequence: CAG
acggaggccagtttctatgt

SEQ ID NO: 76626 - DNA, 20 bp, Artificial Sequence
  Description of Artificial Sequence: Synthetic oligonucleotide
  Target: ATXN1; (-) strand; PAM type: NRG; PAM sequence: CAG
tgtgactttttgacggaggc

SEQ ID NO: 76627 - DNA, 20 bp, Artificial Sequence
  Description of Artificial Sequence: Synthetic oligonucleotide
  Target: ATXN1; (-) strand; PAM type: NRG; PAM sequence: AGG
gaggtgtgactttttgacgg

SEQ ID NO: 76628 - DNA, 20 bp, Artificial Sequence
  Description of Artificial Sequence: Synthetic oligonucleotide
  Target: ATXN1; (-) strand; PAM type: NRG; PAM sequence: GAG
agaggtgtgactttttgacg

SEQ ID NO: 76629 - DNA, 20 bp, Artificial Sequence
  Description of Artificial Sequence: Synthetic oligonucleotide
  Target: ATXN1; (-) strand; PAM type: NRG; PAM sequence: CGG
ggagaggtgtgactttttga

SEQ ID NO: 76630 - DNA, 20 bp, Artificial Sequence
  Description of Artificial Sequence: Synthetic oligonucleotide
  Target: ATXN1; (-) strand; PAM type: NRG; PAM sequence: AGG
caccaagccaggaaaaggag

SEQ ID NO: 76631 - DNA, 20 bp, Artificial Sequence
  Description of Artificial Sequence: Synthetic oligonucleotide
  Target: ATXN1; (-) strand; PAM type: NRG; PAM sequence: GAG
acaccaagccaggaaaagga

SEQ ID NO: 76632 - DNA, 20 bp, Artificial Sequence
  Description of Artificial Sequence: Synthetic oligonucleotide
  Target: ATXN1; (-) strand; PAM type: NRG; PAM sequence: GAG
ggacaccaagccaggaaaag

SEQ ID NO: 76633 - DNA, 20 bp, Artificial Sequence
  Description of Artificial Sequence: Synthetic oligonucleotide
  Target: ATXN1; (-) strand; PAM type: NRG; PAM sequence: AGG
ctggacaccaagccaggaaa

SEQ ID NO: 76634 - DNA, 20 bp, Artificial Sequence
  Description of Artificial Sequence: Synthetic oligonucleotide
  Target: ATXN1; (-) strand; PAM type: NRG; PAM sequence: AAG
gctggacaccaagccaggaa

SEQ ID NO: 76635 - DNA, 20 bp, Artificial Sequence
  Description of Artificial Sequence: Synthetic oligonucleotide
  Target: ATXN1; (-) strand; PAM type: NRG; PAM sequence: AGG
tttcagctggacaccaagcc

SEQ ID NO: 76636 - DNA, 20 bp, Artificial Sequence
  Description of Artificial Sequence: Synthetic oligonucleotide
  Target: ATXN1; (-) strand; PAM type: NRG; PAM sequence: CAG
ttttcagctggacaccaagc

SEQ ID NO: 76637 - DNA, 20 bp, Artificial Sequence
  Description of Artificial Sequence: Synthetic oligonucleotide
  Target: ATXN1; (-) strand; PAM type: NRG; PAM sequence: AAG
cctcttttcagctggacacc

SEQ ID NO: 76638 - DNA, 20 bp, Artificial Sequence
  Description of Artificial Sequence: Synthetic oligonucleotide
  Target: ATXN1; (-) strand; PAM type: NRG; PAM sequence: TGG
gaacccctcctcttttcagc

SEQ ID NO: 76639 - DNA, 20 bp, Artificial Sequence
  Description of Artificial Sequence: Synthetic oligonucleotide
  Target: ATXN1; (-) strand; PAM type: NRG; PAM sequence: CAG
acatgaacccctcctctttt

SEQ ID NO: 76640 - DNA, 20 bp, Artificial Sequence
  Description of Artificial Sequence: Synthetic oligonucleotide
  Target: ATXN1; (-) strand; PAM type: NRG; PAM sequence: CAG
gcccttggggtaaagctgtc

SEQ ID NO: 76641 - DNA, 20 bp, Artificial Sequence
  Description of Artificial Sequence: Synthetic oligonucleotide
  Target: ATXN1; (-) strand; PAM type: NRG; PAM sequence: AAG
ttgcaggtgcccttggggta

SEQ ID NO: 76642 - DNA, 20 bp, Artificial Sequence
  Description of Artificial Sequence: Synthetic oligonucleotide
  Target: ATXN1; (-) strand; PAM type: NRG; PAM sequence: GGG
ctaccttgcaggtgcccttg

SEQ ID NO: 76643 - DNA, 20 bp, Artificial Sequence
  Description of Artificial Sequence: Synthetic oligonucleotide
  Target: ATXN1; (-) strand; PAM type: NRG; PAM sequence: GGG
actaccttgcaggtgccctt

SEQ ID NO: 76644 - DNA, 20 bp, Artificial Sequence
  Description of Artificial Sequence: Synthetic oligonucleotide
  Target: ATXN1; (-) strand; PAM type: NRG; PAM sequence: TGG
tactaccttgcaggtgccct

SEQ ID NO: 76645 - DNA, 20 bp, Artificial Sequence
  Description of Artificial Sequence: Synthetic oligonucleotide
  Target: ATXN1; (-) strand; PAM type: NRG; PAM sequence: AGG
atctgctcctactaccttgc

SEQ ID NO: 76646 - DNA, 20 bp, Artificial Sequence
  Description of Artificial Sequence: Synthetic oligonucleotide
  Target: ATXN1; (-) strand; PAM type: NRG; PAM sequence: CAG
catctgctcctactaccttg

SEQ ID NO: 76647 - DNA, 20 bp, Artificial Sequence
  Description of Artificial Sequence: Synthetic oligonucleotide
  Target: ATXN1; (-) strand; PAM type: NRG; PAM sequence: TAG
gtccccctgtcatctggcca

SEQ ID NO: 76648 - DNA, 20 bp, Artificial Sequence
  Description of Artificial Sequence: Synthetic oligonucleotide
  Target: ATXN1; (-) strand; PAM type: NRG; PAM sequence: TGG
tggcatgtccccctgtcatc

SEQ ID NO: 76649 - DNA, 20 bp, Artificial Sequence
  Description of Artificial Sequence: Synthetic oligonucleotide
  Target: ATXN1; (-) strand; PAM type: NRG; PAM sequence: TGG
gctgcattagttccttctgc

SEQ ID NO: 76650 - DNA, 20 bp, Artificial Sequence
  Description of Artificial Sequence: Synthetic oligonucleotide
  Target: ATXN1; (-) strand; PAM type: NRG; PAM sequence: TAG
cagcaagttggaagctgcat

SEQ ID NO: 76651 - DNA, 20 bp, Artificial Sequence
  Description of Artificial Sequence: Synthetic oligonucleotide
  Target: ATXN1; (-) strand; PAM type: NRG; PAM sequence: AAG
gctgggcaccagcaagttgg

SEQ ID NO: 76652 - DNA, 20 bp, Artificial Sequence
  Description of Artificial Sequence: Synthetic oligonucleotide
  Target: ATXN1; (-) strand; PAM type: NRG; PAM sequence: TGG
ctggctgggcaccagcaagt

SEQ ID NO: 76653 - DNA, 20 bp, Artificial Sequence
  Description of Artificial Sequence: Synthetic oligonucleotide
  Target: ATXN1; (-) strand; PAM type: NRG; PAM sequence: AAG
gggtctggctgggcaccagc

SEQ ID NO: 76654 - DNA, 20 bp, Artificial Sequence
  Description of Artificial Sequence: Synthetic oligonucleotide
  Target: ATXN1; (-) strand; PAM type: NRG; PAM sequence: CAG
agtggggtctggctgggcac

SEQ ID NO: 76655 - DNA, 20 bp, Artificial Sequence
  Description of Artificial Sequence: Synthetic oligonucleotide
  Target: ATXN1; (-) strand; PAM type: NRG; PAM sequence: GGG
caaatcagtggggtctggct

SEQ ID NO: 76656 - DNA, 20 bp, Artificial Sequence
  Description of Artificial Sequence: Synthetic oligonucleotide
  Target: ATXN1; (-) strand; PAM type: NRG; PAM sequence: TGG
ccaaatcagtggggtctggc

SEQ ID NO: 76657 - DNA, 20 bp, Artificial Sequence
  Description of Artificial Sequence: Synthetic oligonucleotide
  Target: ATXN1; (-) strand; PAM type: NRG; PAM sequence: TGG
gtctccaaatcagtggggtc

SEQ ID NO: 76658 - DNA, 20 bp, Artificial Sequence
  Description of Artificial Sequence: Synthetic oligonucleotide
  Target: ATXN1; (-) strand; PAM type: NRG; PAM sequence: GGG
ggaaagtctccaaatcagtg

SEQ ID NO: 76659 - DNA, 20 bp, Artificial Sequence
  Description of Artificial Sequence: Synthetic oligonucleotide
  Target: ATXN1; (-) strand; PAM type: NRG; PAM sequence: GGG
aggaaagtctccaaatcagt

SEQ ID NO: 76660 - DNA, 20 bp, Artificial Sequence
  Description of Artificial Sequence: Synthetic oligonucleotide
  Target: ATXN1; (-) strand; PAM type: NRG; PAM sequence: TGG
caggaaagtctccaaatcag

SEQ ID NO: 76661 - DNA, 20 bp, Artificial Sequence
  Description of Artificial Sequence: Synthetic oligonucleotide
  Target: ATXN1; (-) strand; PAM type: NRG; PAM sequence: CAG
tggcaggaaagtctccaaat

SEQ ID NO: 76662 - DNA, 20 bp, Artificial Sequence
  Description of Artificial Sequence: Synthetic oligonucleotide
  Target: ATXN1; (-) strand; PAM type: NRG; PAM sequence: AAG
tttttggcaagttggcagga

SEQ ID NO: 76663 - DNA, 20 bp, Artificial Sequence
  Description of Artificial Sequence: Synthetic oligonucleotide
  Target: ATXN1; (-) strand; PAM type: NRG; PAM sequence: AGG
tcagtttttggcaagttggc

SEQ ID NO: 76664 - DNA, 20 bp, Artificial Sequence
  Description of Artificial Sequence: Synthetic oligonucleotide
  Target: ATXN1; (-) strand; PAM type: NRG; PAM sequence: CAG
atcagtttttggcaagttgg

SEQ ID NO: 76665 - DNA, 20 bp, Artificial Sequence
  Description of Artificial Sequence: Synthetic oligonucleotide
  Target: ATXN1; (-) strand; PAM type: NRG; PAM sequence: TGG
cagatcagtttttggcaagt

SEQ ID NO: 76666 - DNA, 20 bp, Artificial Sequence
  Description of Artificial Sequence: Synthetic oligonucleotide
  Target: ATXN1; (-) strand; PAM type: NRG; PAM sequence: AAG
gtgtcagatcagtttttggc

SEQ ID NO: 76667 - DNA, 20 bp, Artificial Sequence
  Description of Artificial Sequence: Synthetic oligonucleotide
  Target: ATXN1; (-) strand; PAM type: NRG; PAM sequence: TGG
ttgggtgtcagatcagtttt

SEQ ID NO: 76668 - DNA, 20 bp, Artificial Sequence
  Description of Artificial Sequence: Synthetic oligonucleotide
  Target: ATXN1; (-) strand; PAM type: NRG; PAM sequence: CAG
gacaccattgggtgtcagat

SEQ ID NO: 76669 - DNA, 20 bp, Artificial Sequence
  Description of Artificial Sequence: Synthetic oligonucleotide
  Target: ATXN1; (-) strand; PAM type: NRG; PAM sequence: CAG
ttggtgacaccattgggtgt

SEQ ID NO: 76670 - DNA, 20 bp, Artificial Sequence
  Description of Artificial Sequence: Synthetic oligonucleotide
  Target: ATXN1; (-) strand; PAM type: NRG; PAM sequence: GGG
acatctttggtgacaccatt

SEQ ID NO: 76671 - DNA, 20 bp, Artificial Sequence
  Description of Artificial Sequence: Synthetic oligonucleotide
  Target: ATXN1; (-) strand; PAM type: NRG; PAM sequence: TGG
aacatctttggtgacaccat

SEQ ID NO: 76672 - DNA, 20 bp, Artificial Sequence
  Description of Artificial Sequence: Synthetic oligonucleotide
  Target: ATXN1; (-) strand; PAM type: NRG; PAM sequence: TGG
ataggaaaagaaaacatctt

SEQ ID NO: 76673 - DNA, 20 bp, Artificial Sequence
  Description of Artificial Sequence: Synthetic oligonucleotide
  Target: ATXN1; (-) strand; PAM type: NRG; PAM sequence: AAG
gaggtactgatgcataggaa

SEQ ID NO: 76674 - DNA, 20 bp, Artificial Sequence
  Description of Artificial Sequence: Synthetic oligonucleotide
  Target: ATXN1; (-) strand; PAM type: NRG; PAM sequence: AGG
gtgtggaggtactgatgcat

SEQ ID NO: 76675 - DNA, 20 bp, Artificial Sequence
  Description of Artificial Sequence: Synthetic oligonucleotide
  Target: ATXN1; (-) strand; PAM type: NRG; PAM sequence: TAG
ggtgtggaggtactgatgca

SEQ ID NO: 76676 - DNA, 20 bp, Artificial Sequence
  Description of Artificial Sequence: Synthetic oligonucleotide
  Target: ATXN1; (-) strand; PAM type: NRG; PAM sequence: AGG
agactgatccctgggtgtgg

SEQ ID NO: 76677 - DNA, 20 bp, Artificial Sequence
  Description of Artificial Sequence: Synthetic oligonucleotide
  Target: ATXN1; (-) strand; PAM type: NRG; PAM sequence: GAG
aagactgatccctgggtgtg

SEQ ID NO: 76678 - DNA, 20 bp, Artificial Sequence
  Description of Artificial Sequence: Synthetic oligonucleotide
  Target: ATXN1; (-) strand; PAM type: NRG; PAM sequence: TGG
ggaagactgatccctgggtg

SEQ ID NO: 76679 - DNA, 20 bp, Artificial Sequence
  Description of Artificial Sequence: Synthetic oligonucleotide
  Target: ATXN1; (-) strand; PAM type: NRG; PAM sequence: GGG
gtgaaggaagactgatccct

SEQ ID NO: 76680 - DNA, 20 bp, Artificial Sequence
  Description of Artificial Sequence: Synthetic oligonucleotide
  Target: ATXN1; (-) strand; PAM type: NRG; PAM sequence: TGG
ggtgaaggaagactgatccc

SEQ ID NO: 76681 - DNA, 20 bp, Artificial Sequence
  Description of Artificial Sequence: Synthetic oligonucleotide
  Target: ATXN1; (-) strand; PAM type: NRG; PAM sequence: AAG
cctttagagtgaggtgaagg

SEQ ID NO: 76682 - DNA, 20 bp, Artificial Sequence
  Description of Artificial Sequence: Synthetic oligonucleotide
  Target: ATXN1; (-) strand; PAM type: NRG; PAM sequence: AGG
ggccctttagagtgaggtga

SEQ ID NO: 76683 - DNA, 20 bp, Artificial Sequence
  Description of Artificial Sequence: Synthetic oligonucleotide
  Target: ATXN1; (-) strand; PAM type: NRG; PAM sequence: AAG
tggccctttagagtgaggtg

SEQ ID NO: 76684 - DNA, 20 bp, Artificial Sequence
  Description of Artificial Sequence: Synthetic oligonucleotide
  Target: ATXN1; (-) strand; PAM type: NRG; PAM sequence: AGG
atggctggccctttagagtg

SEQ ID NO: 76685 - DNA, 20 bp, Artificial Sequence
  Description of Artificial Sequence: Synthetic oligonucleotide
  Target: ATXN1; (-) strand; PAM type: NRG; PAM sequence: GAG
gatggctggccctttagagt

SEQ ID NO: 76686 - DNA, 20 bp, Artificial Sequence
  Description of Artificial Sequence: Synthetic oligonucleotide
  Target: ATXN1; (-) strand; PAM type: NRG; PAM sequence: GAG
caatgatggctggcccttta

SEQ ID NO: 76687 - DNA, 20 bp, Artificial Sequence
  Description of Artificial Sequence: Synthetic oligonucleotide
  Target: ATXN1; (-) strand; PAM type: NRG; PAM sequence: TAG
ggcaatgatggctggccctt

SEQ ID NO: 76688 - DNA, 20 bp, Artificial Sequence
  Description of Artificial Sequence: Synthetic oligonucleotide
  Target: ATXN1; (-) strand; PAM type: NRG; PAM sequence: TGG
ccttggaaggcaatgatggc

SEQ ID NO: 76689 - DNA, 20 bp, Artificial Sequence
  Description of Artificial Sequence: Synthetic oligonucleotide
  Target: ATXN1; (-) strand; PAM type: NRG; PAM sequence: TGG
cataccttggaaggcaatga

SEQ ID NO: 76690 - DNA, 20 bp, Artificial Sequence
  Description of Artificial Sequence: Synthetic oligonucleotide
  Target: ATXN1; (-) strand; PAM type: NRG; PAM sequence: AGG
ttcttggttcataccttgga

SEQ ID NO: 76691 - DNA, 20 bp, Artificial Sequence
  Description of Artificial Sequence: Synthetic oligonucleotide
  Target: ATXN1; (-) strand; PAM type: NRG; PAM sequence: AAG
tttcttggttcataccttgg

SEQ ID NO: 76692 - DNA, 20 bp, Artificial Sequence
  Description of Artificial Sequence: Synthetic oligonucleotide
  Target: ATXN1; (-) strand; PAM type: NRG; PAM sequence: TGG
acatttcttggttcatacct

SEQ ID NO: 76693 - DNA, 20 bp, Artificial Sequence
  Description of Artificial Sequence: Synthetic oligonucleotide
  Target: ATXN1; (-) strand; PAM type: NRG; PAM sequence: TGG
gagtgagtggtgacatttct

SEQ ID NO: 76694 - DNA, 20 bp, Artificial Sequence
  Description of Artificial Sequence: Synthetic oligonucleotide
  Target: ATXN1; (-) strand; PAM type: NRG; PAM sequence: TGG
ggcctgttcacctgagtgag

SEQ ID NO: 76695 - DNA, 20 bp, Artificial Sequence
  Description of Artificial Sequence: Synthetic oligonucleotide
  Target: ATXN1; (-) strand; PAM type: NRG; PAM sequence: GAG
tgtggcctgttcacctgagt

SEQ ID NO: 76696 - DNA, 20 bp, Artificial Sequence
  Description of Artificial Sequence: Synthetic oligonucleotide
  Target: ATXN1; (-) strand; PAM type: NRG; PAM sequence: GAG
cctctgtggcctgttcacct

SEQ ID NO: 76697 - DNA, 20 bp, Artificial Sequence
  Description of Artificial Sequence: Synthetic oligonucleotide
  Target: ATXN1; (-) strand; PAM type: NRG; PAM sequence: TGG
ccagcacttttagtcctctg

SEQ ID NO: 76698 - DNA, 20 bp, Artificial Sequence
  Description of Artificial Sequence: Synthetic oligonucleotide
  Target: ATXN1; (-) strand; PAM type: NRG; PAM sequence: TAG
tgctatagggccagcacttt

SEQ ID NO: 76699 - DNA, 20 bp, Artificial Sequence
  Description of Artificial Sequence: Synthetic oligonucleotide
  Target: ATXN1; (-) strand; PAM type: NRG; PAM sequence: CAG
gcatgaggctgctatagggc

SEQ ID NO: 76700 - DNA, 20 bp, Artificial Sequence
  Description of Artificial Sequence: Synthetic oligonucleotide
  Target: ATXN1; (-) strand; PAM type: NRG; PAM sequence: GGG
ttttgcatgaggctgctata

SEQ ID NO: 76701 - DNA, 20 bp, Artificial Sequence
  Description of Artificial Sequence: Synthetic oligonucleotide
  Target: ATXN1; (-) strand; PAM type: NRG; PAM sequence: AGG
tttttgcatgaggctgctat

SEQ ID NO: 76702 - DNA, 20 bp, Artificial Sequence
  Description of Artificial Sequence: Synthetic oligonucleotide
  Target: ATXN1; (-) strand; PAM type: NRG; PAM sequence: TAG
gtttttgcatgaggctgcta

SEQ ID NO: 76703 - DNA, 20 bp, Artificial Sequence
  Description of Artificial Sequence: Synthetic oligonucleotide
  Target: ATXN1; (-) strand; PAM type: NRG; PAM sequence: AGG
cacaaatctgtttttgcatg

SEQ ID NO: 76704 - DNA, 20 bp, Artificial Sequence
  Description of Artificial Sequence: Synthetic oligonucleotide
  Target: ATXN1; (-) strand; PAM type: NRG; PAM sequence: GAG
gcacaaatctgtttttgcat

SEQ ID NO: 76705 - DNA, 20 bp, Artificial Sequence
  Description of Artificial Sequence: Synthetic oligonucleotide
  Target: ATXN1; (-) strand; PAM type: NRG; PAM sequence: CAG
tcaaatttcaaaagtcttct

SEQ ID NO: 76706 - DNA, 20 bp, Artificial Sequence
  Description of Artificial Sequence: Synthetic oligonucleotide
  Target: ATXN1; (-) strand; PAM type: NRG; PAM sequence: AAG
agcggcctttcaaatttcaa

SEQ ID NO: 76707 - DNA, 20 bp, Artificial Sequence
  Description of Artificial Sequence: Synthetic oligonucleotide
  Target: ATXN1; (-) strand; PAM type: NRG; PAM sequence: CGG
agggtttatcttcttagtag

SEQ ID NO: 76708 - DNA, 20 bp, Artificial Sequence
  Description of Artificial Sequence: Synthetic oligonucleotide
  Target: ATXN1; (-) strand; PAM type: NRG; PAM sequence: TAG
tggagggtttatcttcttag

SEQ ID NO: 76709 - DNA, 20 bp, Artificial Sequence
  Description of Artificial Sequence: Synthetic oligonucleotide
  Target: ATXN1; (-) strand; PAM type: NRG; PAM sequence: TAG
ctttggagggtttatcttct

SEQ ID NO: 76710 - DNA, 20 bp, Artificial Sequence
  Description of Artificial Sequence: Synthetic oligonucleotide
  Target: ATXN1; (-) strand; PAM type: NRG; PAM sequence: GGG
gatagaaggaaatctttgga

SEQ ID NO: 76711 - DNA, 20 bp, Artificial Sequence
  Description of Artificial Sequence: Synthetic oligonucleotide
  Target: ATXN1; (-) strand; PAM type: NRG; PAM sequence: AGG
tgatagaaggaaatctttgg

SEQ ID NO: 76712 - DNA, 20 bp, Artificial Sequence
  Description of Artificial Sequence: Synthetic oligonucleotide
  Target: ATXN1; (-) strand; PAM type: NRG; PAM sequence: GAG
atgatagaaggaaatctttg

SEQ ID NO: 76713 - DNA, 20 bp, Artificial Sequence
  Description of Artificial Sequence: Synthetic oligonucleotide
  Target: ATXN1; (-) strand; PAM type: NRG; PAM sequence: TGG
caatgatagaaggaaatctt

SEQ ID NO: 76714 - DNA, 20 bp, Artificial Sequence
  Description of Artificial Sequence: Synthetic oligonucleotide
  Target: ATXN1; (-) strand; PAM type: NRG; PAM sequence: AGG
taatgaataacaatgataga

SEQ ID NO: 76715 - DNA, 20 bp, Artificial Sequence
  Description of Artificial Sequence: Synthetic oligonucleotide
  Target: ATXN1; (-) strand; PAM type: NRG; PAM sequence: AAG
ttaatgaataacaatgatag

SEQ ID NO: 76716 - DNA, 20 bp, Artificial Sequence
  Description of Artificial Sequence: Synthetic oligonucleotide
  Target: ATXN1; (-) strand; PAM type: NRG; PAM sequence: TAG
tttttaatgaataacaatga

SEQ ID NO: 76717 - DNA, 20 bp, Artificial Sequence
  Description of Artificial Sequence: Synthetic oligonucleotide
  Target: ATXN1; (-) strand; PAM type: NRG; PAM sequence: AAG
tgagccaccatgcccggcct

SEQ ID NO: 76718 - DNA, 20 bp, Artificial Sequence
  Description of Artificial Sequence: Synthetic oligonucleotide
  Target: ATXN1; (-) strand; PAM type: NRG; PAM sequence: CGG
caggtgtgagccaccatgcc

SEQ ID NO: 76719 - DNA, 20 bp, Artificial Sequence
  Description of Artificial Sequence: Synthetic oligonucleotide
  Target: ATXN1; (-) strand; PAM type: NRG; PAM sequence: GAG
aatgctgggattacaggtgt

SEQ ID NO: 76720 - DNA, 20 bp, Artificial Sequence
  Description of Artificial Sequence: Synthetic oligonucleotide
  Target: ATXN1; (-) strand; PAM type: NRG; PAM sequence: AGG
tcccaaaatgctgggattac

SEQ ID NO: 76721 - DNA, 20 bp, Artificial Sequence
  Description of Artificial Sequence: Synthetic oligonucleotide
  Target: ATXN1; (-) strand; PAM type: NRG; PAM sequence: CAG
ctcccaaaatgctgggatta

SEQ ID NO: 76722 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaaatgct

SEQ ID NO: 76723 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaaatgc

SEQ ID NO: 76724 - DNA, 20 bp, Artificial Sequence
  Description of Artificial Sequence: Synthetic oligonucleotide
  Target: ATXN1; (-) strand; PAM type: NRG; PAM sequence: CAG
acctcatgatccgctcgcct

SEQ ID NO: 76725 - DNA, 20 bp, Artificial Sequence
  Description of Artificial Sequence: Synthetic oligonucleotide
  Target: ATXN1; (-) strand; PAM type: NRG; PAM sequence: TGG
tttcagcatgttggccagga

SEQ ID NO: 76726 - DNA, 20 bp, Artificial Sequence
  Description of Artificial Sequence: Synthetic oligonucleotide
  Target: ATXN1; (-) strand; PAM type: NRG; PAM sequence: AGG
aaggtttcagcatgttggcc

SEQ ID NO: 76727 - DNA, 20 bp, Artificial Sequence
  Description of Artificial Sequence: Synthetic oligonucleotide
  Target: ATXN1; (-) strand; PAM type: NRG; PAM sequence: CAG
caaggtttcagcatgttggc

SEQ ID NO: 76728 - DNA, 20 bp, Artificial Sequence
  Description of Artificial Sequence: Synthetic oligonucleotide
  Target: ATXN1; (-) strand; PAM type: NRG; PAM sequence: TGG
gagacaaggtttcagcatgt

SEQ ID NO: 76729 - DNA, 20 bp, Artificial Sequence
  Description of Artificial Sequence: Synthetic oligonucleotide
  Target: ATXN1; (-) strand; PAM type: NRG; PAM sequence: CAG
ttttagtagagacaaggttt

SEQ ID NO: 76730 - DNA, 20 bp, Artificial Sequence
  Description of Artificial Sequence: Synthetic oligonucleotide
  Target: ATXN1; (-) strand; PAM type: NRG; PAM sequence: AGG
ttgtatttttagtagagaca

SEQ ID NO: 76731 - DNA, 20 bp, Artificial Sequence
  Description of Artificial Sequence: Synthetic oligonucleotide
  Target: ATXN1; (-) strand; PAM type: NRG; PAM sequence: AAG
tttgtatttttagtagagac

SEQ ID NO: 76732 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 76733 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 76734 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 76735 - DNA, 20 bp, Artificial Sequence
  Description of Artificial Sequence: Synthetic oligonucleotide
  Target: ATXN1; (-) strand; PAM type: NRG; PAM sequence: CAG
caggcacgtgccaccatacc

SEQ ID NO: 76736 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggattac

SEQ ID NO: 76737 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgggatta

SEQ ID NO: 76738 - DNA, 20 bp, Artificial Sequence
  Description of Artificial Sequence: Synthetic oligonucleotide
  Target: ATXN1; (-) strand; PAM type: NRG; PAM sequence: GGG
tctcaccctcctgagtagct

SEQ ID NO: 76739 - DNA, 20 bp, Artificial Sequence
  Description of Artificial Sequence: Synthetic oligonucleotide
  Target: ATXN1; (-) strand; PAM type: NRG; PAM sequence: TGG
gtctcaccctcctgagtagc

SEQ ID NO: 76740 - DNA, 20 bp, Artificial Sequence
  Description of Artificial Sequence: Synthetic oligonucleotide
  Target: ATXN1; (-) strand; PAM type: NRG; PAM sequence: TAG
tcctgtctcaccctcctgag

SEQ ID NO: 76741 - DNA, 20 bp, Artificial Sequence
  Description of Artificial Sequence: Synthetic oligonucleotide
  Target: ATXN1; (-) strand; PAM type: NRG; PAM sequence: GAG
ttctcctgtctcaccctcct

SEQ ID NO: 76742 - DNA, 20 bp, Artificial Sequence
  Description of Artificial Sequence: Synthetic oligonucleotide
  Target: ATXN1; (-) strand; PAM type: NRG; PAM sequence: AAG
aacctctgactccctggttc

SEQ ID NO: 76743 - DNA, 20 bp, Artificial Sequence
  Description of Artificial Sequence: Synthetic oligonucleotide
  Target: ATXN1; (-) strand; PAM type: NRG; PAM sequence: TGG
cactgcaacctctgactccc

SEQ ID NO: 76744 - DNA, 20 bp, Artificial Sequence
  Description of Artificial Sequence: Synthetic oligonucleotide
  Target: ATXN1; (-) strand; PAM type: NRG; PAM sequence: TGG
gtcaccaggctggagtgcag

SEQ ID NO: 76745 - DNA, 20 bp, Artificial Sequence
  Description of Artificial Sequence: Synthetic oligonucleotide
  Target: ATXN1; (-) strand; PAM type: NRG; PAM sequence: CAG
tctgtcaccaggctggagtg

SEQ ID NO: 76746 - DNA, 20 bp, Artificial Sequence
  Description of Artificial Sequence: Synthetic oligonucleotide
  Target: ATXN1; (-) strand; PAM type: NRG; PAM sequence: GAG
ttcactctgtcaccaggctg

SEQ ID NO: 76747 - DNA, 20 bp, Artificial Sequence
  Description of Artificial Sequence: Synthetic oligonucleotide
  Target: ATXN1; (-) strand; PAM type: NRG; PAM sequence: TGG
gtttcactctgtcaccaggc

SEQ ID NO: 76748 - DNA, 20 bp, Artificial Sequence
  Description of Artificial Sequence: Synthetic oligonucleotide
  Target: ATXN1; (-) strand; PAM type: NRG; PAM sequence: AGG
cggagtttcactctgtcacc

SEQ ID NO: 76749 - DNA, 20 bp, Artificial Sequence
  Description of Artificial Sequence: Synthetic oligonucleotide
  Target: ATXN1; (-) strand; PAM type: NRG; PAM sequence: CAG
acggagtttcactctgtcac

SEQ ID NO: 76750 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagacg

SEQ ID NO: 76751 - DNA, 20 bp, Artificial Sequence
  Description of Artificial Sequence: Synthetic oligonucleotide
  Target: ATXN1; (-) strand; PAM type: NRG; PAM sequence: CGG
ctttttttttttttttgaga

SEQ ID NO: 76752 - DNA, 20 bp, Artificial Sequence
  Description of Artificial Sequence: Synthetic oligonucleotide
  Target: ATXN1; (-) strand; PAM type: NRG; PAM sequence: GAG
taagcttttttttttttttt

SEQ ID NO: 76753 - DNA, 20 bp, Artificial Sequence
  Description of Artificial Sequence: Synthetic oligonucleotide
  Target: ATXN1; (-) strand; PAM type: NRG; PAM sequence: AAG
tgttcccattcattcaagtt

SEQ ID NO: 76754 - DNA, 20 bp, Artificial Sequence
  Description of Artificial Sequence: Synthetic oligonucleotide
  Target: ATXN1; (-) strand; PAM type: NRG; PAM sequence: AAG
cctcttgttcccattcattc

SEQ ID NO: 76755 - DNA, 20 bp, Artificial Sequence
  Description of Artificial Sequence: Synthetic oligonucleotide
  Target: ATXN1; (-) strand; PAM type: NRG; PAM sequence: TAG
aatgtcacctttaggtgtga

SEQ ID NO: 76756 - DNA, 20 bp, Artificial Sequence
  Description of Artificial Sequence: Synthetic oligonucleotide
  Target: ATXN1; (-) strand; PAM type: NRG; PAM sequence: AGG
ttctagataatgtcaccttt

SEQ ID NO: 76757 - DNA, 20 bp, Artificial Sequence
  Description of Artificial Sequence: Synthetic oligonucleotide
  Target: ATXN1; (-) strand; PAM type: NRG; PAM sequence: TAG
tttctagataatgtcacctt

SEQ ID NO: 76758 - DNA, 20 bp, Artificial Sequence
  Description of Artificial Sequence: Synthetic oligonucleotide
  Target: ATXN1; (-) strand; PAM type: NRG; PAM sequence: TAG
tcttgacatgttaatgtttc

SEQ ID NO: 76759 - DNA, 20 bp, Artificial Sequence
  Description of Artificial Sequence: Synthetic oligonucleotide
  Target: ATXN1; (-) strand; PAM type: NRG; PAM sequence: GGG
ggggaacagaaggaacagaa

SEQ ID NO: 76760 - DNA, 20 bp, Artificial Sequence
  Description of Artificial Sequence: Synthetic oligonucleotide
  Target: ATXN1; (-) strand; PAM type: NRG; PAM sequence: AGG
gggggaacagaaggaacaga

SEQ ID NO: 76761 - DNA, 20 bp, Artificial Sequence
  Description of Artificial Sequence: Synthetic oligonucleotide
  Target: ATXN1; (-) strand; PAM type: NRG; PAM sequence: AAG
tgggggaacagaaggaacag

SEQ ID NO: 76762 - DNA, 20 bp, Artificial Sequence
  Description of Artificial Sequence: Synthetic oligonucleotide
  Target: ATXN1; (-) strand; PAM type: NRG; PAM sequence: CAG
tcttgggggaacagaaggaa

SEQ ID NO: 76763 - DNA, 20 bp, Artificial Sequence
  Description of Artificial Sequence: Synthetic oligonucleotide
  Target: ATXN1; (-) strand; PAM type: NRG; PAM sequence: AGG
aggcctcttgggggaacaga

SEQ ID NO: 76764 - DNA, 20 bp, Artificial Sequence
  Description of Artificial Sequence: Synthetic oligonucleotide
  Target: ATXN1; (-) strand; PAM type: NRG; PAM sequence: AAG
taggcctcttgggggaacag

SEQ ID NO: 76765 - DNA, 20 bp, Artificial Sequence
  Description of Artificial Sequence: Synthetic oligonucleotide
  Target: ATXN1; (-) strand; PAM type: NRG; PAM sequence: CAG
aaataggcctcttgggggaa

SEQ ID NO: 76766 - DNA, 20 bp, Artificial Sequence
  Description of Artificial Sequence: Synthetic oligonucleotide
  Target: ATXN1; (-) strand; PAM type: NRG; PAM sequence: GGG
gctccaaataggcctcttgg

SEQ ID NO: 76767 - DNA, 20 bp, Artificial Sequence
  Description of Artificial Sequence: Synthetic oligonucleotide
  Target: ATXN1; (-) strand; PAM type: NRG; PAM sequence: GGG
tgctccaaataggcctcttg

SEQ ID NO: 76768 - DNA, 20 bp, Artificial Sequence
  Description of Artificial Sequence: Synthetic oligonucleotide
  Target: ATXN1; (-) strand; PAM type: NRG; PAM sequence: GGG
gtgctccaaataggcctctt

SEQ ID NO: 76769 - DNA, 20 bp, Artificial Sequence
  Description of Artificial Sequence: Synthetic oligonucleotide
  Target: ATXN1; (-) strand; PAM type: NRG; PAM sequence: TGG
ggtgctccaaataggcctct

SEQ ID NO: 76770 - DNA, 20 bp, Artificial Sequence
  Description of Artificial Sequence: Synthetic oligonucleotide
  Target: ATXN1; (-) strand; PAM type: NRG; PAM sequence: AGG
attttgctggtgctccaaat

SEQ ID NO: 76771 - DNA, 20 bp, Artificial Sequence
  Description of Artificial Sequence: Synthetic oligonucleotide
  Target: ATXN1; (-) strand; PAM type: NRG; PAM sequence: TAG
cattttgctggtgctccaaa

SEQ ID NO: 76772 - DNA, 20 bp, Artificial Sequence
  Description of Artificial Sequence: Synthetic oligonucleotide
  Target: ATXN1; (-) strand; PAM type: NRG; PAM sequence: TGG
atcctccaaatgcattttgc

SEQ ID NO: 76773 - DNA, 20 bp, Artificial Sequence
  Description of Artificial Sequence: Synthetic oligonucleotide
  Target: ATXN1; (-) strand; PAM type: NRG; PAM sequence: TAG
gcagtgaacactgttagatt

SEQ ID NO: 76774 - DNA, 20 bp, Artificial Sequence
  Description of Artificial Sequence: Synthetic oligonucleotide
  Target: ATXN1; (-) strand; PAM type: NRG; PAM sequence: TAG
actacagcagtgaacactgt

SEQ ID NO: 76775 - DNA, 20 bp, Artificial Sequence
  Description of Artificial Sequence: Synthetic oligonucleotide
  Target: ATXN1; (-) strand; PAM type: NRG; PAM sequence: CAG
acactctcataacactacag

SEQ ID NO: 76776 - DNA, 20 bp, Artificial Sequence
  Description of Artificial Sequence: Synthetic oligonucleotide
  Target: ATXN1; (-) strand; PAM type: NRG; PAM sequence: CAG
gaaacactctcataacacta

SEQ ID NO: 76777 - DNA, 20 bp, Artificial Sequence
  Description of Artificial Sequence: Synthetic oligonucleotide
  Target: ATXN1; (-) strand; PAM type: NRG; PAM sequence: AAG
tcccttttgaaatttcctga

SEQ ID NO: 76778 - DNA, 20 bp, Artificial Sequence
  Description of Artificial Sequence: Synthetic oligonucleotide
  Target: ATXN1; (-) strand; PAM type: NRG; PAM sequence: AGG
cacatgtgagatttccatgt

SEQ ID NO: 76779 - DNA, 20 bp, Artificial Sequence
  Description of Artificial Sequence: Synthetic oligonucleotide
  Target: ATXN1; (-) strand; PAM type: NRG; PAM sequence: TAG
ccacatgtgagatttccatg

SEQ ID NO: 76780 - DNA, 20 bp, Artificial Sequence
  Description of Artificial Sequence: Synthetic oligonucleotide
  Target: ATXN1; (-) strand; PAM type: NRG; PAM sequence: GAG
agacgcaatgaaccacatgt

SEQ ID NO: 76781 - DNA, 20 bp, Artificial Sequence
  Description of Artificial Sequence: Synthetic oligonucleotide
  Target: ATXN1; (-) strand; PAM type: NRG; PAM sequence: AAG
atggcagctgtgtaagaaaa

SEQ ID NO: 76782 - DNA, 20 bp, Artificial Sequence
  Description of Artificial Sequence: Synthetic oligonucleotide
  Target: ATXN1; (-) strand; PAM type: NRG; PAM sequence: AAG
ttatataatggcagctgtgt

SEQ ID NO: 76783 - DNA, 20 bp, Artificial Sequence
  Description of Artificial Sequence: Synthetic oligonucleotide
  Target: ATXN1; (-) strand; PAM type: NRG; PAM sequence: CAG
ggccaagaattatataatgg

SEQ ID NO: 76784 - DNA, 20 bp, Artificial Sequence
  Description of Artificial Sequence: Synthetic oligonucleotide
  Target: ATXN1; (-) strand; PAM type: NRG; PAM sequence: TGG
aatggccaagaattatataa

SEQ ID NO: 76785 - DNA, 20 bp, Artificial Sequence
  Description of Artificial Sequence: Synthetic oligonucleotide
  Target: ATXN1; (-) strand; PAM type: NRG; PAM sequence: AAG
ttaaataaaaaacaatggcc

SEQ ID NO: 76786 - DNA, 20 bp, Artificial Sequence
  Description of Artificial Sequence: Synthetic oligonucleotide
  Target: ATXN1; (-) strand; PAM type: NRG; PAM sequence: TGG
aattattaaataaaaaacaa

SEQ ID NO: 76787 - DNA, 20 bp, Artificial Sequence
  Description of Artificial Sequence: Synthetic oligonucleotide
  Target: ATXN1; (-) strand; PAM type: NRG; PAM sequence: AAG
catatacaatggatgacccc

SEQ ID NO: 76788 - DNA, 20 bp, Artificial Sequence
  Description of Artificial Sequence: Synthetic oligonucleotide
  Target: ATXN1; (-) strand; PAM type: NRG; PAM sequence: TGG
taccacagatacatatacaa

SEQ ID NO: 76789 - DNA, 20 bp, Artificial Sequence
  Description of Artificial Sequence: Synthetic oligonucleotide
  Target: ATXN1; (-) strand; PAM type: NRG; PAM sequence: CAG
tggaatttttaaacctacca

SEQ ID NO: 76790 - DNA, 20 bp, Artificial Sequence
  Description of Artificial Sequence: Synthetic oligonucleotide
  Target: ATXN1; (-) strand; PAM type: NRG; PAM sequence: TGG
ggggctagggaaaggtcaac

SEQ ID NO: 76791 - DNA, 20 bp, Artificial Sequence
  Description of Artificial Sequence: Synthetic oligonucleotide
  Target: ATXN1; (-) strand; PAM type: NRG; PAM sequence: AGG
gtatactgggggctagggaa

SEQ ID NO: 76792 - DNA, 20 bp, Artificial Sequence
  Description of Artificial Sequence: Synthetic oligonucleotide
  Target: ATXN1; (-) strand; PAM type: NRG; PAM sequence: AAG
agtatactgggggctaggga

SEQ ID NO: 76793 - DNA, 20 bp, Artificial Sequence
  Description of Artificial Sequence: Synthetic oligonucleotide
  Target: ATXN1; (-) strand; PAM type: NRG; PAM sequence: GGG
caaaagtatactgggggcta

SEQ ID NO: 76794 - DNA, 20 bp, Artificial Sequence
  Description of Artificial Sequence: Synthetic oligonucleotide
  Target: ATXN1; (-) strand; PAM type: NRG; PAM sequence: AGG
ccaaaagtatactgggggct

SEQ ID NO: 76795 - DNA, 20 bp, Artificial Sequence
  Description of Artificial Sequence: Synthetic oligonucleotide
  Target: ATXN1; (-) strand; PAM type: NRG; PAM sequence: TAG
cccaaaagtatactgggggc

SEQ ID NO: 76796 - DNA, 20 bp, Artificial Sequence
  Description of Artificial Sequence: Synthetic oligonucleotide
  Target: ATXN1; (-) strand; PAM type: NRG; PAM sequence: GGG
gtagcccaaaagtatactgg

SEQ ID NO: 76797 - DNA, 20 bp, Artificial Sequence
  Description of Artificial Sequence: Synthetic oligonucleotide
  Target: ATXN1; (-) strand; PAM type: NRG; PAM sequence: GGG
agtagcccaaaagtatactg

SEQ ID NO: 76798 - DNA, 20 bp, Artificial Sequence
  Description of Artificial Sequence: Synthetic oligonucleotide
  Target: ATXN1; (-) strand; PAM type: NRG; PAM sequence: GGG
aagtagcccaaaagtatact

SEQ ID NO: 76799 - DNA, 20 bp, Artificial Sequence
  Description of Artificial Sequence: Synthetic oligonucleotide
  Target: ATXN1; (-) strand; PAM type: NRG; PAM sequence: TGG
gaagtagcccaaaagtatac

SEQ ID NO: 76800 - DNA, 20 bp, Artificial Sequence
  Description of Artificial Sequence: Synthetic oligonucleotide
  Target: ATXN1; (-) strand; PAM type: NRG; PAM sequence: AAG
ttagggaggaagtagcccaa

SEQ ID NO: 76801 - DNA, 20 bp, Artificial Sequence
  Description of Artificial Sequence: Synthetic oligonucleotide
  Target: ATXN1; (-) strand; PAM type: NRG; PAM sequence: TAG
agctcatcttagggaggaag

SEQ ID NO: 76802 - DNA, 20 bp, Artificial Sequence
  Description of Artificial Sequence: Synthetic oligonucleotide
  Target: ATXN1; (-) strand; PAM type: NRG; PAM sequence: AAG
catagctcatcttagggagg

SEQ ID NO: 76803 - DNA, 20 bp, Artificial Sequence
  Description of Artificial Sequence: Synthetic oligonucleotide
  Target: ATXN1; (-) strand; PAM type: NRG; PAM sequence: AGG
gcacatagctcatcttaggg

SEQ ID NO: 76804 - DNA, 20 bp, Artificial Sequence
  Description of Artificial Sequence: Synthetic oligonucleotide
  Target: ATXN1; (-) strand; PAM type: NRG; PAM sequence: GAG
tgcacatagctcatcttagg

SEQ ID NO: 76805 - DNA, 20 bp, Artificial Sequence
  Description of Artificial Sequence: Synthetic oligonucleotide
  Target: ATXN1; (-) strand; PAM type: NRG; PAM sequence: GGG
tgtgcacatagctcatctta

SEQ ID NO: 76806 - DNA, 20 bp, Artificial Sequence
  Description of Artificial Sequence: Synthetic oligonucleotide
  Target: ATXN1; (-) strand; PAM type: NRG; PAM sequence: AGG
gtgtgcacatagctcatctt

SEQ ID NO: 76807 - DNA, 20 bp, Artificial Sequence
  Description of Artificial Sequence: Synthetic oligonucleotide
  Target: ATXN1; (-) strand; PAM type: NRG; PAM sequence: TAG
tgtgtgcacatagctcatct

SEQ ID NO: 76808 - DNA, 20 bp, Artificial Sequence
  Description of Artificial Sequence: Synthetic oligonucleotide
  Target: ATXN1; (-) strand; PAM type: NRG; PAM sequence: TAG
ttgtgccacatgtgtgcaca

SEQ ID NO: 76809 - DNA, 20 bp, Artificial Sequence
  Description of Artificial Sequence: Synthetic oligonucleotide
  Target: ATXN1; (-) strand; PAM type: NRG; PAM sequence: TAG
ggtttgtggttttgcttaga

SEQ ID NO: 76810 - DNA, 20 bp, Artificial Sequence
  Description of Artificial Sequence: Synthetic oligonucleotide
  Target: ATXN1; (-) strand; PAM type: NRG; PAM sequence: TAG
tattggtttgtggttttgct

SEQ ID NO: 76811 - DNA, 20 bp, Artificial Sequence
  Description of Artificial Sequence: Synthetic oligonucleotide
  Target: ATXN1; (-) strand; PAM type: NRG; PAM sequence: TGG
atgatgcttttattggtttg

SEQ ID NO: 76812 - DNA, 20 bp, Artificial Sequence
  Description of Artificial Sequence: Synthetic oligonucleotide
  Target: ATXN1; (-) strand; PAM type: NRG; PAM sequence: TGG
gcaccggatgatgcttttat

SEQ ID NO: 76813 - DNA, 20 bp, Artificial Sequence
  Description of Artificial Sequence: Synthetic oligonucleotide
  Target: ATXN1; (-) strand; PAM type: NRG; PAM sequence: CGG
cctttggctttgagaagcac

SEQ ID NO: 76814 - DNA, 20 bp, Artificial Sequence
  Description of Artificial Sequence: Synthetic oligonucleotide
  Target: ATXN1; (-) strand; PAM type: NRG; PAM sequence: AAG
tcatttcctttggctttgag

SEQ ID NO: 76815 - DNA, 20 bp, Artificial Sequence
  Description of Artificial Sequence: Synthetic oligonucleotide
  Target: ATXN1; (-) strand; PAM type: NRG; PAM sequence: GAG
aaatcatttcctttggcttt

SEQ ID NO: 76816 - DNA, 20 bp, Artificial Sequence
  Description of Artificial Sequence: Synthetic oligonucleotide
  Target: ATXN1; (-) strand; PAM type: NRG; PAM sequence: TGG
tgctccaaaatcatttcctt

SEQ ID NO: 76817 - DNA, 20 bp, Artificial Sequence
  Description of Artificial Sequence: Synthetic oligonucleotide
  Target: ATXN1; (-) strand; PAM type: NRG; PAM sequence: CAG
ctgtattaatggaatgtaat

SEQ ID NO: 76818 - DNA, 20 bp, Artificial Sequence
  Description of Artificial Sequence: Synthetic oligonucleotide
  Target: ATXN1; (-) strand; PAM type: NRG; PAM sequence: TGG
cttttaattatctgtattaa

SEQ ID NO: 76819 - DNA, 20 bp, Artificial Sequence
  Description of Artificial Sequence: Synthetic oligonucleotide
  Target: ATXN1; (-) strand; PAM type: NRG; PAM sequence: CAG
tgctatttaacattattata

SEQ ID NO: 76820 - DNA, 20 bp, Artificial Sequence
  Description of Artificial Sequence: Synthetic oligonucleotide
  Target: ATXN1; (-) strand; PAM type: NRG; PAM sequence: AAG
cacggagaaattttcaaaaa

SEQ ID NO: 76821 - DNA, 20 bp, Artificial Sequence
  Description of Artificial Sequence: Synthetic oligonucleotide
  Target: ATXN1; (-) strand; PAM type: NRG; PAM sequence: GAG
tttgcatagctaatatcacg

SEQ ID NO: 76822 - DNA, 20 bp, Artificial Sequence
  Description of Artificial Sequence: Synthetic oligonucleotide
  Target: ATXN1; (-) strand; PAM type: NRG; PAM sequence: CGG
tttttgcatagctaatatca

SEQ ID NO: 76823 - DNA, 20 bp, Artificial Sequence
  Description of Artificial Sequence: Synthetic oligonucleotide
  Target: ATXN1; (-) strand; PAM type: NRG; PAM sequence: TAG
attcagtcagtgtttttgca

SEQ ID NO: 76824 - DNA, 20 bp, Artificial Sequence
  Description of Artificial Sequence: Synthetic oligonucleotide
  Target: ATXN1; (-) strand; PAM type: NRG; PAM sequence: CAG
attagcattgaacattcagt

SEQ ID NO: 76825 - DNA, 20 bp, Artificial Sequence
  Description of Artificial Sequence: Synthetic oligonucleotide
  Target: ATXN1; (-) strand; PAM type: NRG; PAM sequence: CAG
tttgattagcattgaacatt

SEQ ID NO: 76826 - DNA, 20 bp, Artificial Sequence
  Description of Artificial Sequence: Synthetic oligonucleotide
  Target: ATXN1; (-) strand; PAM type: NRG; PAM sequence: TAG
taagaggagatgaatttgat

SEQ ID NO: 76827 - DNA, 20 bp, Artificial Sequence
  Description of Artificial Sequence: Synthetic oligonucleotide
  Target: ATXN1; (-) strand; PAM type: NRG; PAM sequence: GAG
ttatacgctgctcttaagag

SEQ ID NO: 76828 - DNA, 20 bp, Artificial Sequence
  Description of Artificial Sequence: Synthetic oligonucleotide
  Target: ATXN1; (-) strand; PAM type: NRG; PAM sequence: AGG
tattatacgctgctcttaag

SEQ ID NO: 76829 - DNA, 20 bp, Artificial Sequence
  Description of Artificial Sequence: Synthetic oligonucleotide
  Target: ATXN1; (-) strand; PAM type: NRG; PAM sequence: GAG
ttattatacgctgctcttaa

SEQ ID NO: 76830 - DNA, 20 bp, Artificial Sequence
  Description of Artificial Sequence: Synthetic oligonucleotide
  Target: ATXN1; (-) strand; PAM type: NRG; PAM sequence: AAG
atttattatacgctgctctt

SEQ ID NO: 76831 - DNA, 20 bp, Artificial Sequence
  Description of Artificial Sequence: Synthetic oligonucleotide
  Target: ATXN1; (-) strand; PAM type: NRG; PAM sequence: AGG
ctgttcaaagcattcctttt

SEQ ID NO: 76832 - DNA, 20 bp, Artificial Sequence
  Description of Artificial Sequence: Synthetic oligonucleotide
  Target: ATXN1; (-) strand; PAM type: NRG; PAM sequence: TAG
tctgttcaaagcattccttt

SEQ ID NO: 76833 - DNA, 20 bp, Artificial Sequence
  Description of Artificial Sequence: Synthetic oligonucleotide
  Target: ATXN1; (-) strand; PAM type: NRG; PAM sequence: AAG
atagtgaagcattctgttca

SEQ ID NO: 76834 - DNA, 20 bp, Artificial Sequence
  Description of Artificial Sequence: Synthetic oligonucleotide
  Target: ATXN1; (-) strand; PAM type: NRG; PAM sequence: AAG
agaataatcagacaatagtg

SEQ ID NO: 76835 - DNA, 20 bp, Artificial Sequence
  Description of Artificial Sequence: Synthetic oligonucleotide
  Target: ATXN1; (-) strand; PAM type: NRG; PAM sequence: TAG
aatttagaataatcagacaa

SEQ ID NO: 76836 - DNA, 20 bp, Artificial Sequence
  Description of Artificial Sequence: Synthetic oligonucleotide
  Target: ATXN1; (-) strand; PAM type: NRG; PAM sequence: CAG
agttttaaatttagaataat

SEQ ID NO: 76837 - DNA, 20 bp, Artificial Sequence
  Description of Artificial Sequence: Synthetic oligonucleotide
  Target: ATXN1; (-) strand; PAM type: NRG; PAM sequence: TAG
ctttgttggagttttaaatt

SEQ ID NO: 76838 - DNA, 20 bp, Artificial Sequence
  Description of Artificial Sequence: Synthetic oligonucleotide
  Target: ATXN1; (-) strand; PAM type: NRG; PAM sequence: GAG
aataatcctttcctttgttg

SEQ ID NO: 76839 - DNA, 20 bp, Artificial Sequence
  Description of Artificial Sequence: Synthetic oligonucleotide
  Target: ATXN1; (-) strand; PAM type: NRG; PAM sequence: TGG
agaataatcctttcctttgt

SEQ ID NO: 76840 - DNA, 20 bp, Artificial Sequence
  Description of Artificial Sequence: Synthetic oligonucleotide
  Target: ATXN1; (-) strand; PAM type: NRG; PAM sequence: AAG
tcacgaatcttgaaccttag

SEQ ID NO: 76841 - DNA, 20 bp, Artificial Sequence
  Description of Artificial Sequence: Synthetic oligonucleotide
  Target: ATXN1; (-) strand; PAM type: NRG; PAM sequence: TAG
tcctcacgaatcttgaacct

SEQ ID NO: 76842 - DNA, 20 bp, Artificial Sequence
  Description of Artificial Sequence: Synthetic oligonucleotide
  Target: ATXN1; (-) strand; PAM type: NRG; PAM sequence: AGG
tttttaatttgctgtcctta

SEQ ID NO: 76843 - DNA, 20 bp, Artificial Sequence
  Description of Artificial Sequence: Synthetic oligonucleotide
  Target: ATXN1; (-) strand; PAM type: NRG; PAM sequence: AAG
ttttttaatttgctgtcctt

SEQ ID NO: 76844 - DNA, 20 bp, Artificial Sequence
  Description of Artificial Sequence: Synthetic oligonucleotide
  Target: ATXN1; (-) strand; PAM type: NRG; PAM sequence: TAG
aaatagtggcagcttgtaga

SEQ ID NO: 76845 - DNA, 20 bp, Artificial Sequence
  Description of Artificial Sequence: Synthetic oligonucleotide
  Target: ATXN1; (-) strand; PAM type: NRG; PAM sequence: TAG
cataaaatagtggcagcttg

SEQ ID NO: 76846 - DNA, 20 bp, Artificial Sequence
  Description of Artificial Sequence: Synthetic oligonucleotide
  Target: ATXN1; (-) strand; PAM type: NRG; PAM sequence: CAG
atacagacataaaatagtgg

SEQ ID NO: 76847 - DNA, 20 bp, Artificial Sequence
  Description of Artificial Sequence: Synthetic oligonucleotide
  Target: ATXN1; (-) strand; PAM type: NRG; PAM sequence: TGG
actatacagacataaaatag

SEQ ID NO: 76848 - DNA, 20 bp, Artificial Sequence
  Description of Artificial Sequence: Synthetic oligonucleotide
  Target: ATXN1; (-) strand; PAM type: NRG; PAM sequence: TAG
aacactatacagacataaaa

SEQ ID NO: 76849 - DNA, 20 bp, Artificial Sequence
  Description of Artificial Sequence: Synthetic oligonucleotide
  Target: ATXN1; (-) strand; PAM type: NRG; PAM sequence: CAG
tttgattttaaaacactata

SEQ ID NO: 76850 - DNA, 20 bp, Artificial Sequence
  Description of Artificial Sequence: Synthetic oligonucleotide
  Target: ATXN1; (-) strand; PAM type: NRG; PAM sequence: TAG
aacatttgttgttgaatggg

SEQ ID NO: 76851 - DNA, 20 bp, Artificial Sequence
  Description of Artificial Sequence: Synthetic oligonucleotide
  Target: ATXN1; (-) strand; PAM type: NRG; PAM sequence: GGG
acaaacatttgttgttgaat

SEQ ID NO: 76852 - DNA, 20 bp, Artificial Sequence
  Description of Artificial Sequence: Synthetic oligonucleotide
  Target: ATXN1; (-) strand; PAM type: NRG; PAM sequence: TGG
aacaaacatttgttgttgaa

SEQ ID NO: 76853 - DNA, 20 bp, Artificial Sequence
  Description of Artificial Sequence: Synthetic oligonucleotide
  Target: ATXN1; (-) strand; PAM type: NRG; PAM sequence: AGG
taaacttgtaaagtattttg

SEQ ID NO: 76854 - DNA, 20 bp, Artificial Sequence
  Description of Artificial Sequence: Synthetic oligonucleotide
  Target: ATXN1; (-) strand; PAM type: NRG; PAM sequence: GAG
ttaaacttgtaaagtatttt

SEQ ID NO: 76855 - DNA, 20 bp, Artificial Sequence
  Description of Artificial Sequence: Synthetic oligonucleotide
  Target: ATXN1; (-) strand; PAM type: NRG; PAM sequence: AAG
tataggtgattaaacttgta

SEQ ID NO: 76856 - DNA, 20 bp, Artificial Sequence
  Description of Artificial Sequence: Synthetic oligonucleotide
  Target: ATXN1; (-) strand; PAM type: NRG; PAM sequence: AGG
ctgcctaattcataacttat

SEQ ID NO: 76857 - DNA, 20 bp, Artificial Sequence
  Description of Artificial Sequence: Synthetic oligonucleotide
  Target: ATXN1; (-) strand; PAM type: NRG; PAM sequence: TAG
gctgcctaattcataactta

SEQ ID NO: 76858 - DNA, 20 bp, Artificial Sequence
  Description of Artificial Sequence: Synthetic oligonucleotide
  Target: ATXN1; (-) strand; PAM type: NRG; PAM sequence: AAG
caatcatttgggaatgattg

SEQ ID NO: 76859 - DNA, 20 bp, Artificial Sequence
  Description of Artificial Sequence: Synthetic oligonucleotide
  Target: ATXN1; (-) strand; PAM type: NRG; PAM sequence: GGG
ggtaaatgattcaatcattt

SEQ ID NO: 76860 - DNA, 20 bp, Artificial Sequence
  Description of Artificial Sequence: Synthetic oligonucleotide
  Target: ATXN1; (-) strand; PAM type: NRG; PAM sequence: TGG
aggtaaatgattcaatcatt

SEQ ID NO: 76861 - DNA, 20 bp, Artificial Sequence
  Description of Artificial Sequence: Synthetic oligonucleotide
  Target: ATXN1; (-) strand; PAM type: NRG; PAM sequence: AGG
acatataccttaccccagcg

SEQ ID NO: 76862 - DNA, 20 bp, Artificial Sequence
  Description of Artificial Sequence: Synthetic oligonucleotide
  Target: ATXN1; (-) strand; PAM type: NRG; PAM sequence: GAG
gacatataccttaccccagc

SEQ ID NO: 76863 - DNA, 20 bp, Artificial Sequence
  Description of Artificial Sequence: Synthetic oligonucleotide
  Target: ATXN1; (-) strand; PAM type: NRG; PAM sequence: CAG
gccagacatataccttaccc

SEQ ID NO: 76864 - DNA, 20 bp, Artificial Sequence
  Description of Artificial Sequence: Synthetic oligonucleotide
  Target: ATXN1; (-) strand; PAM type: NRG; PAM sequence: CAG
tagttctggctttggcttgc

SEQ ID NO: 76865 - DNA, 20 bp, Artificial Sequence
  Description of Artificial Sequence: Synthetic oligonucleotide
  Target: ATXN1; (-) strand; PAM type: NRG; PAM sequence: TGG
tgagtttctagttctggctt

SEQ ID NO: 76866 - DNA, 20 bp, Artificial Sequence
  Description of Artificial Sequence: Synthetic oligonucleotide
  Target: ATXN1; (-) strand; PAM type: NRG; PAM sequence: TGG
attacttgagtttctagttc

SEQ ID NO: 76867 - DNA, 20 bp, Artificial Sequence
  Description of Artificial Sequence: Synthetic oligonucleotide
  Target: ATXN1; (-) strand; PAM type: NRG; PAM sequence: TAG
aaaggaattacttgagtttc

SEQ ID NO: 76868 - DNA, 20 bp, Artificial Sequence
  Description of Artificial Sequence: Synthetic oligonucleotide
  Target: ATXN1; (-) strand; PAM type: NRG; PAM sequence: GAG
aagaatcaaaggaattactt

SEQ ID NO: 76869 - DNA, 20 bp, Artificial Sequence
  Description of Artificial Sequence: Synthetic oligonucleotide
  Target: ATXN1; (-) strand; PAM type: NRG; PAM sequence: AGG
cgtcattttctaagaatcaa

SEQ ID NO: 76870 - DNA, 20 bp, Artificial Sequence
  Description of Artificial Sequence: Synthetic oligonucleotide
  Target: ATXN1; (-) strand; PAM type: NRG; PAM sequence: AAG
gcgtcattttctaagaatca

SEQ ID NO: 76871 - DNA, 20 bp, Artificial Sequence
  Description of Artificial Sequence: Synthetic oligonucleotide
  Target: ATXN1; (-) strand; PAM type: NRG; PAM sequence: AAG
taacaactgcgtcattttct

SEQ ID NO: 76872 - DNA, 20 bp, Artificial Sequence
  Description of Artificial Sequence: Synthetic oligonucleotide
  Target: ATXN1; (-) strand; PAM type: NRG; PAM sequence: CAG
agacaactgcagcaggcaac

SEQ ID NO: 76873 - DNA, 20 bp, Artificial Sequence
  Description of Artificial Sequence: Synthetic oligonucleotide
  Target: ATXN1; (-) strand; PAM type: NRG; PAM sequence: AGG
cacaggaagacaactgcagc

SEQ ID NO: 76874 - DNA, 20 bp, Artificial Sequence
  Description of Artificial Sequence: Synthetic oligonucleotide
  Target: ATXN1; (-) strand; PAM type: NRG; PAM sequence: CAG
acacaggaagacaactgcag

SEQ ID NO: 76875 - DNA, 20 bp, Artificial Sequence
  Description of Artificial Sequence: Synthetic oligonucleotide
  Target: ATXN1; (-) strand; PAM type: NRG; PAM sequence: CAG
agtacacaggaagacaactg

SEQ ID NO: 76876 - DNA, 20 bp, Artificial Sequence
  Description of Artificial Sequence: Synthetic oligonucleotide
  Target: ATXN1; (-) strand; PAM type: NRG; PAM sequence: AAG
ttgtattgagagtacacagg

SEQ ID NO: 76877 - DNA, 20 bp, Artificial Sequence
  Description of Artificial Sequence: Synthetic oligonucleotide
  Target: ATXN1; (-) strand; PAM type: NRG; PAM sequence: AGG
aaattgtattgagagtacac

SEQ ID NO: 76878 - DNA, 20 bp, Artificial Sequence
  Description of Artificial Sequence: Synthetic oligonucleotide
  Target: ATXN1; (-) strand; PAM type: NRG; PAM sequence: CAG
caaattgtattgagagtaca

SEQ ID NO: 76879 - DNA, 20 bp, Artificial Sequence
  Description of Artificial Sequence: Synthetic oligonucleotide
  Target: ATXN1; (-) strand; PAM type: NRG; PAM sequence: GAG
tgccttccaaattgtattga

SEQ ID NO: 76880 - DNA, 20 bp, Artificial Sequence
  Description of Artificial Sequence: Synthetic oligonucleotide
  Target: ATXN1; (-) strand; PAM type: NRG; PAM sequence: GAG
catgccttccaaattgtatt

SEQ ID NO: 76881 - DNA, 20 bp, Artificial Sequence
  Description of Artificial Sequence: Synthetic oligonucleotide
  Target: ATXN1; (-) strand; PAM type: NRG; PAM sequence: TAG
tgttattacctcccctagcc

SEQ ID NO: 76882 - DNA, 20 bp, Artificial Sequence
  Description of Artificial Sequence: Synthetic oligonucleotide
  Target: ATXN1; (-) strand; PAM type: NRG; PAM sequence: TAG
tcctttgttattacctcccc

SEQ ID NO: 76883 - DNA, 20 bp, Artificial Sequence
  Description of Artificial Sequence: Synthetic oligonucleotide
  Target: ATXN1; (-) strand; PAM type: NRG; PAM sequence: AAG
acccgtataatttcaggagc

SEQ ID NO: 76884 - DNA, 20 bp, Artificial Sequence
  Description of Artificial Sequence: Synthetic oligonucleotide
  Target: ATXN1; (-) strand; PAM type: NRG; PAM sequence: GAG
gactacccgtataatttcag

SEQ ID NO: 76885 - DNA, 20 bp, Artificial Sequence
  Description of Artificial Sequence: Synthetic oligonucleotide
  Target: ATXN1; (-) strand; PAM type: NRG; PAM sequence: AGG
ttgactacccgtataatttc

SEQ ID NO: 76886 - DNA, 20 bp, Artificial Sequence
  Description of Artificial Sequence: Synthetic oligonucleotide
  Target: ATXN1; (-) strand; PAM type: NRG; PAM sequence: CAG
tttgactacccgtataattt

SEQ ID NO: 76887 - DNA, 20 bp, Artificial Sequence
  Description of Artificial Sequence: Synthetic oligonucleotide
  Target: ATXN1; (-) strand; PAM type: NRG; PAM sequence: GGG
tagcttagtaggtgatggtg

SEQ ID NO: 76888 - DNA, 20 bp, Artificial Sequence
  Description of Artificial Sequence: Synthetic oligonucleotide
  Target: ATXN1; (-) strand; PAM type: NRG; PAM sequence: GGG
atagcttagtaggtgatggt

SEQ ID NO: 76889 - DNA, 20 bp, Artificial Sequence
  Description of Artificial Sequence: Synthetic oligonucleotide
  Target: ATXN1; (-) strand; PAM type: NRG; PAM sequence: TGG
catagcttagtaggtgatgg

SEQ ID NO: 76890 - DNA, 20 bp, Artificial Sequence
  Description of Artificial Sequence: Synthetic oligonucleotide
  Target: ATXN1; (-) strand; PAM type: NRG; PAM sequence: TGG
tcacatagcttagtaggtga

SEQ ID NO: 76891 - DNA, 20 bp, Artificial Sequence
  Description of Artificial Sequence: Synthetic oligonucleotide
  Target: ATXN1; (-) strand; PAM type: NRG; PAM sequence: AGG
tacccatcacatagcttagt

SEQ ID NO: 76892 - DNA, 20 bp, Artificial Sequence
  Description of Artificial Sequence: Synthetic oligonucleotide
  Target: ATXN1; (-) strand; PAM type: NRG; PAM sequence: TAG
gtacccatcacatagcttag

SEQ ID NO: 76893 - DNA, 20 bp, Artificial Sequence
  Description of Artificial Sequence: Synthetic oligonucleotide
  Target: ATXN1; (-) strand; PAM type: NRG; PAM sequence: TAG
taggtacccatcacatagct

SEQ ID NO: 76894 - DNA, 20 bp, Artificial Sequence
  Description of Artificial Sequence: Synthetic oligonucleotide
  Target: ATXN1; (-) strand; PAM type: NRG; PAM sequence: TAG
ccagctaggtacccatcaca

SEQ ID NO: 76895 - DNA, 20 bp, Artificial Sequence
  Description of Artificial Sequence: Synthetic oligonucleotide
  Target: ATXN1; (-) strand; PAM type: NRG; PAM sequence: AGG
ggaaacaccttttaccagct

SEQ ID NO: 76896 - DNA, 20 bp, Artificial Sequence
  Description of Artificial Sequence: Synthetic oligonucleotide
  Target: ATXN1; (-) strand; PAM type: NRG; PAM sequence: TAG
tggaaacaccttttaccagc

SEQ ID NO: 76897 - DNA, 20 bp, Artificial Sequence
  Description of Artificial Sequence: Synthetic oligonucleotide
  Target: ATXN1; (-) strand; PAM type: NRG; PAM sequence: CAG
gtcttggaaacaccttttac

SEQ ID NO: 76898 - DNA, 20 bp, Artificial Sequence
  Description of Artificial Sequence: Synthetic oligonucleotide
  Target: ATXN1; (-) strand; PAM type: NRG; PAM sequence: TGG
aaataacttagatccggtct

SEQ ID NO: 76899 - DNA, 20 bp, Artificial Sequence
  Description of Artificial Sequence: Synthetic oligonucleotide
  Target: ATXN1; (-) strand; PAM type: NRG; PAM sequence: CGG
cctatgaaataacttagatc

SEQ ID NO: 76900 - DNA, 20 bp, Artificial Sequence
  Description of Artificial Sequence: Synthetic oligonucleotide
  Target: ATXN1; (-) strand; PAM type: NRG; PAM sequence: TAG
aagttacctatgaaataact

SEQ ID NO: 76901 - DNA, 20 bp, Artificial Sequence
  Description of Artificial Sequence: Synthetic oligonucleotide
  Target: ATXN1; (-) strand; PAM type: NRG; PAM sequence: AAG
acgttgggacgtgctttcta

SEQ ID NO: 76902 - DNA, 20 bp, Artificial Sequence
  Description of Artificial Sequence: Synthetic oligonucleotide
  Target: ATXN1; (-) strand; PAM type: NRG; PAM sequence: GGG
gaatttaacactgccacgtt

SEQ ID NO: 76903 - DNA, 20 bp, Artificial Sequence
  Description of Artificial Sequence: Synthetic oligonucleotide
  Target: ATXN1; (-) strand; PAM type: NRG; PAM sequence: TGG
tgaatttaacactgccacgt

SEQ ID NO: 76904 - DNA, 20 bp, Artificial Sequence
  Description of Artificial Sequence: Synthetic oligonucleotide
  Target: ATXN1; (-) strand; PAM type: NRG; PAM sequence: TAG
atgctctgtgtcacataact

SEQ ID NO: 76905 - DNA, 20 bp, Artificial Sequence
  Description of Artificial Sequence: Synthetic oligonucleotide
  Target: ATXN1; (-) strand; PAM type: NRG; PAM sequence: AGG
tcagttttagcttttgatgt

SEQ ID NO: 76906 - DNA, 20 bp, Artificial Sequence
  Description of Artificial Sequence: Synthetic oligonucleotide
  Target: ATXN1; (-) strand; PAM type: NRG; PAM sequence: TAG
ttcagttttagcttttgatg

SEQ ID NO: 76907 - DNA, 20 bp, Artificial Sequence
  Description of Artificial Sequence: Synthetic oligonucleotide
  Target: ATXN1; (-) strand; PAM type: NRG; PAM sequence: TAG
agaatttcatttttcagttt

SEQ ID NO: 76908 - DNA, 20 bp, Artificial Sequence
  Description of Artificial Sequence: Synthetic oligonucleotide
  Target: ATXN1; (-) strand; PAM type: NRG; PAM sequence: CAG
taaataagaatttcattttt

SEQ ID NO: 76909 - DNA, 20 bp, Artificial Sequence
  Description of Artificial Sequence: Synthetic oligonucleotide
  Target: ATXN1; (-) strand; PAM type: NRG; PAM sequence: AAG
agatagcaacatacttaaat

SEQ ID NO: 76910 - DNA, 20 bp, Artificial Sequence
  Description of Artificial Sequence: Synthetic oligonucleotide
  Target: ATXN1; (-) strand; PAM type: NRG; PAM sequence: TAG
gtatctcattagagtgaaga

SEQ ID NO: 76911 - DNA, 20 bp, Artificial Sequence
  Description of Artificial Sequence: Synthetic oligonucleotide
  Target: ATXN1; (-) strand; PAM type: NRG; PAM sequence: AAG
ccacgtatctcattagagtg

SEQ ID NO: 76912 - DNA, 20 bp, Artificial Sequence
  Description of Artificial Sequence: Synthetic oligonucleotide
  Target: ATXN1; (-) strand; PAM type: NRG; PAM sequence: GAG
ttgttccacgtatctcatta

SEQ ID NO: 76913 - DNA, 20 bp, Artificial Sequence
  Description of Artificial Sequence: Synthetic oligonucleotide
  Target: ATXN1; (-) strand; PAM type: NRG; PAM sequence: TAG
atttgttccacgtatctcat

SEQ ID NO: 76914 - DNA, 20 bp, Artificial Sequence
  Description of Artificial Sequence: Synthetic oligonucleotide
  Target: ATXN1; (-) strand; PAM type: NRG; PAM sequence: CAG
gttataatacattctagccc

SEQ ID NO: 76915 - DNA, 20 bp, Artificial Sequence
  Description of Artificial Sequence: Synthetic oligonucleotide
  Target: ATXN1; (-) strand; PAM type: NRG; PAM sequence: TAG
actattgttataatacattc

SEQ ID NO: 76916 - DNA, 20 bp, Artificial Sequence
  Description of Artificial Sequence: Synthetic oligonucleotide
  Target: ATXN1; (-) strand; PAM type: NRG; PAM sequence: AGG
cctcttaccaagtatccagc

SEQ ID NO: 76917 - DNA, 20 bp, Artificial Sequence
  Description of Artificial Sequence: Synthetic oligonucleotide
  Target: ATXN1; (-) strand; PAM type: NRG; PAM sequence: CAG
acctcttaccaagtatccag

SEQ ID NO: 76918 - DNA, 20 bp, Artificial Sequence
  Description of Artificial Sequence: Synthetic oligonucleotide
  Target: ATXN1; (-) strand; PAM type: NRG; PAM sequence: CAG
cccacctcttaccaagtatc

SEQ ID NO: 76919 - DNA, 20 bp, Artificial Sequence
  Description of Artificial Sequence: Synthetic oligonucleotide
  Target: ATXN1; (-) strand; PAM type: NRG; PAM sequence: AAG
gaccccacccacctcttacc

SEQ ID NO: 76920 - DNA, 20 bp, Artificial Sequence
  Description of Artificial Sequence: Synthetic oligonucleotide
  Target: ATXN1; (-) strand; PAM type: NRG; PAM sequence: TGG
tcaaagtcccctggaaatcc

SEQ ID NO: 76921 - DNA, 20 bp, Artificial Sequence
  Description of Artificial Sequence: Synthetic oligonucleotide
  Target: ATXN1; (-) strand; PAM type: NRG; PAM sequence: TGG
agaataaactcaaagtcccc

SEQ ID NO: 76922 - DNA, 20 bp, Artificial Sequence
  Description of Artificial Sequence: Synthetic oligonucleotide
  Target: ATXN1; (-) strand; PAM type: NRG; PAM sequence: AAG
gtgttggaagaataaactca

SEQ ID NO: 76923 - DNA, 20 bp, Artificial Sequence
  Description of Artificial Sequence: Synthetic oligonucleotide
  Target: ATXN1; (-) strand; PAM type: NRG; PAM sequence: AAG
atgcattttagcagtgttgg

SEQ ID NO: 76924 - DNA, 20 bp, Artificial Sequence
  Description of Artificial Sequence: Synthetic oligonucleotide
  Target: ATXN1; (-) strand; PAM type: NRG; PAM sequence: TGG
tagatgcattttagcagtgt

SEQ ID NO: 76925 - DNA, 20 bp, Artificial Sequence
  Description of Artificial Sequence: Synthetic oligonucleotide
  Target: ATXN1; (-) strand; PAM type: NRG; PAM sequence: CAG
agaaaatagatgcattttag

SEQ ID NO: 76926 - DNA, 20 bp, Artificial Sequence
  Description of Artificial Sequence: Synthetic oligonucleotide
  Target: ATXN1; (-) strand; PAM type: NRG; PAM sequence: TAG
aatagaaaatagatgcattt

SEQ ID NO: 76927 - DNA, 20 bp, Artificial Sequence
  Description of Artificial Sequence: Synthetic oligonucleotide
  Target: ATXN1; (-) strand; PAM type: NRG; PAM sequence: TAG
tagaaagtcagaatagaaaa

SEQ ID NO: 76928 - DNA, 20 bp, Artificial Sequence
  Description of Artificial Sequence: Synthetic oligonucleotide
  Target: ATXN1; (-) strand; PAM type: NRG; PAM sequence: TAG
atcctgttagaaagtcagaa

SEQ ID NO: 76929 - DNA, 20 bp, Artificial Sequence
  Description of Artificial Sequence: Synthetic oligonucleotide
  Target: ATXN1; (-) strand; PAM type: NRG; PAM sequence: CAG
attgcatcctgttagaaagt

SEQ ID NO: 76930 - DNA, 20 bp, Artificial Sequence
  Description of Artificial Sequence: Synthetic oligonucleotide
  Target: ATXN1; (-) strand; PAM type: NRG; PAM sequence: AAG
tcagattgcatcctgttaga

SEQ ID NO: 76931 - DNA, 20 bp, Artificial Sequence
  Description of Artificial Sequence: Synthetic oligonucleotide
  Target: ATXN1; (-) strand; PAM type: NRG; PAM sequence: TAG
gctctcagattgcatcctgt

SEQ ID NO: 76932 - DNA, 20 bp, Artificial Sequence
  Description of Artificial Sequence: Synthetic oligonucleotide
  Target: ATXN1; (-) strand; PAM type: NRG; PAM sequence: CAG
ttaagtggctggctggctct

SEQ ID NO: 76933 - DNA, 20 bp, Artificial Sequence
  Description of Artificial Sequence: Synthetic oligonucleotide
  Target: ATXN1; (-) strand; PAM type: NRG; PAM sequence: TGG
atagattttaagtggctggc

SEQ ID NO: 76934 - DNA, 20 bp, Artificial Sequence
  Description of Artificial Sequence: Synthetic oligonucleotide
  Target: ATXN1; (-) strand; PAM type: NRG; PAM sequence: TGG
ataaatagattttaagtggc

SEQ ID NO: 76935 - DNA, 20 bp, Artificial Sequence
  Description of Artificial Sequence: Synthetic oligonucleotide
  Target: ATXN1; (-) strand; PAM type: NRG; PAM sequence: TGG
tgaaataaatagattttaag

SEQ ID NO: 76936 - DNA, 20 bp, Artificial Sequence
  Description of Artificial Sequence: Synthetic oligonucleotide
  Target: ATXN1; (-) strand; PAM type: NRG; PAM sequence: AAG
agctgaaataaatagatttt

SEQ ID NO: 76937 - DNA, 20 bp, Artificial Sequence
  Description of Artificial Sequence: Synthetic oligonucleotide
  Target: ATXN1; (-) strand; PAM type: NRG; PAM sequence: TAG
ctgcgcacagctgaaataaa

SEQ ID NO: 76938 - DNA, 20 bp, Artificial Sequence
  Description of Artificial Sequence: Synthetic oligonucleotide
  Target: ATXN1; (-) strand; PAM type: NRG; PAM sequence: CAG
caggcgtgagccactgcgca

SEQ ID NO: 76939 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 76940 - DNA, 20 bp, Artificial Sequence
  Description of Artificial Sequence: Synthetic oligonucleotide
  Target: ATXN1; (-) strand; PAM type: NRG; PAM sequence: AGG
tcactaagtgctgggattac

SEQ ID NO: 76941 - DNA, 20 bp, Artificial Sequence
  Description of Artificial Sequence: Synthetic oligonucleotide
  Target: ATXN1; (-) strand; PAM type: NRG; PAM sequence: CAG
ctcactaagtgctgggatta

SEQ ID NO: 76942 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcactaagtgct

SEQ ID NO: 76943 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcactaagtgc

SEQ ID NO: 76944 - DNA, 20 bp, Artificial Sequence
  Description of Artificial Sequence: Synthetic oligonucleotide
  Target: ATXN1; (-) strand; PAM type: NRG; PAM sequence: AAG
ccgcccgcctcggcctcact

SEQ ID NO: 76945 - DNA, 20 bp, Artificial Sequence
  Description of Artificial Sequence: Synthetic oligonucleotide
  Target: ATXN1; (-) strand; PAM type: NRG; PAM sequence: CGG
acctcatggtccgcccgcct

SEQ ID NO: 76946 - DNA, 20 bp, Artificial Sequence
  Description of Artificial Sequence: Synthetic oligonucleotide
  Target: ATXN1; (-) strand; PAM type: NRG; PAM sequence: TGG
gtctcgatctcctgacctca

SEQ ID NO: 76947 - DNA, 20 bp, Artificial Sequence
  Description of Artificial Sequence: Synthetic oligonucleotide
  Target: ATXN1; (-) strand; PAM type: NRG; PAM sequence: TGG
tttcaccgtgttagccagga

SEQ ID NO: 76948 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccgtgttagcc

SEQ ID NO: 76949 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccgtgttagc

SEQ ID NO: 76950 - DNA, 20 bp, Artificial Sequence
  Description of Artificial Sequence: Synthetic oligonucleotide
  Target: ATXN1; (-) strand; PAM type: NRG; PAM sequence: TAG
gagatggggtttcaccgtgt

SEQ ID NO: 76951 - DNA, 20 bp, Artificial Sequence
  Description of Artificial Sequence: Synthetic oligonucleotide
  Target: ATXN1; (-) strand; PAM type: NRG; PAM sequence: GGG
tgtattttttagtagagatg

SEQ ID NO: 76952 - DNA, 20 bp, Artificial Sequence
  Description of Artificial Sequence: Synthetic oligonucleotide
  Target: ATXN1; (-) strand; PAM type: NRG; PAM sequence: GGG
ttgtattttttagtagagat

SEQ ID NO: 76953 - DNA, 20 bp, Artificial Sequence
  Description of Artificial Sequence: Synthetic oligonucleotide
  Target: ATXN1; (-) strand; PAM type: NRG; PAM sequence: TGG
tttgtattttttagtagaga

SEQ ID NO: 76954 - DNA, 20 bp, Artificial Sequence
  Description of Artificial Sequence: Synthetic oligonucleotide
  Target: ATXN1; (-) strand; PAM type: NRG; PAM sequence: GAG
attttttgtattttttagta

SEQ ID NO: 76955 - DNA, 20 bp, Artificial Sequence
  Description of Artificial Sequence: Synthetic oligonucleotide
  Target: ATXN1; (-) strand; PAM type: NRG; PAM sequence: TAG
atattttttgtattttttag

SEQ ID NO: 76956 - DNA, 20 bp, Artificial Sequence
  Description of Artificial Sequence: Synthetic oligonucleotide
  Target: ATXN1; (-) strand; PAM type: NRG; PAM sequence: TAG
ctaatattttttgtattttt

SEQ ID NO: 76957 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggactac

SEQ ID NO: 76958 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggacta

SEQ ID NO: 76959 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtagct

SEQ ID NO: 76960 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 76961 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 76962 - DNA, 20 bp, Artificial Sequence
  Description of Artificial Sequence: Synthetic oligonucleotide
  Target: ATXN1; (-) strand; PAM type: NRG; PAM sequence: GAG
ttttcctgcctcagcctccc

SEQ ID NO: 76963 - DNA, 20 bp, Artificial Sequence
  Description of Artificial Sequence: Synthetic oligonucleotide
  Target: ATXN1; (-) strand; PAM type: NRG; PAM sequence: CAG
ttcacgccattttcctgcct

SEQ ID NO: 76964 - DNA, 20 bp, Artificial Sequence
  Description of Artificial Sequence: Synthetic oligonucleotide
  Target: ATXN1; (-) strand; PAM type: NRG; PAM sequence: GGG
cactgcaagctccgcctcct

SEQ ID NO: 76965 - DNA, 20 bp, Artificial Sequence
  Description of Artificial Sequence: Synthetic oligonucleotide
  Target: ATXN1; (-) strand; PAM type: NRG; PAM sequence: TGG
tcactgcaagctccgcctcc

SEQ ID NO: 76966 - DNA, 20 bp, Artificial Sequence
  Description of Artificial Sequence: Synthetic oligonucleotide
  Target: ATXN1; (-) strand; PAM type: NRG; PAM sequence: AAG
gtgcaatcttggctcactgc

SEQ ID NO: 76967 - DNA, 20 bp, Artificial Sequence
  Description of Artificial Sequence: Synthetic oligonucleotide
  Target: ATXN1; (-) strand; PAM type: NRG; PAM sequence: TGG
ggaatgcagtggtgcaatct

SEQ ID NO: 76968 - DNA, 20 bp, Artificial Sequence
  Description of Artificial Sequence: Synthetic oligonucleotide
  Target: ATXN1; (-) strand; PAM type: NRG; PAM sequence: TGG
tcatccaggctggaatgcag

SEQ ID NO: 76969 - DNA, 20 bp, Artificial Sequence
  Description of Artificial Sequence: Synthetic oligonucleotide
  Target: ATXN1; (-) strand; PAM type: NRG; PAM sequence: CAG
ctgtcatccaggctggaatg

SEQ ID NO: 76970 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtcatccaggc

SEQ ID NO: 76971 - DNA, 20 bp, Artificial Sequence
  Description of Artificial Sequence: Synthetic oligonucleotide
  Target: ATXN1; (-) strand; PAM type: NRG; PAM sequence: AGG
aaagtctcactctgtcatcc

SEQ ID NO: 76972 - DNA, 20 bp, Artificial Sequence
  Description of Artificial Sequence: Synthetic oligonucleotide
  Target: ATXN1; (-) strand; PAM type: NRG; PAM sequence: CAG
caaagtctcactctgtcatc

SEQ ID NO: 76973 - DNA, 20 bp, Artificial Sequence
  Description of Artificial Sequence: Synthetic oligonucleotide
  Target: ATXN1; (-) strand; PAM type: NRG; PAM sequence: AAG
attttttcttttttgagaca

SEQ ID NO: 76974 - DNA, 20 bp, Artificial Sequence
  Description of Artificial Sequence: Synthetic oligonucleotide
  Target: ATXN1; (-) strand; PAM type: NRG; PAM sequence: GAG
aaattgattttttctttttt

SEQ ID NO: 76975 - DNA, 20 bp, Artificial Sequence
  Description of Artificial Sequence: Synthetic oligonucleotide
  Target: ATXN1; (-) strand; PAM type: NRG; PAM sequence: TGG
ttctacttgtatttctactc

SEQ ID NO: 76976 - DNA, 20 bp, Artificial Sequence
  Description of Artificial Sequence: Synthetic oligonucleotide
  Target: ATXN1; (-) strand; PAM type: NRG; PAM sequence: TAG
agaattttctgcttgcaaaa

SEQ ID NO: 76977 - DNA, 20 bp, Artificial Sequence
  Description of Artificial Sequence: Synthetic oligonucleotide
  Target: ATXN1; (-) strand; PAM type: NRG; PAM sequence: GAG
accctgactctaaaatacgt

SEQ ID NO: 76978 - DNA, 20 bp, Artificial Sequence
  Description of Artificial Sequence: Synthetic oligonucleotide
  Target: ATXN1; (-) strand; PAM type: NRG; PAM sequence: GAG
aactttaagatttatgattt

SEQ ID NO: 76979 - DNA, 20 bp, Artificial Sequence
  Description of Artificial Sequence: Synthetic oligonucleotide
  Target: ATXN1; (-) strand; PAM type: NRG; PAM sequence: AAG
gcatggattctgaaaacttt

SEQ ID NO: 76980 - DNA, 20 bp, Artificial Sequence
  Description of Artificial Sequence: Synthetic oligonucleotide
  Target: ATXN1; (-) strand; PAM type: NRG; PAM sequence: TGG
ttttcttaagtcccttggca

SEQ ID NO: 76981 - DNA, 20 bp, Artificial Sequence
  Description of Artificial Sequence: Synthetic oligonucleotide
  Target: ATXN1; (-) strand; PAM type: NRG; PAM sequence: TGG
attaattttcttaagtccct

SEQ ID NO: 76982 - DNA, 20 bp, Artificial Sequence
  Description of Artificial Sequence: Synthetic oligonucleotide
  Target: ATXN1; (-) strand; PAM type: NRG; PAM sequence: AAG
ggggcaatattaattttctt

SEQ ID NO: 76983 - DNA, 20 bp, Artificial Sequence
  Description of Artificial Sequence: Synthetic oligonucleotide
  Target: ATXN1; (-) strand; PAM type: NRG; PAM sequence: GGG
acaaaagacagcttatatgg

SEQ ID NO: 76984 - DNA, 20 bp, Artificial Sequence
  Description of Artificial Sequence: Synthetic oligonucleotide
  Target: ATXN1; (-) strand; PAM type: NRG; PAM sequence: GGG
tacaaaagacagcttatatg

SEQ ID NO: 76985 - DNA, 20 bp, Artificial Sequence
  Description of Artificial Sequence: Synthetic oligonucleotide
  Target: ATXN1; (-) strand; PAM type: NRG; PAM sequence: GGG
atacaaaagacagcttatat

SEQ ID NO: 76986 - DNA, 20 bp, Artificial Sequence
  Description of Artificial Sequence: Synthetic oligonucleotide
  Target: ATXN1; (-) strand; PAM type: NRG; PAM sequence: TGG
tatacaaaagacagcttata

SEQ ID NO: 76987 - DNA, 20 bp, Artificial Sequence
  Description of Artificial Sequence: Synthetic oligonucleotide
  Target: ATXN1; (-) strand; PAM type: NRG; PAM sequence: CAG
gatgcttagtatacaaaaga

SEQ ID NO: 76988 - DNA, 20 bp, Artificial Sequence
  Description of Artificial Sequence: Synthetic oligonucleotide
  Target: ATXN1; (-) strand; PAM type: NRG; PAM sequence: AAG
tgctgatgcttagtatacaa

SEQ ID NO: 76989 - DNA, 20 bp, Artificial Sequence
  Description of Artificial Sequence: Synthetic oligonucleotide
  Target: ATXN1; (-) strand; PAM type: NRG; PAM sequence: TAG
gcagatgctttgctgatgct

SEQ ID NO: 76990 - DNA, 20 bp, Artificial Sequence
  Description of Artificial Sequence: Synthetic oligonucleotide
  Target: ATXN1; (-) strand; PAM type: NRG; PAM sequence: CAG
agtaaaatagctgttggggg

SEQ ID NO: 76991 - DNA, 20 bp, Artificial Sequence
  Description of Artificial Sequence: Synthetic oligonucleotide
  Target: ATXN1; (-) strand; PAM type: NRG; PAM sequence: GGG
accagtaaaatagctgttgg

SEQ ID NO: 76992 - DNA, 20 bp, Artificial Sequence
  Description of Artificial Sequence: Synthetic oligonucleotide
  Target: ATXN1; (-) strand; PAM type: NRG; PAM sequence: GGG
gaccagtaaaatagctgttg

SEQ ID NO: 76993 - DNA, 20 bp, Artificial Sequence
  Description of Artificial Sequence: Synthetic oligonucleotide
  Target: ATXN1; (-) strand; PAM type: NRG; PAM sequence: GGG
ggaccagtaaaatagctgtt

SEQ ID NO: 76994 - DNA, 20 bp, Artificial Sequence
  Description of Artificial Sequence: Synthetic oligonucleotide
  Target: ATXN1; (-) strand; PAM type: NRG; PAM sequence: TGG
gggaccagtaaaatagctgt

SEQ ID NO: 76995 - DNA, 20 bp, Artificial Sequence
  Description of Artificial Sequence: Synthetic oligonucleotide
  Target: ATXN1; (-) strand; PAM type: NRG; PAM sequence: TAG
ttcctctgggaccagtaaaa

SEQ ID NO: 76996 - DNA, 20 bp, Artificial Sequence
  Description of Artificial Sequence: Synthetic oligonucleotide
  Target: ATXN1; (-) strand; PAM type: NRG; PAM sequence: CAG
gcttatctttcctctgggac

SEQ ID NO: 76997 - DNA, 20 bp, Artificial Sequence
  Description of Artificial Sequence: Synthetic oligonucleotide
  Target: ATXN1; (-) strand; PAM type: NRG; PAM sequence: GGG
actctgcttatctttcctct

SEQ ID NO: 76998 - DNA, 20 bp, Artificial Sequence
  Description of Artificial Sequence: Synthetic oligonucleotide
  Target: ATXN1; (-) strand; PAM type: NRG; PAM sequence: TGG
aactctgcttatctttcctc

SEQ ID NO: 76999 - DNA, 20 bp, Artificial Sequence
  Description of Artificial Sequence: Synthetic oligonucleotide
  Target: ATXN1; (-) strand; PAM type: NRG; PAM sequence: AAG
ccttctttatgattttgcgg

SEQ ID NO: 77000 - DNA, 20 bp, Artificial Sequence
  Description of Artificial Sequence: Synthetic oligonucleotide
  Target: ATXN1; (-) strand; PAM type: NRG; PAM sequence: CGG
tgaccttctttatgattttg

SEQ ID NO: 77001 - DNA, 20 bp, Artificial Sequence
  Description of Artificial Sequence: Synthetic oligonucleotide
  Target: ATXN1; (-) strand; PAM type: NRG; PAM sequence: CAG
gcctaaggggaaggatccta

SEQ ID NO: 77002 - DNA, 20 bp, Artificial Sequence
  Description of Artificial Sequence: Synthetic oligonucleotide
  Target: ATXN1; (-) strand; PAM type: NRG; PAM sequence: AGG
acctagagggcctaagggga

SEQ ID NO: 77003 - DNA, 20 bp, Artificial Sequence
  Description of Artificial Sequence: Synthetic oligonucleotide
  Target: ATXN1; (-) strand; PAM type: NRG; PAM sequence: AAG
cacctagagggcctaagggg

SEQ ID NO: 77004 - DNA, 20 bp, Artificial Sequence
  Description of Artificial Sequence: Synthetic oligonucleotide
  Target: ATXN1; (-) strand; PAM type: NRG; PAM sequence: GGG
aggcacctagagggcctaag

SEQ ID NO: 77005 - DNA, 20 bp, Artificial Sequence
  Description of Artificial Sequence: Synthetic oligonucleotide
  Target: ATXN1; (-) strand; PAM type: NRG; PAM sequence: GGG
gaggcacctagagggcctaa

SEQ ID NO: 77006 - DNA, 20 bp, Artificial Sequence
  Description of Artificial Sequence: Synthetic oligonucleotide
  Target: ATXN1; (-) strand; PAM type: NRG; PAM sequence: AGG
ggaggcacctagagggccta

SEQ ID NO: 77007 - DNA, 20 bp, Artificial Sequence
  Description of Artificial Sequence: Synthetic oligonucleotide
  Target: ATXN1; (-) strand; PAM type: NRG; PAM sequence: AAG
gggaggcacctagagggcct

SEQ ID NO: 77008 - DNA, 20 bp, Artificial Sequence
  Description of Artificial Sequence: Synthetic oligonucleotide
  Target: ATXN1; (-) strand; PAM type: NRG; PAM sequence: GGG
ccaatggggaggcacctaga

SEQ ID NO: 77009 - DNA, 20 bp, Artificial Sequence
  Description of Artificial Sequence: Synthetic oligonucleotide
  Target: ATXN1; (-) strand; PAM type: NRG; PAM sequence: AGG
cccaatggggaggcacctag

SEQ ID NO: 77010 - DNA, 20 bp, Artificial Sequence
  Description of Artificial Sequence: Synthetic oligonucleotide
  Target: ATXN1; (-) strand; PAM type: NRG; PAM sequence: GAG
gcccaatggggaggcaccta

SEQ ID NO: 77011 - DNA, 20 bp, Artificial Sequence
  Description of Artificial Sequence: Synthetic oligonucleotide
  Target: ATXN1; (-) strand; PAM type: NRG; PAM sequence: TAG
gggcccaatggggaggcacc

SEQ ID NO: 77012 - DNA, 20 bp, Artificial Sequence
  Description of Artificial Sequence: Synthetic oligonucleotide
  Target: ATXN1; (-) strand; PAM type: NRG; PAM sequence: AGG
acccctggggcccaatgggg

SEQ ID NO: 77013 - DNA, 20 bp, Artificial Sequence
  Description of Artificial Sequence: Synthetic oligonucleotide
  Target: ATXN1; (-) strand; PAM type: NRG; PAM sequence: GAG
aacccctggggcccaatggg

SEQ ID NO: 77014 - DNA, 20 bp, Artificial Sequence
  Description of Artificial Sequence: Synthetic oligonucleotide
  Target: ATXN1; (-) strand; PAM type: NRG; PAM sequence: GGG
gaaacccctggggcccaatg

SEQ ID NO: 77015 - DNA, 20 bp, Artificial Sequence
  Description of Artificial Sequence: Synthetic oligonucleotide
  Target: ATXN1; (-) strand; PAM type: NRG; PAM sequence: GGG
agaaacccctggggcccaat

SEQ ID NO: 77016 - DNA, 20 bp, Artificial Sequence
  Description of Artificial Sequence: Synthetic oligonucleotide
  Target: ATXN1; (-) strand; PAM type: NRG; PAM sequence: TGG
tagaaacccctggggcccaa

SEQ ID NO: 77017 - DNA, 20 bp, Artificial Sequence
  Description of Artificial Sequence: Synthetic oligonucleotide
  Target: ATXN1; (-) strand; PAM type: NRG; PAM sequence: GGG
ttacggagtagaaacccctg

SEQ ID NO: 77018 - DNA, 20 bp, Artificial Sequence
  Description of Artificial Sequence: Synthetic oligonucleotide
  Target: ATXN1; (-) strand; PAM type: NRG; PAM sequence: GGG
attacggagtagaaacccct

SEQ ID NO: 77019 - DNA, 20 bp, Artificial Sequence
  Description of Artificial Sequence: Synthetic oligonucleotide
  Target: ATXN1; (-) strand; PAM type: NRG; PAM sequence: TGG
aattacggagtagaaacccc

SEQ ID NO: 77020 - DNA, 20 bp, Artificial Sequence
  Description of Artificial Sequence: Synthetic oligonucleotide
  Target: ATXN1; (-) strand; PAM type: NRG; PAM sequence: TAG
ggtgggaaagaattacggag

SEQ ID NO: 77021 - DNA, 20 bp, Artificial Sequence
  Description of Artificial Sequence: Synthetic oligonucleotide
  Target: ATXN1; (-) strand; PAM type: NRG; PAM sequence: GAG
aggggtgggaaagaattacg

SEQ ID NO: 77022 - DNA, 20 bp, Artificial Sequence
  Description of Artificial Sequence: Synthetic oligonucleotide
  Target: ATXN1; (-) strand; PAM type: NRG; PAM sequence: CGG
gcaggggtgggaaagaatta

SEQ ID NO: 77023 - DNA, 20 bp, Artificial Sequence
  Description of Artificial Sequence: Synthetic oligonucleotide
  Target: ATXN1; (-) strand; PAM type: NRG; PAM sequence: AAG
ttgacagggcaggggtggga

SEQ ID NO: 77024 - DNA, 20 bp, Artificial Sequence
  Description of Artificial Sequence: Synthetic oligonucleotide
  Target: ATXN1; (-) strand; PAM type: NRG; PAM sequence: GGG
caagttgacagggcaggggt

SEQ ID NO: 77025 - DNA, 20 bp, Artificial Sequence
  Description of Artificial Sequence: Synthetic oligonucleotide
  Target: ATXN1; (-) strand; PAM type: NRG; PAM sequence: TGG
tcaagttgacagggcagggg

SEQ ID NO: 77026 - DNA, 20 bp, Artificial Sequence
  Description of Artificial Sequence: Synthetic oligonucleotide
  Target: ATXN1; (-) strand; PAM type: NRG; PAM sequence: GGG
tgttcaagttgacagggcag

SEQ ID NO: 77027 - DNA, 20 bp, Artificial Sequence
  Description of Artificial Sequence: Synthetic oligonucleotide
  Target: ATXN1; (-) strand; PAM type: NRG; PAM sequence: GGG
gtgttcaagttgacagggca

SEQ ID NO: 77028 - DNA, 20 bp, Artificial Sequence
  Description of Artificial Sequence: Synthetic oligonucleotide
  Target: ATXN1; (-) strand; PAM type: NRG; PAM sequence: AGG
ggtgttcaagttgacagggc

SEQ ID NO: 77029 - DNA, 20 bp, Artificial Sequence
  Description of Artificial Sequence: Synthetic oligonucleotide
  Target: ATXN1; (-) strand; PAM type: NRG; PAM sequence: CAG
tggtgttcaagttgacaggg

SEQ ID NO: 77030 - DNA, 20 bp, Artificial Sequence
  Description of Artificial Sequence: Synthetic oligonucleotide
  Target: ATXN1; (-) strand; PAM type: NRG; PAM sequence: GGG
cactggtgttcaagttgaca

SEQ ID NO: 77031 - DNA, 20 bp, Artificial Sequence
  Description of Artificial Sequence: Synthetic oligonucleotide
  Target: ATXN1; (-) strand; PAM type: NRG; PAM sequence: AGG
tcactggtgttcaagttgac

SEQ ID NO: 77032 - DNA, 20 bp, Artificial Sequence
  Description of Artificial Sequence: Synthetic oligonucleotide
  Target: ATXN1; (-) strand; PAM type: NRG; PAM sequence: CAG
ttcactggtgttcaagttga

SEQ ID NO: 77033 - DNA, 20 bp, Artificial Sequence
  Description of Artificial Sequence: Synthetic oligonucleotide
  Target: ATXN1; (-) strand; PAM type: NRG; PAM sequence: AAG
gtggtgtttcactggtgttc

SEQ ID NO: 77034 - DNA, 20 bp, Artificial Sequence
  Description of Artificial Sequence: Synthetic oligonucleotide
  Target: ATXN1; (-) strand; PAM type: NRG; PAM sequence: TGG
gaaacactgtggtgtttcac

SEQ ID NO: 77035 - DNA, 20 bp, Artificial Sequence
  Description of Artificial Sequence: Synthetic oligonucleotide
  Target: ATXN1; (-) strand; PAM type: NRG; PAM sequence: TGG
gtattcatattgaaacactg

SEQ ID NO: 77036 - DNA, 20 bp, Artificial Sequence
  Description of Artificial Sequence: Synthetic oligonucleotide
  Target: ATXN1; (-) strand; PAM type: NRG; PAM sequence: AAG
cggagcaaaaacagtgactg

SEQ ID NO: 77037 - DNA, 20 bp, Artificial Sequence
  Description of Artificial Sequence: Synthetic oligonucleotide
  Target: ATXN1; (-) strand; PAM type: NRG; PAM sequence: CAG
tttggtgggcggagcaaaaa

SEQ ID NO: 77038 - DNA, 20 bp, Artificial Sequence
  Description of Artificial Sequence: Synthetic oligonucleotide
  Target: ATXN1; (-) strand; PAM type: NRG; PAM sequence: GAG
tggattttttttggtgggcg

SEQ ID NO: 77039 - DNA, 20 bp, Artificial Sequence
  Description of Artificial Sequence: Synthetic oligonucleotide
  Target: ATXN1; (-) strand; PAM type: NRG; PAM sequence: CGG
tatggattttttttggtggg

SEQ ID NO: 77040 - DNA, 20 bp, Artificial Sequence
  Description of Artificial Sequence: Synthetic oligonucleotide
  Target: ATXN1; (-) strand; PAM type: NRG; PAM sequence: GGG
aagtatggattttttttggt

SEQ ID NO: 77041 - DNA, 20 bp, Artificial Sequence
  Description of Artificial Sequence: Synthetic oligonucleotide
  Target: ATXN1; (-) strand; PAM type: NRG; PAM sequence: TGG
aaagtatggattttttttgg

SEQ ID NO: 77042 - DNA, 20 bp, Artificial Sequence
  Description of Artificial Sequence: Synthetic oligonucleotide
  Target: ATXN1; (-) strand; PAM type: NRG; PAM sequence: TGG
tttaaagtatggattttttt

SEQ ID NO: 77043 - DNA, 20 bp, Artificial Sequence
  Description of Artificial Sequence: Synthetic oligonucleotide
  Target: ATXN1; (-) strand; PAM type: NRG; PAM sequence: TGG
aaattaaaagctttaaagta

SEQ ID NO: 77044 - DNA, 20 bp, Artificial Sequence
  Description of Artificial Sequence: Synthetic oligonucleotide
  Target: ATXN1; (-) strand; PAM type: NRG; PAM sequence: AAG
taaaaaaattaaaagcttta

SEQ ID NO: 77045 - DNA, 20 bp, Artificial Sequence
  Description of Artificial Sequence: Synthetic oligonucleotide
  Target: ATXN1; (-) strand; PAM type: NRG; PAM sequence: AAG
taaaagcttaaaaaaattaa

SEQ ID NO: 77046 - DNA, 20 bp, Artificial Sequence
  Description of Artificial Sequence: Synthetic oligonucleotide
  Target: ATXN1; (-) strand; PAM type: NRG; PAM sequence: AAG
gcttcaattaaaaaaattaa

SEQ ID NO: 77047 - DNA, 20 bp, Artificial Sequence
  Description of Artificial Sequence: Synthetic oligonucleotide
  Target: ATXN1; (-) strand; PAM type: NRG; PAM sequence: AAG
ttagaatttaaaagaaagta

SEQ ID NO: 77048 - DNA, 20 bp, Artificial Sequence
  Description of Artificial Sequence: Synthetic oligonucleotide
  Target: ATXN1; (-) strand; PAM type: NRG; PAM sequence: AAG
tgatgttagaatttaaaaga

SEQ ID NO: 77049 - DNA, 20 bp, Artificial Sequence
  Description of Artificial Sequence: Synthetic oligonucleotide
  Target: ATXN1; (-) strand; PAM type: NRG; PAM sequence: AAG
tcactgatgttagaatttaa

SEQ ID NO: 77050 - DNA, 20 bp, Artificial Sequence
  Description of Artificial Sequence: Synthetic oligonucleotide
  Target: ATXN1; (-) strand; PAM type: NRG; PAM sequence: TAG
ttttggctgctcactgatgt

SEQ ID NO: 77051 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaaaaaaagaattt

SEQ ID NO: 77052 - DNA, 20 bp, Artificial Sequence
  Description of Artificial Sequence: Synthetic oligonucleotide
  Target: ATXN1; (-) strand; PAM type: NRG; PAM sequence: AAG
tccatctaaaaaaaaaaaaa

SEQ ID NO: 77053 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtcacagagc

SEQ ID NO: 77054 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggtcaca

SEQ ID NO: 77055 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggtca

SEQ ID NO: 77056 - DNA, 20 bp, Artificial Sequence
  Description of Artificial Sequence: Synthetic oligonucleotide
  Target: ATXN1; (-) strand; PAM type: NRG; PAM sequence: GGG
atgccactgcactccagcct

SEQ ID NO: 77057 - DNA, 20 bp, Artificial Sequence
  Description of Artificial Sequence: Synthetic oligonucleotide
  Target: ATXN1; (-) strand; PAM type: NRG; PAM sequence: TGG
catgccactgcactccagcc

SEQ ID NO: 77058 - DNA, 20 bp, Artificial Sequence
  Description of Artificial Sequence: Synthetic oligonucleotide
  Target: ATXN1; (-) strand; PAM type: NRG; PAM sequence: CAG
aagatcatgccactgcactc

SEQ ID NO: 77059 - DNA, 20 bp, Artificial Sequence
  Description of Artificial Sequence: Synthetic oligonucleotide
  Target: ATXN1; (-) strand; PAM type: NRG; PAM sequence: AAG
ggcgaaggttgcagtgagcc

SEQ ID NO: 77060 - DNA, 20 bp, Artificial Sequence
  Description of Artificial Sequence: Synthetic oligonucleotide
  Target: ATXN1; (-) strand; PAM type: NRG; PAM sequence: GAG
caggaggcgaaggttgcagt

SEQ ID NO: 77061 - DNA, 20 bp, Artificial Sequence
  Description of Artificial Sequence: Synthetic oligonucleotide
  Target: ATXN1; (-) strand; PAM type: NRG; PAM sequence: CAG
aacccaggaggcgaaggttg

SEQ ID NO: 77062 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacccaggaggcga

SEQ ID NO: 77063 - DNA, 20 bp, Artificial Sequence
  Description of Artificial Sequence: Synthetic oligonucleotide
  Target: ATXN1; (-) strand; PAM type: NRG; PAM sequence: AAG
ttgcttgaacccaggaggcg

SEQ ID NO: 77064 - DNA, 20 bp, Artificial Sequence
  Description of Artificial Sequence: Synthetic oligonucleotide
  Target: ATXN1; (-) strand; PAM type: NRG; PAM sequence: AGG
gagacttgcttgaacccagg

SEQ ID NO: 77065 - DNA, 20 bp, Artificial Sequence
  Description of Artificial Sequence: Synthetic oligonucleotide
  Target: ATXN1; (-) strand; PAM type: NRG; PAM sequence: GAG
agagacttgcttgaacccag

SEQ ID NO: 77066 - DNA, 20 bp, Artificial Sequence
  Description of Artificial Sequence: Synthetic oligonucleotide
  Target: ATXN1; (-) strand; PAM type: NRG; PAM sequence: AGG
caagagacttgcttgaaccc

SEQ ID NO: 77067 - DNA, 20 bp, Artificial Sequence
  Description of Artificial Sequence: Synthetic oligonucleotide
  Target: ATXN1; (-) strand; PAM type: NRG; PAM sequence: CAG
gcaagagacttgcttgaacc

SEQ ID NO: 77068 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcaa

SEQ ID NO: 77069 - DNA, 20 bp, Artificial Sequence
  Description of Artificial Sequence: Synthetic oligonucleotide
  Target: ATXN1; (-) strand; PAM type: NRG; PAM sequence: AAG
gctacttgggaggctgaggc

SEQ ID NO: 77070 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 77071 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 77072 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctacttggg

SEQ ID NO: 77073 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacttgg

SEQ ID NO: 77074 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagctactt

SEQ ID NO: 77075 - DNA, 20 bp, Artificial Sequence
  Description of Artificial Sequence: Synthetic oligonucleotide
  Target: ATXN1; (-) strand; PAM type: NRG; PAM sequence: TGG
cgcctgtagtcccagctact

SEQ ID NO: 77076 - DNA, 20 bp, Artificial Sequence
  Description of Artificial Sequence: Synthetic oligonucleotide
  Target: ATXN1; (-) strand; PAM type: NRG; PAM sequence: CAG
gtggcctgcgcctgtagtcc

SEQ ID NO: 77077 - DNA, 20 bp, Artificial Sequence
  Description of Artificial Sequence: Synthetic oligonucleotide
  Target: ATXN1; (-) strand; PAM type: NRG; PAM sequence: TAG
ggcatggtggcctgcgcctg

SEQ ID NO: 77078 - DNA, 20 bp, Artificial Sequence
  Description of Artificial Sequence: Synthetic oligonucleotide
  Target: ATXN1; (-) strand; PAM type: NRG; PAM sequence: TGG
caaaaattagcagggcatgg

SEQ ID NO: 77079 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagcagggca

SEQ ID NO: 77080 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaattagca

SEQ ID NO: 77081 - DNA, 20 bp, Artificial Sequence
  Description of Artificial Sequence: Synthetic oligonucleotide
  Target: ATXN1; (-) strand; PAM type: NRG; PAM sequence: AGG
ctaaaaatacaaaaattagc

SEQ ID NO: 77082 - DNA, 20 bp, Artificial Sequence
  Description of Artificial Sequence: Synthetic oligonucleotide
  Target: ATXN1; (-) strand; PAM type: NRG; PAM sequence: CAG
actaaaaatacaaaaattag

SEQ ID NO: 77083 - DNA, 20 bp, Artificial Sequence
  Description of Artificial Sequence: Synthetic oligonucleotide
  Target: ATXN1; (-) strand; PAM type: NRG; PAM sequence: TAG
tgtactaaaaatacaaaaat

SEQ ID NO: 77084 - DNA, 20 bp, Artificial Sequence
  Description of Artificial Sequence: Synthetic oligonucleotide
  Target: ATXN1; (-) strand; PAM type: NRG; PAM sequence: CGG
caagaccattctggccaaca

SEQ ID NO: 77085 - DNA, 20 bp, Artificial Sequence
  Description of Artificial Sequence: Synthetic oligonucleotide
  Target: ATXN1; (-) strand; PAM type: NRG; PAM sequence: TGG
tcaagagatcaagaccattc

SEQ ID NO: 77086 - DNA, 20 bp, Artificial Sequence
  Description of Artificial Sequence: Synthetic oligonucleotide
  Target: ATXN1; (-) strand; PAM type: NRG; PAM sequence: AAG
gttcatgaggtcaagagatc

SEQ ID NO: 77087 - DNA, 20 bp, Artificial Sequence
  Description of Artificial Sequence: Synthetic oligonucleotide
  Target: ATXN1; (-) strand; PAM type: NRG; PAM sequence: GAG
cgggtggttcatgaggtcaa

SEQ ID NO: 77088 - DNA, 20 bp, Artificial Sequence
  Description of Artificial Sequence: Synthetic oligonucleotide
  Target: ATXN1; (-) strand; PAM type: NRG; PAM sequence: AAG
agcgggtggttcatgaggtc

SEQ ID NO: 77089 - DNA, 20 bp, Artificial Sequence
  Description of Artificial Sequence: Synthetic oligonucleotide
  Target: ATXN1; (-) strand; PAM type: NRG; PAM sequence: AGG
gccgaagcgggtggttcatg

SEQ ID NO: 77090 - DNA, 20 bp, Artificial Sequence
  Description of Artificial Sequence: Synthetic oligonucleotide
  Target: ATXN1; (-) strand; PAM type: NRG; PAM sequence: GAG
ggccgaagcgggtggttcat

SEQ ID NO: 77091 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccgaagcggg

SEQ ID NO: 77092 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccgaagc

SEQ ID NO: 77093 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaggccgaag

SEQ ID NO: 77094 - DNA, 20 bp, Artificial Sequence
  Description of Artificial Sequence: Synthetic oligonucleotide
  Target: ATXN1; (-) strand; PAM type: NRG; PAM sequence: AAG
ctcagcactttgggaggccg

SEQ ID NO: 77095 - DNA, 20 bp, Artificial Sequence
  Description of Artificial Sequence: Synthetic oligonucleotide
  Target: ATXN1; (-) strand; PAM type: NRG; PAM sequence: AGG
tgtaatctcagcactttggg

SEQ ID NO: 77096 - DNA, 20 bp, Artificial Sequence
  Description of Artificial Sequence: Synthetic oligonucleotide
  Target: ATXN1; (-) strand; PAM type: NRG; PAM sequence: GAG
ctgtaatctcagcactttgg

SEQ ID NO: 77097 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatctcagcacttt

SEQ ID NO: 77098 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatctcagcactt

SEQ ID NO: 77099 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatct

SEQ ID NO: 77100 - DNA, 20 bp, Artificial Sequence
  Description of Artificial Sequence: Synthetic oligonucleotide
  Target: ATXN1; (-) strand; PAM type: NRG; PAM sequence: TGG
tgggctgcggccaggctcag

SEQ ID NO: 77101 - DNA, 20 bp, Artificial Sequence
  Description of Artificial Sequence: Synthetic oligonucleotide
  Target: ATXN1; (-) strand; PAM type: NRG; PAM sequence: CAG
atttgggctgcggccaggct

SEQ ID NO: 77102 - DNA, 20 bp, Artificial Sequence
  Description of Artificial Sequence: Synthetic oligonucleotide
  Target: ATXN1; (-) strand; PAM type: NRG; PAM sequence: AGG
tcagaatttgggctgcggcc

SEQ ID NO: 77103 - DNA, 20 bp, Artificial Sequence
  Description of Artificial Sequence: Synthetic oligonucleotide
  Target: ATXN1; (-) strand; PAM type: NRG; PAM sequence: CAG
ttcagaatttgggctgcggc

SEQ ID NO: 77104 - DNA, 20 bp, Artificial Sequence
  Description of Artificial Sequence: Synthetic oligonucleotide
  Target: ATXN1; (-) strand; PAM type: NRG; PAM sequence: CGG
cccgttcagaatttgggctg

SEQ ID NO: 77105 - DNA, 20 bp, Artificial Sequence
  Description of Artificial Sequence: Synthetic oligonucleotide
  Target: ATXN1; (-) strand; PAM type: NRG; PAM sequence: GGG
tctttccccgttcagaattt

SEQ ID NO: 77106 - DNA, 20 bp, Artificial Sequence
  Description of Artificial Sequence: Synthetic oligonucleotide
  Target: ATXN1; (-) strand; PAM type: NRG; PAM sequence: TGG
ctctttccccgttcagaatt

SEQ ID NO: 77107 - DNA, 20 bp, Artificial Sequence
  Description of Artificial Sequence: Synthetic oligonucleotide
  Target: ATXN1; (-) strand; PAM type: NRG; PAM sequence: CAG
ccttatcctctttccccgtt

SEQ ID NO: 77108 - DNA, 20 bp, Artificial Sequence
  Description of Artificial Sequence: Synthetic oligonucleotide
  Target: ATXN1; (-) strand; PAM type: NRG; PAM sequence: GAG
aaagaagcttgcaaaagtag

SEQ ID NO: 77109 - DNA, 20 bp, Artificial Sequence
  Description of Artificial Sequence: Synthetic oligonucleotide
  Target: ATXN1; (-) strand; PAM type: NRG; PAM sequence: AGG
caaaagaagcttgcaaaagt

SEQ ID NO: 77110 - DNA, 20 bp, Artificial Sequence
  Description of Artificial Sequence: Synthetic oligonucleotide
  Target: ATXN1; (-) strand; PAM type: NRG; PAM sequence: TAG
gcaaaagaagcttgcaaaag

SEQ ID NO: 77111 - DNA, 20 bp, Artificial Sequence
  Description of Artificial Sequence: Synthetic oligonucleotide
  Target: ATXN1; (-) strand; PAM type: NRG; PAM sequence: AAG
gaagcaaaagaagcttgcaa

SEQ ID NO: 77112 - DNA, 20 bp, Artificial Sequence
  Description of Artificial Sequence: Synthetic oligonucleotide
  Target: ATXN1; (-) strand; PAM type: NRG; PAM sequence: AAG
gccttcataggaagcaaaag

SEQ ID NO: 77113 - DNA, 20 bp, Artificial Sequence
  Description of Artificial Sequence: Synthetic oligonucleotide
  Target: ATXN1; (-) strand; PAM type: NRG; PAM sequence: AAG
caagccttcataggaagcaa

SEQ ID NO: 77114 - DNA, 20 bp, Artificial Sequence
  Description of Artificial Sequence: Synthetic oligonucleotide
  Target: ATXN1; (-) strand; PAM type: NRG; PAM sequence: AAG
ttatggcaagccttcatagg

SEQ ID NO: 77115 - DNA, 20 bp, Artificial Sequence
  Description of Artificial Sequence: Synthetic oligonucleotide
  Target: ATXN1; (-) strand; PAM type: NRG; PAM sequence: AGG
tctttatggcaagccttcat

SEQ ID NO: 77116 - DNA, 20 bp, Artificial Sequence
  Description of Artificial Sequence: Synthetic oligonucleotide
  Target: ATXN1; (-) strand; PAM type: NRG; PAM sequence: TAG
atctttatggcaagccttca

SEQ ID NO: 77117 - DNA, 20 bp, Artificial Sequence
  Description of Artificial Sequence: Synthetic oligonucleotide
  Target: ATXN1; (-) strand; PAM type: NRG; PAM sequence: AAG
agcatttctatctttatggc

SEQ ID NO: 77118 - DNA, 20 bp, Artificial Sequence
  Description of Artificial Sequence: Synthetic oligonucleotide
  Target: ATXN1; (-) strand; PAM type: NRG; PAM sequence: TGG
tcaaagcatttctatcttta

SEQ ID NO: 77119 - DNA, 20 bp, Artificial Sequence
  Description of Artificial Sequence: Synthetic oligonucleotide
  Target: ATXN1; (-) strand; PAM type: NRG; PAM sequence: AAG
gaacccagtttgtgatgtca

SEQ ID NO: 77120 - DNA, 20 bp, Artificial Sequence
  Description of Artificial Sequence: Synthetic oligonucleotide
  Target: ATXN1; (-) strand; PAM type: NRG; PAM sequence: CAG
gtcacagtggaacatgaacc

SEQ ID NO: 77121 - DNA, 20 bp, Artificial Sequence
  Description of Artificial Sequence: Synthetic oligonucleotide
  Target: ATXN1; (-) strand; PAM type: NRG; PAM sequence: TGG
tagcctgtccatggtcacag

SEQ ID NO: 77122 - DNA, 20 bp, Artificial Sequence
  Description of Artificial Sequence: Synthetic oligonucleotide
  Target: ATXN1; (-) strand; PAM type: NRG; PAM sequence: CAG
acatagcctgtccatggtca

SEQ ID NO: 77123 - DNA, 20 bp, Artificial Sequence
  Description of Artificial Sequence: Synthetic oligonucleotide
  Target: ATXN1; (-) strand; PAM type: NRG; PAM sequence: TGG
tcagttacatagcctgtcca

SEQ ID NO: 77124 - DNA, 20 bp, Artificial Sequence
  Description of Artificial Sequence: Synthetic oligonucleotide
  Target: ATXN1; (-) strand; PAM type: NRG; PAM sequence: TAG
gtagccgaagctcagttaca

SEQ ID NO: 77125 - DNA, 20 bp, Artificial Sequence
  Description of Artificial Sequence: Synthetic oligonucleotide
  Target: ATXN1; (-) strand; PAM type: NRG; PAM sequence: CAG
gtaaatgagtagccgaagct

SEQ ID NO: 77126 - DNA, 20 bp, Artificial Sequence
  Description of Artificial Sequence: Synthetic oligonucleotide
  Target: ATXN1; (-) strand; PAM type: NRG; PAM sequence: AAG
gttttgtaaatgagtagccg

SEQ ID NO: 77127 - DNA, 20 bp, Artificial Sequence
  Description of Artificial Sequence: Synthetic oligonucleotide
  Target: ATXN1; (-) strand; PAM type: NRG; PAM sequence: TAG
attcctgttttgtaaatgag

SEQ ID NO: 77128 - DNA, 20 bp, Artificial Sequence
  Description of Artificial Sequence: Synthetic oligonucleotide
  Target: ATXN1; (-) strand; PAM type: NRG; PAM sequence: GAG
ataattcctgttttgtaaat

SEQ ID NO: 77129 - DNA, 20 bp, Artificial Sequence
  Description of Artificial Sequence: Synthetic oligonucleotide
  Target: ATXN1; (-) strand; PAM type: NRG; PAM sequence: GGG
gggctctttaacattgcaat

SEQ ID NO: 77130 - DNA, 20 bp, Artificial Sequence
  Description of Artificial Sequence: Synthetic oligonucleotide
  Target: ATXN1; (-) strand; PAM type: NRG; PAM sequence: TGG
agggctctttaacattgcaa

SEQ ID NO: 77131 - DNA, 20 bp, Artificial Sequence
  Description of Artificial Sequence: Synthetic oligonucleotide
  Target: ATXN1; (-) strand; PAM type: NRG; PAM sequence: GGG
gtatggtgctccttctgaga

SEQ ID NO: 77132 - DNA, 20 bp, Artificial Sequence
  Description of Artificial Sequence: Synthetic oligonucleotide
  Target: ATXN1; (-) strand; PAM type: NRG; PAM sequence: AGG
agtatggtgctccttctgag

SEQ ID NO: 77133 - DNA, 20 bp, Artificial Sequence
  Description of Artificial Sequence: Synthetic oligonucleotide
  Target: ATXN1; (-) strand; PAM type: NRG; PAM sequence: GAG
aagtatggtgctccttctga

SEQ ID NO: 77134 - DNA, 20 bp, Artificial Sequence
  Description of Artificial Sequence: Synthetic oligonucleotide
  Target: ATXN1; (-) strand; PAM type: NRG; PAM sequence: GAG
gaaagtatggtgctccttct

SEQ ID NO: 77135 - DNA, 20 bp, Artificial Sequence
  Description of Artificial Sequence: Synthetic oligonucleotide
  Target: ATXN1; (-) strand; PAM type: NRG; PAM sequence: TGG
cggcacttagaaagaaagta

SEQ ID NO: 77136 - DNA, 20 bp, Artificial Sequence
  Description of Artificial Sequence: Synthetic oligonucleotide
  Target: ATXN1; (-) strand; PAM type: NRG; PAM sequence: AAG
tttatcggcacttagaaaga

SEQ ID NO: 77137 - DNA, 20 bp, Artificial Sequence
  Description of Artificial Sequence: Synthetic oligonucleotide
  Target: ATXN1; (-) strand; PAM type: NRG; PAM sequence: AAG
ttattttatcggcacttaga

SEQ ID NO: 77138 - DNA, 20 bp, Artificial Sequence
  Description of Artificial Sequence: Synthetic oligonucleotide
  Target: ATXN1; (-) strand; PAM type: NRG; PAM sequence: TAG
tcttttattttatcggcact

SEQ ID NO: 77139 - DNA, 20 bp, Artificial Sequence
  Description of Artificial Sequence: Synthetic oligonucleotide
  Target: ATXN1; (-) strand; PAM type: NRG; PAM sequence: CGG
gcttttatcttttattttat

SEQ ID NO: 77140 - DNA, 20 bp, Artificial Sequence
  Description of Artificial Sequence: Synthetic oligonucleotide
  Target: ATXN1; (-) strand; PAM type: NRG; PAM sequence: CGG
gtggctgggtcaatcccagt

SEQ ID NO: 77141 - DNA, 20 bp, Artificial Sequence
  Description of Artificial Sequence: Synthetic oligonucleotide
  Target: ATXN1; (-) strand; PAM type: NRG; PAM sequence: CAG
agaggtggctgggtcaatcc

SEQ ID NO: 77142 - DNA, 20 bp, Artificial Sequence
  Description of Artificial Sequence: Synthetic oligonucleotide
  Target: ATXN1; (-) strand; PAM type: NRG; PAM sequence: GGG
ggcccttagcagaggtggct

SEQ ID NO: 77143 - DNA, 20 bp, Artificial Sequence
  Description of Artificial Sequence: Synthetic oligonucleotide
  Target: ATXN1; (-) strand; PAM type: NRG; PAM sequence: TGG
aggcccttagcagaggtggc

SEQ ID NO: 77144 - DNA, 20 bp, Artificial Sequence
  Description of Artificial Sequence: Synthetic oligonucleotide
  Target: ATXN1; (-) strand; PAM type: NRG; PAM sequence: TGG
taggaggcccttagcagagg

SEQ ID NO: 77145 - DNA, 20 bp, Artificial Sequence
  Description of Artificial Sequence: Synthetic oligonucleotide
  Target: ATXN1; (-) strand; PAM type: NRG; PAM sequence: AGG
aggtaggaggcccttagcag

SEQ ID NO: 77146 - DNA, 20 bp, Artificial Sequence
  Description of Artificial Sequence: Synthetic oligonucleotide
  Target: ATXN1; (-) strand; PAM type: NRG; PAM sequence: GAG
taggtaggaggcccttagca

SEQ ID NO: 77147 - DNA, 20 bp, Artificial Sequence
  Description of Artificial Sequence: Synthetic oligonucleotide
  Target: ATXN1; (-) strand; PAM type: NRG; PAM sequence: CAG
tctaggtaggaggcccttag

SEQ ID NO: 77148 - DNA, 20 bp, Artificial Sequence
  Description of Artificial Sequence: Synthetic oligonucleotide
  Target: ATXN1; (-) strand; PAM type: NRG; PAM sequence: TAG
gactctaggtaggaggccct

SEQ ID NO: 77149 - DNA, 20 bp, Artificial Sequence
  Description of Artificial Sequence: Synthetic oligonucleotide
  Target: ATXN1; (-) strand; PAM type: NRG; PAM sequence: AGG
gtgaggtgactctaggtagg

SEQ ID NO: 77150 - DNA, 20 bp, Artificial Sequence
  Description of Artificial Sequence: Synthetic oligonucleotide
  Target: ATXN1; (-) strand; PAM type: NRG; PAM sequence: GAG
agtgaggtgactctaggtag

SEQ ID NO: 77151 - DNA, 20 bp, Artificial Sequence
  Description of Artificial Sequence: Synthetic oligonucleotide
  Target: ATXN1; (-) strand; PAM type: NRG; PAM sequence: AGG
ccagtgaggtgactctaggt

SEQ ID NO: 77152 - DNA, 20 bp, Artificial Sequence
  Description of Artificial Sequence: Synthetic oligonucleotide
  Target: ATXN1; (-) strand; PAM type: NRG; PAM sequence: TAG
cccagtgaggtgactctagg

SEQ ID NO: 77153 - DNA, 20 bp, Artificial Sequence
  Description of Artificial Sequence: Synthetic oligonucleotide
  Target: ATXN1; (-) strand; PAM type: NRG; PAM sequence: AGG
ggtcccagtgaggtgactct

SEQ ID NO: 77154 - DNA, 20 bp, Artificial Sequence
  Description of Artificial Sequence: Synthetic oligonucleotide
  Target: ATXN1; (-) strand; PAM type: NRG; PAM sequence: TAG
aggtcccagtgaggtgactc

SEQ ID NO: 77155 - DNA, 20 bp, Artificial Sequence
  Description of Artificial Sequence: Synthetic oligonucleotide
  Target: ATXN1; (-) strand; PAM type: NRG; PAM sequence: AGG
tgctgtcccaggtcccagtg

SEQ ID NO: 77156 - DNA, 20 bp, Artificial Sequence
  Description of Artificial Sequence: Synthetic oligonucleotide
  Target: ATXN1; (-) strand; PAM type: NRG; PAM sequence: GAG
atgctgtcccaggtcccagt

SEQ ID NO: 77157 - DNA, 20 bp, Artificial Sequence
  Description of Artificial Sequence: Synthetic oligonucleotide
  Target: ATXN1; (-) strand; PAM type: NRG; PAM sequence: CAG
aatcatgctgtcccaggtcc

SEQ ID NO: 77158 - DNA, 20 bp, Artificial Sequence
  Description of Artificial Sequence: Synthetic oligonucleotide
  Target: ATXN1; (-) strand; PAM type: NRG; PAM sequence: AGG
ggtaagaatcatgctgtccc

SEQ ID NO: 77159 - DNA, 20 bp, Artificial Sequence
  Description of Artificial Sequence: Synthetic oligonucleotide
  Target: ATXN1; (-) strand; PAM type: NRG; PAM sequence: CAG
tggtaagaatcatgctgtcc

SEQ ID NO: 77160 - DNA, 20 bp, Artificial Sequence
  Description of Artificial Sequence: Synthetic oligonucleotide
  Target: ATXN1; (-) strand; PAM type: NRG; PAM sequence: AAG
tcaagctctcagaaactggt

SEQ ID NO: 77161 - DNA, 20 bp, Artificial Sequence
  Description of Artificial Sequence: Synthetic oligonucleotide
  Target: ATXN1; (-) strand; PAM type: NRG; PAM sequence: TGG
gacctcaagctctcagaaac

SEQ ID NO: 77162 - DNA, 20 bp, Artificial Sequence
  Description of Artificial Sequence: Synthetic oligonucleotide
  Target: ATXN1; (-) strand; PAM type: NRG; PAM sequence: CAG
ggcccaagacctcaagctct

SEQ ID NO: 77163 - DNA, 20 bp, Artificial Sequence
  Description of Artificial Sequence: Synthetic oligonucleotide
  Target: ATXN1; (-) strand; PAM type: NRG; PAM sequence: AAG
gctcgagggcccaagacctc

SEQ ID NO: 77164 - DNA, 20 bp, Artificial Sequence
  Description of Artificial Sequence: Synthetic oligonucleotide
  Target: ATXN1; (-) strand; PAM type: NRG; PAM sequence: AAG
gacgcctggctcgagggccc

SEQ ID NO: 77165 - DNA, 20 bp, Artificial Sequence
  Description of Artificial Sequence: Synthetic oligonucleotide
  Target: ATXN1; (-) strand; PAM type: NRG; PAM sequence: GGG
ttagcggacgcctggctcga

SEQ ID NO: 77166 - DNA, 20 bp, Artificial Sequence
  Description of Artificial Sequence: Synthetic oligonucleotide
  Target: ATXN1; (-) strand; PAM type: NRG; PAM sequence: AGG
tttagcggacgcctggctcg

SEQ ID NO: 77167 - DNA, 20 bp, Artificial Sequence
  Description of Artificial Sequence: Synthetic oligonucleotide
  Target: ATXN1; (-) strand; PAM type: NRG; PAM sequence: GAG
ctttagcggacgcctggctc

SEQ ID NO: 77168 - DNA, 20 bp, Artificial Sequence
  Description of Artificial Sequence: Synthetic oligonucleotide
  Target: ATXN1; (-) strand; PAM type: NRG; PAM sequence: TGG
acctgcctttagcggacgcc

SEQ ID NO: 77169 - DNA, 20 bp, Artificial Sequence
  Description of Artificial Sequence: Synthetic oligonucleotide
  Target: ATXN1; (-) strand; PAM type: NRG; PAM sequence: CGG
aacctcagacctgcctttag

SEQ ID NO: 77170 - DNA, 20 bp, Artificial Sequence
  Description of Artificial Sequence: Synthetic oligonucleotide
  Target: ATXN1; (-) strand; PAM type: NRG; PAM sequence: TAG
gctaacctcagacctgcctt

SEQ ID NO: 77171 - DNA, 20 bp, Artificial Sequence
  Description of Artificial Sequence: Synthetic oligonucleotide
  Target: ATXN1; (-) strand; PAM type: NRG; PAM sequence: CAG
actgggaaatgggctaacct

SEQ ID NO: 77172 - DNA, 20 bp, Artificial Sequence
  Description of Artificial Sequence: Synthetic oligonucleotide
  Target: ATXN1; (-) strand; PAM type: NRG; PAM sequence: GGG
gagaatggtaactgggaaat

SEQ ID NO: 77173 - DNA, 20 bp, Artificial Sequence
  Description of Artificial Sequence: Synthetic oligonucleotide
  Target: ATXN1; (-) strand; PAM type: NRG; PAM sequence: TGG
ggagaatggtaactgggaaa

SEQ ID NO: 77174 - DNA, 20 bp, Artificial Sequence
  Description of Artificial Sequence: Synthetic oligonucleotide
  Target: ATXN1; (-) strand; PAM type: NRG; PAM sequence: GGG
gggaaaggagaatggtaact

SEQ ID NO: 77175 - DNA, 20 bp, Artificial Sequence
  Description of Artificial Sequence: Synthetic oligonucleotide
  Target: ATXN1; (-) strand; PAM type: NRG; PAM sequence: TGG
ggggaaaggagaatggtaac

SEQ ID NO: 77176 - DNA, 20 bp, Artificial Sequence
  Description of Artificial Sequence: Synthetic oligonucleotide
  Target: ATXN1; (-) strand; PAM type: NRG; PAM sequence: TGG
aaagccaggggaaaggagaa

SEQ ID NO: 77177 - DNA, 20 bp, Artificial Sequence
  Description of Artificial Sequence: Synthetic oligonucleotide
  Target: ATXN1; (-) strand; PAM type: NRG; PAM sequence: GAG
ggagaaaagccaggggaaag

SEQ ID NO: 77178 - DNA, 20 bp, Artificial Sequence
  Description of Artificial Sequence: Synthetic oligonucleotide
  Target: ATXN1; (-) strand; PAM type: NRG; PAM sequence: AGG
aaggagaaaagccaggggaa

SEQ ID NO: 77179 - DNA, 20 bp, Artificial Sequence
  Description of Artificial Sequence: Synthetic oligonucleotide
  Target: ATXN1; (-) strand; PAM type: NRG; PAM sequence: AAG
gaaggagaaaagccagggga

SEQ ID NO: 77180 - DNA, 20 bp, Artificial Sequence
  Description of Artificial Sequence: Synthetic oligonucleotide
  Target: ATXN1; (-) strand; PAM type: NRG; PAM sequence: GGG
cttggaaggagaaaagccag

SEQ ID NO: 77181 - DNA, 20 bp, Artificial Sequence
  Description of Artificial Sequence: Synthetic oligonucleotide
  Target: ATXN1; (-) strand; PAM type: NRG; PAM sequence: GGG
tcttggaaggagaaaagcca

SEQ ID NO: 77182 - DNA, 20 bp, Artificial Sequence
  Description of Artificial Sequence: Synthetic oligonucleotide
  Target: ATXN1; (-) strand; PAM type: NRG; PAM sequence: AGG
ctcttggaaggagaaaagcc

SEQ ID NO: 77183 - DNA, 20 bp, Artificial Sequence
  Description of Artificial Sequence: Synthetic oligonucleotide
  Target: ATXN1; (-) strand; PAM type: NRG; PAM sequence: CAG
cctcttggaaggagaaaagc

SEQ ID NO: 77184 - DNA, 20 bp, Artificial Sequence
  Description of Artificial Sequence: Synthetic oligonucleotide
  Target: ATXN1; (-) strand; PAM type: NRG; PAM sequence: AAG
aaagcctcttggaaggagaa

SEQ ID NO: 77185 - DNA, 20 bp, Artificial Sequence
  Description of Artificial Sequence: Synthetic oligonucleotide
  Target: ATXN1; (-) strand; PAM type: NRG; PAM sequence: GAG
ggcttaaagcctcttggaag

SEQ ID NO: 77186 - DNA, 20 bp, Artificial Sequence
  Description of Artificial Sequence: Synthetic oligonucleotide
  Target: ATXN1; (-) strand; PAM type: NRG; PAM sequence: AGG
aaggcttaaagcctcttgga

SEQ ID NO: 77187 - DNA, 20 bp, Artificial Sequence
  Description of Artificial Sequence: Synthetic oligonucleotide
  Target: ATXN1; (-) strand; PAM type: NRG; PAM sequence: AAG
aaaggcttaaagcctcttgg

SEQ ID NO: 77188 - DNA, 20 bp, Artificial Sequence
  Description of Artificial Sequence: Synthetic oligonucleotide
  Target: ATXN1; (-) strand; PAM type: NRG; PAM sequence: TGG
gggaaaggcttaaagcctct

SEQ ID NO: 77189 - DNA, 20 bp, Artificial Sequence
  Description of Artificial Sequence: Synthetic oligonucleotide
  Target: ATXN1; (-) strand; PAM type: NRG; PAM sequence: AAG
ggaggagtgggaaaggctta

SEQ ID NO: 77190 - DNA, 20 bp, Artificial Sequence
  Description of Artificial Sequence: Synthetic oligonucleotide
  Target: ATXN1; (-) strand; PAM type: NRG; PAM sequence: AGG
agaggagggaggagtgggaa

SEQ ID NO: 77191 - DNA, 20 bp, Artificial Sequence
  Description of Artificial Sequence: Synthetic oligonucleotide
  Target: ATXN1; (-) strand; PAM type: NRG; PAM sequence: AAG
gagaggagggaggagtggga

SEQ ID NO: 77192 - DNA, 20 bp, Artificial Sequence
  Description of Artificial Sequence: Synthetic oligonucleotide
  Target: ATXN1; (-) strand; PAM type: NRG; PAM sequence: GGG
gaaggagaggagggaggagt

SEQ ID NO: 77193 - DNA, 20 bp, Artificial Sequence
  Description of Artificial Sequence: Synthetic oligonucleotide
  Target: ATXN1; (-) strand; PAM type: NRG; PAM sequence: TGG
agaaggagaggagggaggag

SEQ ID NO: 77194 - DNA, 20 bp, Artificial Sequence
  Description of Artificial Sequence: Synthetic oligonucleotide
  Target: ATXN1; (-) strand; PAM type: NRG; PAM sequence: GAG
accagaaggagaggagggag

SEQ ID NO: 77195 - DNA, 20 bp, Artificial Sequence
  Description of Artificial Sequence: Synthetic oligonucleotide
  Target: ATXN1; (-) strand; PAM type: NRG; PAM sequence: AGG
ggaccagaaggagaggaggg

SEQ ID NO: 77196 - DNA, 20 bp, Artificial Sequence
  Description of Artificial Sequence: Synthetic oligonucleotide
  Target: ATXN1; (-) strand; PAM type: NRG; PAM sequence: GAG
gggaccagaaggagaggagg

SEQ ID NO: 77197 - DNA, 20 bp, Artificial Sequence
  Description of Artificial Sequence: Synthetic oligonucleotide
  Target: ATXN1; (-) strand; PAM type: NRG; PAM sequence: GGG
aggggaccagaaggagagga

SEQ ID NO: 77198 - DNA, 20 bp, Artificial Sequence
  Description of Artificial Sequence: Synthetic oligonucleotide
  Target: ATXN1; (-) strand; PAM type: NRG; PAM sequence: AGG
caggggaccagaaggagagg

SEQ ID NO: 77199 - DNA, 20 bp, Artificial Sequence
  Description of Artificial Sequence: Synthetic oligonucleotide
  Target: ATXN1; (-) strand; PAM type: NRG; PAM sequence: GAG
gcaggggaccagaaggagag

SEQ ID NO: 77200 - DNA, 20 bp, Artificial Sequence
  Description of Artificial Sequence: Synthetic oligonucleotide
  Target: ATXN1; (-) strand; PAM type: NRG; PAM sequence: AGG
aggcaggggaccagaaggag

SEQ ID NO: 77201 - DNA, 20 bp, Artificial Sequence
  Description of Artificial Sequence: Synthetic oligonucleotide
  Target: ATXN1; (-) strand; PAM type: NRG; PAM sequence: GAG
gaggcaggggaccagaagga

SEQ ID NO: 77202 - DNA, 20 bp, Artificial Sequence
  Description of Artificial Sequence: Synthetic oligonucleotide
  Target: ATXN1; (-) strand; PAM type: NRG; PAM sequence: GAG
ttgaggcaggggaccagaag

SEQ ID NO: 77203 - DNA, 20 bp, Artificial Sequence
  Description of Artificial Sequence: Synthetic oligonucleotide
  Target: ATXN1; (-) strand; PAM type: NRG; PAM sequence: AGG
agttgaggcaggggaccaga

SEQ ID NO: 77204 - DNA, 20 bp, Artificial Sequence
  Description of Artificial Sequence: Synthetic oligonucleotide
  Target: ATXN1; (-) strand; PAM type: NRG; PAM sequence: AAG
gagttgaggcaggggaccag

SEQ ID NO: 77205 - DNA, 20 bp, Artificial Sequence
  Description of Artificial Sequence: Synthetic oligonucleotide
  Target: ATXN1; (-) strand; PAM type: NRG; PAM sequence: CAG
ggtgagttgaggcaggggac

SEQ ID NO: 77206 - DNA, 20 bp, Artificial Sequence
  Description of Artificial Sequence: Synthetic oligonucleotide
  Target: ATXN1; (-) strand; PAM type: NRG; PAM sequence: GGG
ctctgggtgagttgaggcag

SEQ ID NO: 77207 - DNA, 20 bp, Artificial Sequence
  Description of Artificial Sequence: Synthetic oligonucleotide
  Target: ATXN1; (-) strand; PAM type: NRG; PAM sequence: GGG
tctctgggtgagttgaggca

SEQ ID NO: 77208 - DNA, 20 bp, Artificial Sequence
  Description of Artificial Sequence: Synthetic oligonucleotide
  Target: ATXN1; (-) strand; PAM type: NRG; PAM sequence: AGG
gtctctgggtgagttgaggc

SEQ ID NO: 77209 - DNA, 20 bp, Artificial Sequence
  Description of Artificial Sequence: Synthetic oligonucleotide
  Target: ATXN1; (-) strand; PAM type: NRG; PAM sequence: CAG
agtctctgggtgagttgagg

SEQ ID NO: 77210 - DNA, 20 bp, Artificial Sequence
  Description of Artificial Sequence: Synthetic oligonucleotide
  Target: ATXN1; (-) strand; PAM type: NRG; PAM sequence: AGG
ctcagtctctgggtgagttg

SEQ ID NO: 77211 - DNA, 20 bp, Artificial Sequence
  Description of Artificial Sequence: Synthetic oligonucleotide
  Target: ATXN1; (-) strand; PAM type: NRG; PAM sequence: GAG
tctcagtctctgggtgagtt

SEQ ID NO: 77212 - DNA, 20 bp, Artificial Sequence
  Description of Artificial Sequence: Synthetic oligonucleotide
  Target: ATXN1; (-) strand; PAM type: NRG; PAM sequence: GAG
tgcattctcagtctctgggt

SEQ ID NO: 77213 - DNA, 20 bp, Artificial Sequence
  Description of Artificial Sequence: Synthetic oligonucleotide
  Target: ATXN1; (-) strand; PAM type: NRG; PAM sequence: GGG
gtactgcattctcagtctct

SEQ ID NO: 77214 - DNA, 20 bp, Artificial Sequence
  Description of Artificial Sequence: Synthetic oligonucleotide
  Target: ATXN1; (-) strand; PAM type: NRG; PAM sequence: TGG
ggtactgcattctcagtctc

SEQ ID NO: 77215 - DNA, 20 bp, Artificial Sequence
  Description of Artificial Sequence: Synthetic oligonucleotide
  Target: ATXN1; (-) strand; PAM type: NRG; PAM sequence: CAG
gaggaatggtactgcattct

SEQ ID NO: 77216 - DNA, 20 bp, Artificial Sequence
  Description of Artificial Sequence: Synthetic oligonucleotide
  Target: ATXN1; (-) strand; PAM type: NRG; PAM sequence: TGG
gaaggtggcccagtgaggaa

SEQ ID NO: 77217 - DNA, 20 bp, Artificial Sequence
  Description of Artificial Sequence: Synthetic oligonucleotide
  Target: ATXN1; (-) strand; PAM type: NRG; PAM sequence: AGG
aaagggaaggtggcccagtg

SEQ ID NO: 77218 - DNA, 20 bp, Artificial Sequence
  Description of Artificial Sequence: Synthetic oligonucleotide
  Target: ATXN1; (-) strand; PAM type: NRG; PAM sequence: GAG
gaaagggaaggtggcccagt

SEQ ID NO: 77219 - DNA, 20 bp, Artificial Sequence
  Description of Artificial Sequence: Synthetic oligonucleotide
  Target: ATXN1; (-) strand; PAM type: NRG; PAM sequence: CAG
cctggaaagggaaggtggcc

SEQ ID NO: 77220 - DNA, 20 bp, Artificial Sequence
  Description of Artificial Sequence: Synthetic oligonucleotide
  Target: ATXN1; (-) strand; PAM type: NRG; PAM sequence: TGG
tggagcctggaaagggaagg

SEQ ID NO: 77221 - DNA, 20 bp, Artificial Sequence
  Description of Artificial Sequence: Synthetic oligonucleotide
  Target: ATXN1; (-) strand; PAM type: NRG; PAM sequence: AGG
gtatggagcctggaaaggga

SEQ ID NO: 77222 - DNA, 20 bp, Artificial Sequence
  Description of Artificial Sequence: Synthetic oligonucleotide
  Target: ATXN1; (-) strand; PAM type: NRG; PAM sequence: AAG
agtatggagcctggaaaggg

SEQ ID NO: 77223 - DNA, 20 bp, Artificial Sequence
  Description of Artificial Sequence: Synthetic oligonucleotide
  Target: ATXN1; (-) strand; PAM type: NRG; PAM sequence: GGG
tggagtatggagcctggaaa

SEQ ID NO: 77224 - DNA, 20 bp, Artificial Sequence
  Description of Artificial Sequence: Synthetic oligonucleotide
  Target: ATXN1; (-) strand; PAM type: NRG; PAM sequence: AGG
atggagtatggagcctggaa

SEQ ID NO: 77225 - DNA, 20 bp, Artificial Sequence
  Description of Artificial Sequence: Synthetic oligonucleotide
  Target: ATXN1; (-) strand; PAM type: NRG; PAM sequence: AAG
aatggagtatggagcctgga

SEQ ID NO: 77226 - DNA, 20 bp, Artificial Sequence
  Description of Artificial Sequence: Synthetic oligonucleotide
  Target: ATXN1; (-) strand; PAM type: NRG; PAM sequence: TGG
acagaatggagtatggagcc

SEQ ID NO: 77227 - DNA, 20 bp, Artificial Sequence
  Description of Artificial Sequence: Synthetic oligonucleotide
  Target: ATXN1; (-) strand; PAM type: NRG; PAM sequence: GAG
ttattacagaatggagtatg

SEQ ID NO: 77228 - DNA, 20 bp, Artificial Sequence
  Description of Artificial Sequence: Synthetic oligonucleotide
  Target: ATXN1; (-) strand; PAM type: NRG; PAM sequence: TGG
ctttattacagaatggagta

SEQ ID NO: 77229 - DNA, 20 bp, Artificial Sequence
  Description of Artificial Sequence: Synthetic oligonucleotide
  Target: ATXN1; (-) strand; PAM type: NRG; PAM sequence: GAG
gagaactttattacagaatg

SEQ ID NO: 77230 - DNA, 20 bp, Artificial Sequence
  Description of Artificial Sequence: Synthetic oligonucleotide
  Target: ATXN1; (-) strand; PAM type: NRG; PAM sequence: TGG
atgagaactttattacagaa

SEQ ID NO: 77231 - DNA, 20 bp, Artificial Sequence
  Description of Artificial Sequence: Synthetic oligonucleotide
  Target: ATXN1; (-) strand; PAM type: NRG; PAM sequence: CAG
tccccatgagaactttatta

SEQ ID NO: 77232 - DNA, 20 bp, Artificial Sequence
  Description of Artificial Sequence: Synthetic oligonucleotide
  Target: ATXN1; (-) strand; PAM type: NRG; PAM sequence: GAG
gctgttggaggtctccccat

SEQ ID NO: 77233 - DNA, 20 bp, Artificial Sequence
  Description of Artificial Sequence: Synthetic oligonucleotide
  Target: ATXN1; (-) strand; PAM type: NRG; PAM sequence: AGG
ctcaactgttgggctgttgg

SEQ ID NO: 77234 - DNA, 20 bp, Artificial Sequence
  Description of Artificial Sequence: Synthetic oligonucleotide
  Target: ATXN1; (-) strand; PAM type: NRG; PAM sequence: GAG
actcaactgttgggctgttg

SEQ ID NO: 77235 - DNA, 20 bp, Artificial Sequence
  Description of Artificial Sequence: Synthetic oligonucleotide
  Target: ATXN1; (-) strand; PAM type: NRG; PAM sequence: TGG
acactcaactgttgggctgt

SEQ ID NO: 77236 - DNA, 20 bp, Artificial Sequence
  Description of Artificial Sequence: Synthetic oligonucleotide
  Target: ATXN1; (-) strand; PAM type: NRG; PAM sequence: GGG
gctgtgtacactcaactgtt

SEQ ID NO: 77237 - DNA, 20 bp, Artificial Sequence
  Description of Artificial Sequence: Synthetic oligonucleotide
  Target: ATXN1; (-) strand; PAM type: NRG; PAM sequence: TGG
ggctgtgtacactcaactgt

SEQ ID NO: 77238 - DNA, 20 bp, Artificial Sequence
  Description of Artificial Sequence: Synthetic oligonucleotide
  Target: ATXN1; (-) strand; PAM type: NRG; PAM sequence: AGG
ttctggccgctaagcactca

SEQ ID NO: 77239 - DNA, 20 bp, Artificial Sequence
  Description of Artificial Sequence: Synthetic oligonucleotide
  Target: ATXN1; (-) strand; PAM type: NRG; PAM sequence: AAG
gttctggccgctaagcactc

SEQ ID NO: 77240 - DNA, 20 bp, Artificial Sequence
  Description of Artificial Sequence: Synthetic oligonucleotide
  Target: ATXN1; (-) strand; PAM type: NRG; PAM sequence: AAG
tcaatgaggttctggccgct

SEQ ID NO: 77241 - DNA, 20 bp, Artificial Sequence
  Description of Artificial Sequence: Synthetic oligonucleotide
  Target: ATXN1; (-) strand; PAM type: NRG; PAM sequence: TGG
ctgtgttttcaatgaggttc

SEQ ID NO: 77242 - DNA, 20 bp, Artificial Sequence
  Description of Artificial Sequence: Synthetic oligonucleotide
  Target: ATXN1; (-) strand; PAM type: NRG; PAM sequence: AGG
atggaactgtgttttcaatg

SEQ ID NO: 77243 - DNA, 20 bp, Artificial Sequence
  Description of Artificial Sequence: Synthetic oligonucleotide
  Target: ATXN1; (-) strand; PAM type: NRG; PAM sequence: GAG
tatggaactgtgttttcaat

SEQ ID NO: 77244 - DNA, 20 bp, Artificial Sequence
  Description of Artificial Sequence: Synthetic oligonucleotide
  Target: ATXN1; (-) strand; PAM type: NRG; PAM sequence: TGG
ttaaaacctgcctttcctta

SEQ ID NO: 77245 - DNA, 20 bp, Artificial Sequence
  Description of Artificial Sequence: Synthetic oligonucleotide
  Target: ATXN1; (-) strand; PAM type: NRG; PAM sequence: TGG
atttatggtgggggcctgcc

SEQ ID NO: 77246 - DNA, 20 bp, Artificial Sequence
  Description of Artificial Sequence: Synthetic oligonucleotide
  Target: ATXN1; (-) strand; PAM type: NRG; PAM sequence: GGG
gctcaccccatttatggtgg

SEQ ID NO: 77247 - DNA, 20 bp, Artificial Sequence
  Description of Artificial Sequence: Synthetic oligonucleotide
  Target: ATXN1; (-) strand; PAM type: NRG; PAM sequence: GGG
agctcaccccatttatggtg

SEQ ID NO: 77248 - DNA, 20 bp, Artificial Sequence
  Description of Artificial Sequence: Synthetic oligonucleotide
  Target: ATXN1; (-) strand; PAM type: NRG; PAM sequence: GGG
gagctcaccccatttatggt

SEQ ID NO: 77249 - DNA, 20 bp, Artificial Sequence
  Description of Artificial Sequence: Synthetic oligonucleotide
  Target: ATXN1; (-) strand; PAM type: NRG; PAM sequence: TGG
cgagctcaccccatttatgg

SEQ ID NO: 77250 - DNA, 20 bp, Artificial Sequence
  Description of Artificial Sequence: Synthetic oligonucleotide
  Target: ATXN1; (-) strand; PAM type: NRG; PAM sequence: TGG
tggcgagctcaccccattta

SEQ ID NO: 77251 - DNA, 20 bp, Artificial Sequence
  Description of Artificial Sequence: Synthetic oligonucleotide
  Target: ATXN1; (-) strand; PAM type: NRG; PAM sequence: GAG
agtcaagcctagcttttggc

SEQ ID NO: 77252 - DNA, 20 bp, Artificial Sequence
  Description of Artificial Sequence: Synthetic oligonucleotide
  Target: ATXN1; (-) strand; PAM type: NRG; PAM sequence: TGG
cctaagtcaagcctagcttt

SEQ ID NO: 77253 - DNA, 20 bp, Artificial Sequence
  Description of Artificial Sequence: Synthetic oligonucleotide
  Target: ATXN1; (-) strand; PAM type: NRG; PAM sequence: TAG
aatgaggcctaagtcaagcc

SEQ ID NO: 77254 - DNA, 20 bp, Artificial Sequence
  Description of Artificial Sequence: Synthetic oligonucleotide
  Target: ATXN1; (-) strand; PAM type: NRG; PAM sequence: AAG
ctccaaatgaggcctaagtc

SEQ ID NO: 77255 - DNA, 20 bp, Artificial Sequence
  Description of Artificial Sequence: Synthetic oligonucleotide
  Target: ATXN1; (-) strand; PAM type: NRG; PAM sequence: AAG
cagacctccaaatgaggcct

SEQ ID NO: 77256 - DNA, 20 bp, Artificial Sequence
  Description of Artificial Sequence: Synthetic oligonucleotide
  Target: ATXN1; (-) strand; PAM type: NRG; PAM sequence: AGG
tcaactcagacctccaaatg

SEQ ID NO: 77257 - DNA, 20 bp, Artificial Sequence
  Description of Artificial Sequence: Synthetic oligonucleotide
  Target: ATXN1; (-) strand; PAM type: NRG; PAM sequence: GAG
ttcaactcagacctccaaat

SEQ ID NO: 77258 - DNA, 20 bp, Artificial Sequence
  Description of Artificial Sequence: Synthetic oligonucleotide
  Target: ATXN1; (-) strand; PAM type: NRG; PAM sequence: CAG
ttgatttttgaaattcaact

SEQ ID NO: 77259 - DNA, 20 bp, Artificial Sequence
  Description of Artificial Sequence: Synthetic oligonucleotide
  Target: ATXN1; (-) strand; PAM type: NRG; PAM sequence: CAG
ctgcctctctaaacttctgc

SEQ ID NO: 77260 - DNA, 20 bp, Artificial Sequence
  Description of Artificial Sequence: Synthetic oligonucleotide
  Target: ATXN1; (-) strand; PAM type: NRG; PAM sequence: TGG
gcctcccgcgtcttttcttg

SEQ ID NO: 77261 - DNA, 20 bp, Artificial Sequence
  Description of Artificial Sequence: Synthetic oligonucleotide
  Target: ATXN1; (-) strand; PAM type: NRG; PAM sequence: AAG
tcctcctgcctgttctggtg

SEQ ID NO: 77262 - DNA, 20 bp, Artificial Sequence
  Description of Artificial Sequence: Synthetic oligonucleotide
  Target: ATXN1; (-) strand; PAM type: NRG; PAM sequence: TGG
ctacttcctcctgcctgttc

SEQ ID NO: 77263 - DNA, 20 bp, Artificial Sequence
  Description of Artificial Sequence: Synthetic oligonucleotide
  Target: ATXN1; (-) strand; PAM type: NRG; PAM sequence: TGG
accaggccagtttcacctgg

SEQ ID NO: 77264 - DNA, 20 bp, Artificial Sequence
  Description of Artificial Sequence: Synthetic oligonucleotide
  Target: ATXN1; (-) strand; PAM type: NRG; PAM sequence: TGG
gccaccaggccagtttcacc

SEQ ID NO: 77265 - DNA, 20 bp, Artificial Sequence
  Description of Artificial Sequence: Synthetic oligonucleotide
  Target: ATXN1; (-) strand; PAM type: NRG; PAM sequence: CAG
gtaccccacagccaccaggc

SEQ ID NO: 77266 - DNA, 20 bp, Artificial Sequence
  Description of Artificial Sequence: Synthetic oligonucleotide
  Target: ATXN1; (-) strand; PAM type: NRG; PAM sequence: AGG
ccctgtaccccacagccacc

SEQ ID NO: 77267 - DNA, 20 bp, Artificial Sequence
  Description of Artificial Sequence: Synthetic oligonucleotide
  Target: ATXN1; (-) strand; PAM type: NRG; PAM sequence: CAG
cccctgtaccccacagccac

SEQ ID NO: 77268 - DNA, 20 bp, Artificial Sequence
  Description of Artificial Sequence: Synthetic oligonucleotide
  Target: ATXN1; (-) strand; PAM type: NRG; PAM sequence: CAG
acctcttcccctgtacccca

SEQ ID NO: 77269 - DNA, 20 bp, Artificial Sequence
  Description of Artificial Sequence: Synthetic oligonucleotide
  Target: ATXN1; (-) strand; PAM type: NRG; PAM sequence: CAG
cactgtcctcatccccaccc

SEQ ID NO: 77270 - DNA, 20 bp, Artificial Sequence
  Description of Artificial Sequence: Synthetic oligonucleotide
  Target: ATXN1; (-) strand; PAM type: NRG; PAM sequence: GGG
gagaggcgcccctttgcatg

SEQ ID NO: 77271 - DNA, 20 bp, Artificial Sequence
  Description of Artificial Sequence: Synthetic oligonucleotide
  Target: ATXN1; (-) strand; PAM type: NRG; PAM sequence: GGG
ggagaggcgcccctttgcat

SEQ ID NO: 77272 - DNA, 20 bp, Artificial Sequence
  Description of Artificial Sequence: Synthetic oligonucleotide
  Target: ATXN1; (-) strand; PAM type: NRG; PAM sequence: TGG
cggagaggcgcccctttgca

SEQ ID NO: 77273 - DNA, 20 bp, Artificial Sequence
  Description of Artificial Sequence: Synthetic oligonucleotide
  Target: ATXN1; (-) strand; PAM type: NRG; PAM sequence: AGG
ccagtacctgtgtgacggag

SEQ ID NO: 77274 - DNA, 20 bp, Artificial Sequence
  Description of Artificial Sequence: Synthetic oligonucleotide
  Target: ATXN1; (-) strand; PAM type: NRG; PAM sequence: GAG
gccagtacctgtgtgacgga

SEQ ID NO: 77275 - DNA, 20 bp, Artificial Sequence
  Description of Artificial Sequence: Synthetic oligonucleotide
  Target: ATXN1; (-) strand; PAM type: NRG; PAM sequence: GAG
atgccagtacctgtgtgacg

SEQ ID NO: 77276 - DNA, 20 bp, Artificial Sequence
  Description of Artificial Sequence: Synthetic oligonucleotide
  Target: ATXN1; (-) strand; PAM type: NRG; PAM sequence: CGG
tcatgccagtacctgtgtga

SEQ ID NO: 77277 - DNA, 20 bp, Artificial Sequence
  Description of Artificial Sequence: Synthetic oligonucleotide
  Target: ATXN1; (-) strand; PAM type: NRG; PAM sequence: CAG
cggtccccacaccctcatgc

SEQ ID NO: 77278 - DNA, 20 bp, Artificial Sequence
  Description of Artificial Sequence: Synthetic oligonucleotide
  Target: ATXN1; (-) strand; PAM type: NRG; PAM sequence: CGG
acccaggaactcataggact

SEQ ID NO: 77279 - DNA, 20 bp, Artificial Sequence
  Description of Artificial Sequence: Synthetic oligonucleotide
  Target: ATXN1; (-) strand; PAM type: NRG; PAM sequence: AGG
gtagagacccaggaactcat

SEQ ID NO: 77280 - DNA, 20 bp, Artificial Sequence
  Description of Artificial Sequence: Synthetic oligonucleotide
  Target: ATXN1; (-) strand; PAM type: NRG; PAM sequence: TAG
ggtagagacccaggaactca

SEQ ID NO: 77281 - DNA, 20 bp, Artificial Sequence
  Description of Artificial Sequence: Synthetic oligonucleotide
  Target: ATXN1; (-) strand; PAM type: NRG; PAM sequence: AGG
gaaaatcctggtagagaccc

SEQ ID NO: 77282 - DNA, 20 bp, Artificial Sequence
  Description of Artificial Sequence: Synthetic oligonucleotide
  Target: ATXN1; (-) strand; PAM type: NRG; PAM sequence: CAG
ggaaaatcctggtagagacc

SEQ ID NO: 77283 - DNA, 20 bp, Artificial Sequence
  Description of Artificial Sequence: Synthetic oligonucleotide
  Target: ATXN1; (-) strand; PAM type: NRG; PAM sequence: GAG
tgacctggaaaatcctggta

SEQ ID NO: 77284 - DNA, 20 bp, Artificial Sequence
  Description of Artificial Sequence: Synthetic oligonucleotide
  Target: ATXN1; (-) strand; PAM type: NRG; PAM sequence: TAG
gctgacctggaaaatcctgg

SEQ ID NO: 77285 - DNA, 20 bp, Artificial Sequence
  Description of Artificial Sequence: Synthetic oligonucleotide
  Target: ATXN1; (-) strand; PAM type: NRG; PAM sequence: TGG
gatgctgacctggaaaatcc

SEQ ID NO: 77286 - DNA, 20 bp, Artificial Sequence
  Description of Artificial Sequence: Synthetic oligonucleotide
  Target: ATXN1; (-) strand; PAM type: NRG; PAM sequence: TGG
agtatcactcgatgctgacc

SEQ ID NO: 77287 - DNA, 20 bp, Artificial Sequence
  Description of Artificial Sequence: Synthetic oligonucleotide
  Target: ATXN1; (-) strand; PAM type: NRG; PAM sequence: TAG
cccaccacttctaggagaga

SEQ ID NO: 77288 - DNA, 20 bp, Artificial Sequence
  Description of Artificial Sequence: Synthetic oligonucleotide
  Target: ATXN1; (-) strand; PAM type: NRG; PAM sequence: GAG
agttcccaccacttctagga

SEQ ID NO: 77289 - DNA, 20 bp, Artificial Sequence
  Description of Artificial Sequence: Synthetic oligonucleotide
  Target: ATXN1; (-) strand; PAM type: NRG; PAM sequence: GAG
tcagttcccaccacttctag

SEQ ID NO: 77290 - DNA, 20 bp, Artificial Sequence
  Description of Artificial Sequence: Synthetic oligonucleotide
  Target: ATXN1; (-) strand; PAM type: NRG; PAM sequence: AGG
catcagttcccaccacttct

SEQ ID NO: 77291 - DNA, 20 bp, Artificial Sequence
  Description of Artificial Sequence: Synthetic oligonucleotide
  Target: ATXN1; (-) strand; PAM type: NRG; PAM sequence: TAG
ccatcagttcccaccacttc

SEQ ID NO: 77292 - DNA, 20 bp, Artificial Sequence
  Description of Artificial Sequence: Synthetic oligonucleotide
  Target: ATXN1; (-) strand; PAM type: NRG; PAM sequence: CAG
gcttccatggtcattcccat

SEQ ID NO: 77293 - DNA, 20 bp, Artificial Sequence
  Description of Artificial Sequence: Synthetic oligonucleotide
  Target: ATXN1; (-) strand; PAM type: NRG; PAM sequence: TGG
gtttgtggattcagcttcca

SEQ ID NO: 77294 - DNA, 20 bp, Artificial Sequence
  Description of Artificial Sequence: Synthetic oligonucleotide
  Target: ATXN1; (-) strand; PAM type: NRG; PAM sequence: CAG
agacccttggtttgtggatt

SEQ ID NO: 77295 - DNA, 20 bp, Artificial Sequence
  Description of Artificial Sequence: Synthetic oligonucleotide
  Target: ATXN1; (-) strand; PAM type: NRG; PAM sequence: TGG
ataaggagacccttggtttg

SEQ ID NO: 77296 - DNA, 20 bp, Artificial Sequence
  Description of Artificial Sequence: Synthetic oligonucleotide
  Target: ATXN1; (-) strand; PAM type: NRG; PAM sequence: TGG
ggacaagataaggagaccct

SEQ ID NO: 77297 - DNA, 20 bp, Artificial Sequence
  Description of Artificial Sequence: Synthetic oligonucleotide
  Target: ATXN1; (-) strand; PAM type: NRG; PAM sequence: GAG
ccatgagaggacaagataag

SEQ ID NO: 77298 - DNA, 20 bp, Artificial Sequence
  Description of Artificial Sequence: Synthetic oligonucleotide
  Target: ATXN1; (-) strand; PAM type: NRG; PAM sequence: AGG
atccatgagaggacaagata

SEQ ID NO: 77299 - DNA, 20 bp, Artificial Sequence
  Description of Artificial Sequence: Synthetic oligonucleotide
  Target: ATXN1; (-) strand; PAM type: NRG; PAM sequence: AAG
tatccatgagaggacaagat

SEQ ID NO: 77300 - DNA, 20 bp, Artificial Sequence
  Description of Artificial Sequence: Synthetic oligonucleotide
  Target: ATXN1; (-) strand; PAM type: NRG; PAM sequence: AAG
agccttatccatgagaggac

SEQ ID NO: 77301 - DNA, 20 bp, Artificial Sequence
  Description of Artificial Sequence: Synthetic oligonucleotide
  Target: ATXN1; (-) strand; PAM type: NRG; PAM sequence: AGG
tacgaagccttatccatgag

SEQ ID NO: 77302 - DNA, 20 bp, Artificial Sequence
  Description of Artificial Sequence: Synthetic oligonucleotide
  Target: ATXN1; (-) strand; PAM type: NRG; PAM sequence: GAG
ttacgaagccttatccatga

SEQ ID NO: 77303 - DNA, 20 bp, Artificial Sequence
  Description of Artificial Sequence: Synthetic oligonucleotide
  Target: ATXN1; (-) strand; PAM type: NRG; PAM sequence: GAG
ctttacgaagccttatccat

SEQ ID NO: 77304 - DNA, 20 bp, Artificial Sequence
  Description of Artificial Sequence: Synthetic oligonucleotide
  Target: ATXN1; (-) strand; PAM type: NRG; PAM sequence: AAG
tgaggaatcccccctttacg

SEQ ID NO: 77305 - DNA, 20 bp, Artificial Sequence
  Description of Artificial Sequence: Synthetic oligonucleotide
  Target: ATXN1; (-) strand; PAM type: NRG; PAM sequence: AGG
gacttggttaaaagaccttg

SEQ ID NO: 77306 - DNA, 20 bp, Artificial Sequence
  Description of Artificial Sequence: Synthetic oligonucleotide
  Target: ATXN1; (-) strand; PAM type: NRG; PAM sequence: GAG
agacttggttaaaagacctt

SEQ ID NO: 77307 - DNA, 20 bp, Artificial Sequence
  Description of Artificial Sequence: Synthetic oligonucleotide
  Target: ATXN1; (-) strand; PAM type: NRG; PAM sequence: AAG
ccatgtgcagacttggttaa

SEQ ID NO: 77308 - DNA, 20 bp, Artificial Sequence
  Description of Artificial Sequence: Synthetic oligonucleotide
  Target: ATXN1; (-) strand; PAM type: NRG; PAM sequence: TGG
ttttctcccatgtgcagact

SEQ ID NO: 77309 - DNA, 20 bp, Artificial Sequence
  Description of Artificial Sequence: Synthetic oligonucleotide
  Target: ATXN1; (-) strand; PAM type: NRG; PAM sequence: CAG
ccatcgttttctcccatgtg

SEQ ID NO: 77310 - DNA, 20 bp, Artificial Sequence
  Description of Artificial Sequence: Synthetic oligonucleotide
  Target: ATXN1; (-) strand; PAM type: NRG; PAM sequence: AAG
tgtattgagaggttcttgag

SEQ ID NO: 77311 - DNA, 20 bp, Artificial Sequence
  Description of Artificial Sequence: Synthetic oligonucleotide
  Target: ATXN1; (-) strand; PAM type: NRG; PAM sequence: GAG
ctttgtattgagaggttctt

SEQ ID NO: 77312 - DNA, 20 bp, Artificial Sequence
  Description of Artificial Sequence: Synthetic oligonucleotide
  Target: ATXN1; (-) strand; PAM type: NRG; PAM sequence: AGG
ctttatctctttgtattgag

SEQ ID NO: 77313 - DNA, 20 bp, Artificial Sequence
  Description of Artificial Sequence: Synthetic oligonucleotide
  Target: ATXN1; (-) strand; PAM type: NRG; PAM sequence: GAG
tctttatctctttgtattga

SEQ ID NO: 77314 - DNA, 20 bp, Artificial Sequence
  Description of Artificial Sequence: Synthetic oligonucleotide
  Target: ATXN1; (-) strand; PAM type: NRG; PAM sequence: GAG
cctctttatctctttgtatt

SEQ ID NO: 77315 - DNA, 20 bp, Artificial Sequence
  Description of Artificial Sequence: Synthetic oligonucleotide
  Target: ATXN1; (-) strand; PAM type: NRG; PAM sequence: TGG
acaggtgtgtgccatgtgcc

SEQ ID NO: 77316 - DNA, 20 bp, Artificial Sequence
  Description of Artificial Sequence: Synthetic oligonucleotide
  Target: ATXN1; (-) strand; PAM type: NRG; PAM sequence: AGG
ttccaaagtgctgaggttac

SEQ ID NO: 77317 - DNA, 20 bp, Artificial Sequence
  Description of Artificial Sequence: Synthetic oligonucleotide
  Target: ATXN1; (-) strand; PAM type: NRG; PAM sequence: CAG
cttccaaagtgctgaggtta

SEQ ID NO: 77318 - DNA, 20 bp, Artificial Sequence
  Description of Artificial Sequence: Synthetic oligonucleotide
  Target: ATXN1; (-) strand; PAM type: NRG; PAM sequence: AGG
cttggccttccaaagtgctg

SEQ ID NO: 77319 - DNA, 20 bp, Artificial Sequence
  Description of Artificial Sequence: Synthetic oligonucleotide
  Target: ATXN1; (-) strand; PAM type: NRG; PAM sequence: GAG
ccttggccttccaaagtgct

SEQ ID NO: 77320 - DNA, 20 bp, Artificial Sequence
  Description of Artificial Sequence: Synthetic oligonucleotide
  Target: ATXN1; (-) strand; PAM type: NRG; PAM sequence: AAG
cttccctccttggccttcca

SEQ ID NO: 77321 - DNA, 20 bp, Artificial Sequence
  Description of Artificial Sequence: Synthetic oligonucleotide
  Target: ATXN1; (-) strand; PAM type: NRG; PAM sequence: TGG
ctcaagtggtcttccctcct

SEQ ID NO: 77322 - DNA, 20 bp, Artificial Sequence
  Description of Artificial Sequence: Synthetic oligonucleotide
  Target: ATXN1; (-) strand; PAM type: NRG; PAM sequence: TGG
cttgaattcctgggctcaag

SEQ ID NO: 77323 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaattcctgggctc

SEQ ID NO: 77324 - DNA, 20 bp, Artificial Sequence
  Description of Artificial Sequence: Synthetic oligonucleotide
  Target: ATXN1; (-) strand; PAM type: NRG; PAM sequence: GGG
caggctggtcttgaattcct

SEQ ID NO: 77325 - DNA, 20 bp, Artificial Sequence
  Description of Artificial Sequence: Synthetic oligonucleotide
  Target: ATXN1; (-) strand; PAM type: NRG; PAM sequence: TGG
ccaggctggtcttgaattcc

SEQ ID NO: 77326 - DNA, 20 bp, Artificial Sequence
  Description of Artificial Sequence: Synthetic oligonucleotide
  Target: ATXN1; (-) strand; PAM type: NRG; PAM sequence: TGG
ttttgctgtgttgcccaggc

SEQ ID NO: 77327 - DNA, 20 bp, Artificial Sequence
  Description of Artificial Sequence: Synthetic oligonucleotide
  Target: ATXN1; (-) strand; PAM type: NRG; PAM sequence: AGG
agagttttgctgtgttgccc

SEQ ID NO: 77328 - DNA, 20 bp, Artificial Sequence
  Description of Artificial Sequence: Synthetic oligonucleotide
  Target: ATXN1; (-) strand; PAM type: NRG; PAM sequence: CAG
cagagttttgctgtgttgcc

SEQ ID NO: 77329 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 77330 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaga

SEQ ID NO: 77331 - DNA, 20 bp, Artificial Sequence
  Description of Artificial Sequence: Synthetic oligonucleotide
  Target: ATXN1; (-) strand; PAM type: NRG; PAM sequence: GAG
ttgttttttttttttttttt

SEQ ID NO: 77332 - DNA, 20 bp, Artificial Sequence
  Description of Artificial Sequence: Synthetic oligonucleotide
  Target: ATXN1; (-) strand; PAM type: NRG; PAM sequence: TAG
cagttgagtagctggaacta

SEQ ID NO: 77333 - DNA, 20 bp, Artificial Sequence
  Description of Artificial Sequence: Synthetic oligonucleotide
  Target: ATXN1; (-) strand; PAM type: NRG; PAM sequence: TGG
acctcagtcagttgagtagc

SEQ ID NO: 77334 - DNA, 20 bp, Artificial Sequence
  Description of Artificial Sequence: Synthetic oligonucleotide
  Target: ATXN1; (-) strand; PAM type: NRG; PAM sequence: TAG
taccacctcagtcagttgag

SEQ ID NO: 77335 - DNA, 20 bp, Artificial Sequence
  Description of Artificial Sequence: Synthetic oligonucleotide
  Target: ATXN1; (-) strand; PAM type: NRG; PAM sequence: GAG
tcctaccacctcagtcagtt

SEQ ID NO: 77336 - DNA, 20 bp, Artificial Sequence
  Description of Artificial Sequence: Synthetic oligonucleotide
  Target: ATXN1; (-) strand; PAM type: NRG; PAM sequence: CAG
aatggtcctaccacctcagt

SEQ ID NO: 77337 - DNA, 20 bp, Artificial Sequence
  Description of Artificial Sequence: Synthetic oligonucleotide
  Target: ATXN1; (-) strand; PAM type: NRG; PAM sequence: CAG
aagcaatggtcctaccacct

SEQ ID NO: 77338 - DNA, 20 bp, Artificial Sequence
  Description of Artificial Sequence: Synthetic oligonucleotide
  Target: ATXN1; (-) strand; PAM type: NRG; PAM sequence: TGG
gaactcctgggctcaagcaa

SEQ ID NO: 77339 - DNA, 20 bp, Artificial Sequence
  Description of Artificial Sequence: Synthetic oligonucleotide
  Target: ATXN1; (-) strand; PAM type: NRG; PAM sequence: AAG
agcctcgaactcctgggctc

SEQ ID NO: 77340 - DNA, 20 bp, Artificial Sequence
  Description of Artificial Sequence: Synthetic oligonucleotide
  Target: ATXN1; (-) strand; PAM type: NRG; PAM sequence: GGG
cattgcagcctcgaactcct

SEQ ID NO: 77341 - DNA, 20 bp, Artificial Sequence
  Description of Artificial Sequence: Synthetic oligonucleotide
  Target: ATXN1; (-) strand; PAM type: NRG; PAM sequence: TGG
tcattgcagcctcgaactcc

SEQ ID NO: 77342 - DNA, 20 bp, Artificial Sequence
  Description of Artificial Sequence: Synthetic oligonucleotide
  Target: ATXN1; (-) strand; PAM type: NRG; PAM sequence: CAG
gatacaattgtggttcattg

SEQ ID NO: 77343 - DNA, 20 bp, Artificial Sequence
  Description of Artificial Sequence: Synthetic oligonucleotide
  Target: ATXN1; (-) strand; PAM type: NRG; PAM sequence: TGG
ggagagcagtgatacaattg

SEQ ID NO: 77344 - DNA, 20 bp, Artificial Sequence
  Description of Artificial Sequence: Synthetic oligonucleotide
  Target: ATXN1; (-) strand; PAM type: NRG; PAM sequence: CAG
ccatcacccaggctggagag

SEQ ID NO: 77345 - DNA, 20 bp, Artificial Sequence
  Description of Artificial Sequence: Synthetic oligonucleotide
  Target: ATXN1; (-) strand; PAM type: NRG; PAM sequence: GAG
tctccatcacccaggctgga

SEQ ID NO: 77346 - DNA, 20 bp, Artificial Sequence
  Description of Artificial Sequence: Synthetic oligonucleotide
  Target: ATXN1; (-) strand; PAM type: NRG; PAM sequence: GAG
tctctccatcacccaggctg

SEQ ID NO: 77347 - DNA, 20 bp, Artificial Sequence
  Description of Artificial Sequence: Synthetic oligonucleotide
  Target: ATXN1; (-) strand; PAM type: NRG; PAM sequence: TGG
tctctctccatcacccaggc

SEQ ID NO: 77348 - DNA, 20 bp, Artificial Sequence
  Description of Artificial Sequence: Synthetic oligonucleotide
  Target: ATXN1; (-) strand; PAM type: NRG; PAM sequence: AGG
agggtctctctccatcaccc

SEQ ID NO: 77349 - DNA, 20 bp, Artificial Sequence
  Description of Artificial Sequence: Synthetic oligonucleotide
  Target: ATXN1; (-) strand; PAM type: NRG; PAM sequence: CAG
cagggtctctctccatcacc

SEQ ID NO: 77350 - DNA, 20 bp, Artificial Sequence
  Description of Artificial Sequence: Synthetic oligonucleotide
  Target: ATXN1; (-) strand; PAM type: NRG; PAM sequence: GGG
ttttcttttttttagataca

SEQ ID NO: 77351 - DNA, 20 bp, Artificial Sequence
  Description of Artificial Sequence: Synthetic oligonucleotide
  Target: ATXN1; (-) strand; PAM type: NRG; PAM sequence: AGG
gttttcttttttttagatac

SEQ ID NO: 77352 - DNA, 20 bp, Artificial Sequence
  Description of Artificial Sequence: Synthetic oligonucleotide
  Target: ATXN1; (-) strand; PAM type: NRG; PAM sequence: CAG
tgttttcttttttttagata

SEQ ID NO: 77353 - DNA, 20 bp, Artificial Sequence
  Description of Artificial Sequence: Synthetic oligonucleotide
  Target: ATXN1; (-) strand; PAM type: NRG; PAM sequence: TAG
taattttgttttcttttttt

SEQ ID NO: 77354 - DNA, 20 bp, Artificial Sequence
  Description of Artificial Sequence: Synthetic oligonucleotide
  Target: ATXN1; (-) strand; PAM type: NRG; PAM sequence: GAG
aagaggaacaacttcttcct

SEQ ID NO: 77355 - DNA, 20 bp, Artificial Sequence
  Description of Artificial Sequence: Synthetic oligonucleotide
  Target: ATXN1; (-) strand; PAM type: NRG; PAM sequence: AGG
caaaatccagttgtctgaag

SEQ ID NO: 77356 - DNA, 20 bp, Artificial Sequence
  Description of Artificial Sequence: Synthetic oligonucleotide
  Target: ATXN1; (-) strand; PAM type: NRG; PAM sequence: GAG
acaaaatccagttgtctgaa

SEQ ID NO: 77357 - DNA, 20 bp, Artificial Sequence
  Description of Artificial Sequence: Synthetic oligonucleotide
  Target: ATXN1; (-) strand; PAM type: NRG; PAM sequence: AAG
aaacaaaatccagttgtctg

SEQ ID NO: 77358 - DNA, 20 bp, Artificial Sequence
  Description of Artificial Sequence: Synthetic oligonucleotide
  Target: ATXN1; (-) strand; PAM type: NRG; PAM sequence: CAG
aaaagaagagaaacaaaatc

SEQ ID NO: 77359 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaaaaaaaagaa

SEQ ID NO: 77360 - DNA, 20 bp, Artificial Sequence
  Description of Artificial Sequence: Synthetic oligonucleotide
  Target: ATXN1; (-) strand; PAM type: NRG; PAM sequence: AAG
taaaaaaaaaaaaaaaaaag

SEQ ID NO: 77361 - DNA, 20 bp, Artificial Sequence
  Description of Artificial Sequence: Synthetic oligonucleotide
  Target: ATXN1; (-) strand; PAM type: NRG; PAM sequence: AAG
gtctaaaaaaaaaaaaaaaa

SEQ ID NO: 77362 - DNA, 20 bp, Artificial Sequence
  Description of Artificial Sequence: Synthetic oligonucleotide
  Target: ATXN1; (-) strand; PAM type: NRG; PAM sequence: AAG
tctagcctgggcaacaaagc

SEQ ID NO: 77363 - DNA, 20 bp, Artificial Sequence
  Description of Artificial Sequence: Synthetic oligonucleotide
  Target: ATXN1; (-) strand; PAM type: NRG; PAM sequence: AAG
gcactctagcctgggcaaca

SEQ ID NO: 77364 - DNA, 20 bp, Artificial Sequence
  Description of Artificial Sequence: Synthetic oligonucleotide
  Target: ATXN1; (-) strand; PAM type: NRG; PAM sequence: GGG
gtaccactgcactctagcct

SEQ ID NO: 77365 - DNA, 20 bp, Artificial Sequence
  Description of Artificial Sequence: Synthetic oligonucleotide
  Target: ATXN1; (-) strand; PAM type: NRG; PAM sequence: TGG
tgtaccactgcactctagcc

SEQ ID NO: 77366 - DNA, 20 bp, Artificial Sequence
  Description of Artificial Sequence: Synthetic oligonucleotide
  Target: ATXN1; (-) strand; PAM type: NRG; PAM sequence: TAG
ctgattgtaccactgcactc

SEQ ID NO: 77367 - DNA, 20 bp, Artificial Sequence
  Description of Artificial Sequence: Synthetic oligonucleotide
  Target: ATXN1; (-) strand; PAM type: NRG; PAM sequence: GAG
caggaggctgaggctgcagt

SEQ ID NO: 77368 - DNA, 20 bp, Artificial Sequence
  Description of Artificial Sequence: Synthetic oligonucleotide
  Target: ATXN1; (-) strand; PAM type: NRG; PAM sequence: CAG
gttccaggaggctgaggctg

SEQ ID NO: 77369 - DNA, 20 bp, Artificial Sequence
  Description of Artificial Sequence: Synthetic oligonucleotide
  Target: ATXN1; (-) strand; PAM type: NRG; PAM sequence: AGG
cacctggttccaggaggctg

SEQ ID NO: 77370 - DNA, 20 bp, Artificial Sequence
  Description of Artificial Sequence: Synthetic oligonucleotide
  Target: ATXN1; (-) strand; PAM type: NRG; PAM sequence: GAG
tcacctggttccaggaggct

SEQ ID NO: 77371 - DNA, 20 bp, Artificial Sequence
  Description of Artificial Sequence: Synthetic oligonucleotide
  Target: ATXN1; (-) strand; PAM type: NRG; PAM sequence: AGG
gaggatcacctggttccagg

SEQ ID NO: 77372 - DNA, 20 bp, Artificial Sequence
  Description of Artificial Sequence: Synthetic oligonucleotide
  Target: ATXN1; (-) strand; PAM type: NRG; PAM sequence: GAG
ggaggatcacctggttccag

SEQ ID NO: 77373 - DNA, 20 bp, Artificial Sequence
  Description of Artificial Sequence: Synthetic oligonucleotide
  Target: ATXN1; (-) strand; PAM type: NRG; PAM sequence: AGG
tgggaggatcacctggttcc

SEQ ID NO: 77374 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcacctggttc

SEQ ID NO: 77375 - DNA, 20 bp, Artificial Sequence
  Description of Artificial Sequence: Synthetic oligonucleotide
  Target: ATXN1; (-) strand; PAM type: NRG; PAM sequence: TGG
gctgaagtgggaggatcacc

SEQ ID NO: 77376 - DNA, 20 bp, Artificial Sequence
  Description of Artificial Sequence: Synthetic oligonucleotide
  Target: ATXN1; (-) strand; PAM type: NRG; PAM sequence: AGG
actcagaaggctgaagtggg

SEQ ID NO: 77377 - DNA, 20 bp, Artificial Sequence
  Description of Artificial Sequence: Synthetic oligonucleotide
  Target: ATXN1; (-) strand; PAM type: NRG; PAM sequence: GAG
tactcagaaggctgaagtgg

SEQ ID NO: 77378 - DNA, 20 bp, Artificial Sequence
  Description of Artificial Sequence: Synthetic oligonucleotide
  Target: ATXN1; (-) strand; PAM type: NRG; PAM sequence: GGG
gctactcagaaggctgaagt

SEQ ID NO: 77379 - DNA, 20 bp, Artificial Sequence
  Description of Artificial Sequence: Synthetic oligonucleotide
  Target: ATXN1; (-) strand; PAM type: NRG; PAM sequence: TGG
ggctactcagaaggctgaag

SEQ ID NO: 77380 - DNA, 20 bp, Artificial Sequence
  Description of Artificial Sequence: Synthetic oligonucleotide
  Target: ATXN1; (-) strand; PAM type: NRG; PAM sequence: AAG
cccggctactcagaaggctg

SEQ ID NO: 77381 - DNA, 20 bp, Artificial Sequence
  Description of Artificial Sequence: Synthetic oligonucleotide
  Target: ATXN1; (-) strand; PAM type: NRG; PAM sequence: AGG
tgtggtcccggctactcaga

SEQ ID NO: 77382 - DNA, 20 bp, Artificial Sequence
  Description of Artificial Sequence: Synthetic oligonucleotide
  Target: ATXN1; (-) strand; PAM type: NRG; PAM sequence: AAG
ctgtggtcccggctactcag

SEQ ID NO: 77383 - DNA, 20 bp, Artificial Sequence
  Description of Artificial Sequence: Synthetic oligonucleotide
  Target: ATXN1; (-) strand; PAM type: NRG; PAM sequence: CAG
tgcctgtggtcccggctact

SEQ ID NO: 77384 - DNA, 20 bp, Artificial Sequence
  Description of Artificial Sequence: Synthetic oligonucleotide
  Target: ATXN1; (-) strand; PAM type: NRG; PAM sequence: CGG
gtgatgtgtgcctgtggtcc

SEQ ID NO: 77385 - DNA, 20 bp, Artificial Sequence
  Description of Artificial Sequence: Synthetic oligonucleotide
  Target: ATXN1; (-) strand; PAM type: NRG; PAM sequence: TGG
ggcatggtgatgtgtgcctg

SEQ ID NO: 77386 - DNA, 20 bp, Artificial Sequence
  Description of Artificial Sequence: Synthetic oligonucleotide
  Target: ATXN1; (-) strand; PAM type: NRG; PAM sequence: TGG
tttttttaatcagccaggca

SEQ ID NO: 77387 - DNA, 20 bp, Artificial Sequence
  Description of Artificial Sequence: Synthetic oligonucleotide
  Target: ATXN1; (-) strand; PAM type: NRG; PAM sequence: AGG
ttttttttttttaatcagcc

SEQ ID NO: 77388 - DNA, 20 bp, Artificial Sequence
  Description of Artificial Sequence: Synthetic oligonucleotide
  Target: ATXN1; (-) strand; PAM type: NRG; PAM sequence: CAG
attttttttttttaatcagc

SEQ ID NO: 77389 - DNA, 20 bp, Artificial Sequence
  Description of Artificial Sequence: Synthetic oligonucleotide
  Target: ATXN1; (-) strand; PAM type: NRG; PAM sequence: CAG
ctacattttttttttttaat

SEQ ID NO: 77390 - DNA, 20 bp, Artificial Sequence
  Description of Artificial Sequence: Synthetic oligonucleotide
  Target: ATXN1; (-) strand; PAM type: NRG; PAM sequence: AGG
ctagcctgggcaacatagtg

SEQ ID NO: 77391 - DNA, 20 bp, Artificial Sequence
  Description of Artificial Sequence: Synthetic oligonucleotide
  Target: ATXN1; (-) strand; PAM type: NRG; PAM sequence: GAG
actagcctgggcaacatagt

SEQ ID NO: 77392 - DNA, 20 bp, Artificial Sequence
  Description of Artificial Sequence: Synthetic oligonucleotide
  Target: ATXN1; (-) strand; PAM type: NRG; PAM sequence: TAG
tgagactagcctgggcaaca

SEQ ID NO: 77393 - DNA, 20 bp, Artificial Sequence
  Description of Artificial Sequence: Synthetic oligonucleotide
  Target: ATXN1; (-) strand; PAM type: NRG; PAM sequence: GGG
caggagtttgagactagcct

SEQ ID NO: 77394 - DNA, 20 bp, Artificial Sequence
  Description of Artificial Sequence: Synthetic oligonucleotide
  Target: ATXN1; (-) strand; PAM type: NRG; PAM sequence: TGG
gcaggagtttgagactagcc

SEQ ID NO: 77395 - DNA, 20 bp, Artificial Sequence
  Description of Artificial Sequence: Synthetic oligonucleotide
  Target: ATXN1; (-) strand; PAM type: NRG; PAM sequence: TAG
ttagggcaggagtttgagac

SEQ ID NO: 77396 - DNA, 20 bp, Artificial Sequence
  Description of Artificial Sequence: Synthetic oligonucleotide
  Target: ATXN1; (-) strand; PAM type: NRG; PAM sequence: GAG
attgcttagggcaggagttt

SEQ ID NO: 77397 - DNA, 20 bp, Artificial Sequence
  Description of Artificial Sequence: Synthetic oligonucleotide
  Target: ATXN1; (-) strand; PAM type: NRG; PAM sequence: GAG
gggaggattgcttagggcag

SEQ ID NO: 77398 - DNA, 20 bp, Artificial Sequence
  Description of Artificial Sequence: Synthetic oligonucleotide
  Target: ATXN1; (-) strand; PAM type: NRG; PAM sequence: AGG
gtgggaggattgcttagggc

SEQ ID NO: 77399 - DNA, 20 bp, Artificial Sequence
  Description of Artificial Sequence: Synthetic oligonucleotide
  Target: ATXN1; (-) strand; PAM type: NRG; PAM sequence: CAG
agtgggaggattgcttaggg

SEQ ID NO: 77400 - DNA, 20 bp, Artificial Sequence
  Description of Artificial Sequence: Synthetic oligonucleotide
  Target: ATXN1; (-) strand; PAM type: NRG; PAM sequence: GGG
caaagtgggaggattgctta

SEQ ID NO: 77401 - DNA, 20 bp, Artificial Sequence
  Description of Artificial Sequence: Synthetic oligonucleotide
  Target: ATXN1; (-) strand; PAM type: NRG; PAM sequence: AGG
ccaaagtgggaggattgctt

SEQ ID NO: 77402 - DNA, 20 bp, Artificial Sequence
  Description of Artificial Sequence: Synthetic oligonucleotide
  Target: ATXN1; (-) strand; PAM type: NRG; PAM sequence: TAG
gccaaagtgggaggattgct

SEQ ID NO: 77403 - DNA, 20 bp, Artificial Sequence
  Description of Artificial Sequence: Synthetic oligonucleotide
  Target: ATXN1; (-) strand; PAM type: NRG; PAM sequence: AGG
ctttgtgaagccaaagtggg

SEQ ID NO: 77404 - DNA, 20 bp, Artificial Sequence
  Description of Artificial Sequence: Synthetic oligonucleotide
  Target: ATXN1; (-) strand; PAM type: NRG; PAM sequence: GAG
actttgtgaagccaaagtgg

SEQ ID NO: 77405 - DNA, 20 bp, Artificial Sequence
  Description of Artificial Sequence: Synthetic oligonucleotide
  Target: ATXN1; (-) strand; PAM type: NRG; PAM sequence: GGG
gcactttgtgaagccaaagt

SEQ ID NO: 77406 - DNA, 20 bp, Artificial Sequence
  Description of Artificial Sequence: Synthetic oligonucleotide
  Target: ATXN1; (-) strand; PAM type: NRG; PAM sequence: TGG
agcactttgtgaagccaaag

SEQ ID NO: 77407 - DNA, 20 bp, Artificial Sequence
  Description of Artificial Sequence: Synthetic oligonucleotide
  Target: ATXN1; (-) strand; PAM type: NRG; PAM sequence: AAG
tccagcactttgtgaagcca

SEQ ID NO: 77408 - DNA, 20 bp, Artificial Sequence
  Description of Artificial Sequence: Synthetic oligonucleotide
  Target: ATXN1; (-) strand; PAM type: NRG; PAM sequence: AAG
tgtatttccagcactttgtg

SEQ ID NO: 77409 - DNA, 20 bp, Artificial Sequence
  Description of Artificial Sequence: Synthetic oligonucleotide
  Target: ATXN1; (-) strand; PAM type: NRG; PAM sequence: CAG
gtggcttgagtgtgtatttc

SEQ ID NO: 77410 - DNA, 20 bp, Artificial Sequence
  Description of Artificial Sequence: Synthetic oligonucleotide
  Target: ATXN1; (-) strand; PAM type: NRG; PAM sequence: GAG
tcagctgggtgcagtggctt

SEQ ID NO: 77411 - DNA, 20 bp, Artificial Sequence
  Description of Artificial Sequence: Synthetic oligonucleotide
  Target: ATXN1; (-) strand; PAM type: NRG; PAM sequence: TGG
aggtggtcagctgggtgcag

SEQ ID NO: 77412 - DNA, 20 bp, Artificial Sequence
  Description of Artificial Sequence: Synthetic oligonucleotide
  Target: ATXN1; (-) strand; PAM type: NRG; PAM sequence: CAG
tccaggtggtcagctgggtg

SEQ ID NO: 77413 - DNA, 20 bp, Artificial Sequence
  Description of Artificial Sequence: Synthetic oligonucleotide
  Target: ATXN1; (-) strand; PAM type: NRG; PAM sequence: GGG
caaaatccaggtggtcagct

SEQ ID NO: 77414 - DNA, 20 bp, Artificial Sequence
  Description of Artificial Sequence: Synthetic oligonucleotide
  Target: ATXN1; (-) strand; PAM type: NRG; PAM sequence: TGG
ccaaaatccaggtggtcagc

SEQ ID NO: 77415 - DNA, 20 bp, Artificial Sequence
  Description of Artificial Sequence: Synthetic oligonucleotide
  Target: ATXN1; (-) strand; PAM type: NRG; PAM sequence: CAG
ttttccaaaatccaggtggt

SEQ ID NO: 77416 - DNA, 20 bp, Artificial Sequence
  Description of Artificial Sequence: Synthetic oligonucleotide
  Target: ATXN1; (-) strand; PAM type: NRG; PAM sequence: TGG
cctcttttccaaaatccagg

SEQ ID NO: 77417 - DNA, 20 bp, Artificial Sequence
  Description of Artificial Sequence: Synthetic oligonucleotide
  Target: ATXN1; (-) strand; PAM type: NRG; PAM sequence: AGG
tttcctcttttccaaaatcc

SEQ ID NO: 77418 - DNA, 20 bp, Artificial Sequence
  Description of Artificial Sequence: Synthetic oligonucleotide
  Target: ATXN1; (-) strand; PAM type: NRG; PAM sequence: CAG
ttttcctcttttccaaaatc

SEQ ID NO: 77419 - DNA, 20 bp, Artificial Sequence
  Description of Artificial Sequence: Synthetic oligonucleotide
  Target: ATXN1; (-) strand; PAM type: NRG; PAM sequence: CAG
tgattcccacatctaacagt

SEQ ID NO: 77420 - DNA, 20 bp, Artificial Sequence
  Description of Artificial Sequence: Synthetic oligonucleotide
  Target: ATXN1; (-) strand; PAM type: NRG; PAM sequence: CAG
catctgattcccacatctaa

SEQ ID NO: 77421 - DNA, 20 bp, Artificial Sequence
  Description of Artificial Sequence: Synthetic oligonucleotide
  Target: ATXN1; (-) strand; PAM type: NRG; PAM sequence: TAG
gatttgttttctaatgtctc

SEQ ID NO: 77422 - DNA, 20 bp, Artificial Sequence
  Description of Artificial Sequence: Synthetic oligonucleotide
  Target: ATXN1; (-) strand; PAM type: NRG; PAM sequence: CAG
caacactttttattgttcct

SEQ ID NO: 77423 - DNA, 20 bp, Artificial Sequence
  Description of Artificial Sequence: Synthetic oligonucleotide
  Target: ATXN1; (-) strand; PAM type: NRG; PAM sequence: AAG
agtggaagcagttcacgtaa

SEQ ID NO: 77424 - DNA, 20 bp, Artificial Sequence
  Description of Artificial Sequence: Synthetic oligonucleotide
  Target: ATXN1; (-) strand; PAM type: NRG; PAM sequence: CAG
taattgggcattagtggaag

SEQ ID NO: 77425 - DNA, 20 bp, Artificial Sequence
  Description of Artificial Sequence: Synthetic oligonucleotide
  Target: ATXN1; (-) strand; PAM type: NRG; PAM sequence: AAG
tagtaattgggcattagtgg

SEQ ID NO: 77426 - DNA, 20 bp, Artificial Sequence
  Description of Artificial Sequence: Synthetic oligonucleotide
  Target: ATXN1; (-) strand; PAM type: NRG; PAM sequence: TGG
gcatagtaattgggcattag

SEQ ID NO: 77427 - DNA, 20 bp, Artificial Sequence
  Description of Artificial Sequence: Synthetic oligonucleotide
  Target: ATXN1; (-) strand; PAM type: NRG; PAM sequence: TAG
gctgcatagtaattgggcat

SEQ ID NO: 77428 - DNA, 20 bp, Artificial Sequence
  Description of Artificial Sequence: Synthetic oligonucleotide
  Target: ATXN1; (-) strand; PAM type: NRG; PAM sequence: GGG
tactgtgctgcatagtaatt

SEQ ID NO: 77429 - DNA, 20 bp, Artificial Sequence
  Description of Artificial Sequence: Synthetic oligonucleotide
  Target: ATXN1; (-) strand; PAM type: NRG; PAM sequence: TGG
atactgtgctgcatagtaat

SEQ ID NO: 77430 - DNA, 20 bp, Artificial Sequence
  Description of Artificial Sequence: Synthetic oligonucleotide
  Target: ATXN1; (-) strand; PAM type: NRG; PAM sequence: TAG
taaattgatactgtgctgca

SEQ ID NO: 77431 - DNA, 20 bp, Artificial Sequence
  Description of Artificial Sequence: Synthetic oligonucleotide
  Target: ATXN1; (-) strand; PAM type: NRG; PAM sequence: TAG
aagtgagtcaatcggatacg

SEQ ID NO: 77432 - DNA, 20 bp, Artificial Sequence
  Description of Artificial Sequence: Synthetic oligonucleotide
  Target: ATXN1; (-) strand; PAM type: NRG; PAM sequence: CGG
acttatacaagtgagtcaat

SEQ ID NO: 77433 - DNA, 20 bp, Artificial Sequence
  Description of Artificial Sequence: Synthetic oligonucleotide
  Target: ATXN1; (-) strand; PAM type: NRG; PAM sequence: GAG
aaaatgtaacttatacaagt

SEQ ID NO: 77434 - DNA, 20 bp, Artificial Sequence
  Description of Artificial Sequence: Synthetic oligonucleotide
  Target: ATXN1; (-) strand; PAM type: NRG; PAM sequence: AAG
tcataaaatgtaacttatac

SEQ ID NO: 77435 - DNA, 20 bp, Artificial Sequence
  Description of Artificial Sequence: Synthetic oligonucleotide
  Target: ATXN1; (-) strand; PAM type: NRG; PAM sequence: TAG
tgaacatataaaggagaatt

SEQ ID NO: 77436 - DNA, 20 bp, Artificial Sequence
  Description of Artificial Sequence: Synthetic oligonucleotide
  Target: ATXN1; (-) strand; PAM type: NRG; PAM sequence: GAG
gggagcctgaacatataaag

SEQ ID NO: 77437 - DNA, 20 bp, Artificial Sequence
  Description of Artificial Sequence: Synthetic oligonucleotide
  Target: ATXN1; (-) strand; PAM type: NRG; PAM sequence: AGG
tagggagcctgaacatataa

SEQ ID NO: 77438 - DNA, 20 bp, Artificial Sequence
  Description of Artificial Sequence: Synthetic oligonucleotide
  Target: ATXN1; (-) strand; PAM type: NRG; PAM sequence: AAG
atagggagcctgaacatata

SEQ ID NO: 77439 - DNA, 20 bp, Artificial Sequence
  Description of Artificial Sequence: Synthetic oligonucleotide
  Target: ATXN1; (-) strand; PAM type: NRG; PAM sequence: GAG
tacacgcatcacaaaatagg

SEQ ID NO: 77440 - DNA, 20 bp, Artificial Sequence
  Description of Artificial Sequence: Synthetic oligonucleotide
  Target: ATXN1; (-) strand; PAM type: NRG; PAM sequence: GGG
attacacgcatcacaaaata

SEQ ID NO: 77441 - DNA, 20 bp, Artificial Sequence
  Description of Artificial Sequence: Synthetic oligonucleotide
  Target: ATXN1; (-) strand; PAM type: NRG; PAM sequence: AGG
aattacacgcatcacaaaat

SEQ ID NO: 77442 - DNA, 20 bp, Artificial Sequence
  Description of Artificial Sequence: Synthetic oligonucleotide
  Target: ATXN1; (-) strand; PAM type: NRG; PAM sequence: TAG
caattacacgcatcacaaaa

SEQ ID NO: 77443 - DNA, 20 bp, Artificial Sequence
  Description of Artificial Sequence: Synthetic oligonucleotide
  Target: ATXN1; (-) strand; PAM type: NRG; PAM sequence: AAG
caaggtccattctagctccc

SEQ ID NO: 77444 - DNA, 20 bp, Artificial Sequence
  Description of Artificial Sequence: Synthetic oligonucleotide
  Target: ATXN1; (-) strand; PAM type: NRG; PAM sequence: TAG
gatctcctcaaggtccattc

SEQ ID NO: 77445 - DNA, 20 bp, Artificial Sequence
  Description of Artificial Sequence: Synthetic oligonucleotide
  Target: ATXN1; (-) strand; PAM type: NRG; PAM sequence: AGG
tggcgtaagggatctcctca

SEQ ID NO: 77446 - DNA, 20 bp, Artificial Sequence
  Description of Artificial Sequence: Synthetic oligonucleotide
  Target: ATXN1; (-) strand; PAM type: NRG; PAM sequence: AAG
ttggcgtaagggatctcctc

SEQ ID NO: 77447 - DNA, 20 bp, Artificial Sequence
  Description of Artificial Sequence: Synthetic oligonucleotide
  Target: ATXN1; (-) strand; PAM type: NRG; PAM sequence: GGG
aagtgaaagcgttggcgtaa

SEQ ID NO: 77448 - DNA, 20 bp, Artificial Sequence
  Description of Artificial Sequence: Synthetic oligonucleotide
  Target: ATXN1; (-) strand; PAM type: NRG; PAM sequence: AGG
gaagtgaaagcgttggcgta

SEQ ID NO: 77449 - DNA, 20 bp, Artificial Sequence
  Description of Artificial Sequence: Synthetic oligonucleotide
  Target: ATXN1; (-) strand; PAM type: NRG; PAM sequence: AAG
tgaagtgaaagcgttggcgt

SEQ ID NO: 77450 - DNA, 20 bp, Artificial Sequence
  Description of Artificial Sequence: Synthetic oligonucleotide
  Target: ATXN1; (-) strand; PAM type: NRG; PAM sequence: TGG
catctgtgaagtgaaagcgt

SEQ ID NO: 77451 - DNA, 20 bp, Artificial Sequence
  Description of Artificial Sequence: Synthetic oligonucleotide
  Target: ATXN1; (-) strand; PAM type: NRG; PAM sequence: AAG
tgtctacatctgtgaagtga

SEQ ID NO: 77452 - DNA, 20 bp, Artificial Sequence
  Description of Artificial Sequence: Synthetic oligonucleotide
  Target: ATXN1; (-) strand; PAM type: NRG; PAM sequence: AAG
cctcggtgtctacatctgtg

SEQ ID NO: 77453 - DNA, 20 bp, Artificial Sequence
  Description of Artificial Sequence: Synthetic oligonucleotide
  Target: ATXN1; (-) strand; PAM type: NRG; PAM sequence: CGG
gtcataccctctttaagcct

SEQ ID NO: 77454 - DNA, 20 bp, Artificial Sequence
  Description of Artificial Sequence: Synthetic oligonucleotide
  Target: ATXN1; (-) strand; PAM type: NRG; PAM sequence: AAG
gggaaagtcataccctcttt

SEQ ID NO: 77455 - DNA, 20 bp, Artificial Sequence
  Description of Artificial Sequence: Synthetic oligonucleotide
  Target: ATXN1; (-) strand; PAM type: NRG; PAM sequence: AAG
gtcctcttgtggccttggga

SEQ ID NO: 77456 - DNA, 20 bp, Artificial Sequence
  Description of Artificial Sequence: Synthetic oligonucleotide
  Target: ATXN1; (-) strand; PAM type: NRG; PAM sequence: GGG
actagtcctcttgtggcctt

SEQ ID NO: 77457 - DNA, 20 bp, Artificial Sequence
  Description of Artificial Sequence: Synthetic oligonucleotide
  Target: ATXN1; (-) strand; PAM type: NRG; PAM sequence: TGG
aactagtcctcttgtggcct

SEQ ID NO: 77458 - DNA, 20 bp, Artificial Sequence
  Description of Artificial Sequence: Synthetic oligonucleotide
  Target: ATXN1; (-) strand; PAM type: NRG; PAM sequence: TGG
gctgtaaactagtcctcttg

SEQ ID NO: 77459 - DNA, 20 bp, Artificial Sequence
  Description of Artificial Sequence: Synthetic oligonucleotide
  Target: ATXN1; (-) strand; PAM type: NRG; PAM sequence: TAG
agcccagctctgctgtaaac

SEQ ID NO: 77460 - DNA, 20 bp, Artificial Sequence
  Description of Artificial Sequence: Synthetic oligonucleotide
  Target: ATXN1; (-) strand; PAM type: NRG; PAM sequence: CAG
gcagccctgttatataagcc

SEQ ID NO: 77461 - DNA, 20 bp, Artificial Sequence
  Description of Artificial Sequence: Synthetic oligonucleotide
  Target: ATXN1; (-) strand; PAM type: NRG; PAM sequence: AAG
catgggcagccctgttatat

SEQ ID NO: 77462 - DNA, 20 bp, Artificial Sequence
  Description of Artificial Sequence: Synthetic oligonucleotide
  Target: ATXN1; (-) strand; PAM type: NRG; PAM sequence: CAG
agccttgcagggctcatggg

SEQ ID NO: 77463 - DNA, 20 bp, Artificial Sequence
  Description of Artificial Sequence: Synthetic oligonucleotide
  Target: ATXN1; (-) strand; PAM type: NRG; PAM sequence: GGG
tggagccttgcagggctcat

SEQ ID NO: 77464 - DNA, 20 bp, Artificial Sequence
  Description of Artificial Sequence: Synthetic oligonucleotide
  Target: ATXN1; (-) strand; PAM type: NRG; PAM sequence: TGG
ctggagccttgcagggctca

SEQ ID NO: 77465 - DNA, 20 bp, Artificial Sequence
  Description of Artificial Sequence: Synthetic oligonucleotide
  Target: ATXN1; (-) strand; PAM type: NRG; PAM sequence: GGG
aatagctctggagccttgca

SEQ ID NO: 77466 - DNA, 20 bp, Artificial Sequence
  Description of Artificial Sequence: Synthetic oligonucleotide
  Target: ATXN1; (-) strand; PAM type: NRG; PAM sequence: AGG
gaatagctctggagccttgc

SEQ ID NO: 77467 - DNA, 20 bp, Artificial Sequence
  Description of Artificial Sequence: Synthetic oligonucleotide
  Target: ATXN1; (-) strand; PAM type: NRG; PAM sequence: CAG
agaatagctctggagccttg

SEQ ID NO: 77468 - DNA, 20 bp, Artificial Sequence
  Description of Artificial Sequence: Synthetic oligonucleotide
  Target: ATXN1; (-) strand; PAM type: NRG; PAM sequence: GAG
ggatcttaagaatagctctg

SEQ ID NO: 77469 - DNA, 20 bp, Artificial Sequence
  Description of Artificial Sequence: Synthetic oligonucleotide
  Target: ATXN1; (-) strand; PAM type: NRG; PAM sequence: TGG
gaggatcttaagaatagctc

SEQ ID NO: 77470 - DNA, 20 bp, Artificial Sequence
  Description of Artificial Sequence: Synthetic oligonucleotide
  Target: ATXN1; (-) strand; PAM type: NRG; PAM sequence: TAG
agtgcagaggatcttaagaa

SEQ ID NO: 77471 - DNA, 20 bp, Artificial Sequence
  Description of Artificial Sequence: Synthetic oligonucleotide
  Target: ATXN1; (-) strand; PAM type: NRG; PAM sequence: AAG
gtctaagtgcagaggatctt

SEQ ID NO: 77472 - DNA, 20 bp, Artificial Sequence
  Description of Artificial Sequence: Synthetic oligonucleotide
  Target: ATXN1; (-) strand; PAM type: NRG; PAM sequence: AGG
gcagcattgtctaagtgcag

SEQ ID NO: 77473 - DNA, 20 bp, Artificial Sequence
  Description of Artificial Sequence: Synthetic oligonucleotide
  Target: ATXN1; (-) strand; PAM type: NRG; PAM sequence: GAG
tgcagcattgtctaagtgca

SEQ ID NO: 77474 - DNA, 20 bp, Artificial Sequence
  Description of Artificial Sequence: Synthetic oligonucleotide
  Target: ATXN1; (-) strand; PAM type: NRG; PAM sequence: CAG
cctgcagcattgtctaagtg

SEQ ID NO: 77475 - DNA, 20 bp, Artificial Sequence
  Description of Artificial Sequence: Synthetic oligonucleotide
  Target: ATXN1; (-) strand; PAM type: NRG; PAM sequence: AAG
gtgtccctgcagcattgtct

SEQ ID NO: 77476 - DNA, 20 bp, Artificial Sequence
  Description of Artificial Sequence: Synthetic oligonucleotide
  Target: ATXN1; (-) strand; PAM type: NRG; PAM sequence: CAG
aagaagagagtgtgtccctg

SEQ ID NO: 77477 - DNA, 20 bp, Artificial Sequence
  Description of Artificial Sequence: Synthetic oligonucleotide
  Target: ATXN1; (-) strand; PAM type: NRG; PAM sequence: GAG
ttcttacaaaataaagaaga

SEQ ID NO: 77478 - DNA, 20 bp, Artificial Sequence
  Description of Artificial Sequence: Synthetic oligonucleotide
  Target: ATXN1; (-) strand; PAM type: NRG; PAM sequence: GAG
tgttcttacaaaataaagaa

SEQ ID NO: 77479 - DNA, 20 bp, Artificial Sequence
  Description of Artificial Sequence: Synthetic oligonucleotide
  Target: ATXN1; (-) strand; PAM type: NRG; PAM sequence: AAG
aatgttcttacaaaataaag

SEQ ID NO: 77480 - DNA, 20 bp, Artificial Sequence
  Description of Artificial Sequence: Synthetic oligonucleotide
  Target: ATXN1; (-) strand; PAM type: NRG; PAM sequence: AAG
gcaaatgttcttacaaaata

SEQ ID NO: 77481 - DNA, 20 bp, Artificial Sequence
  Description of Artificial Sequence: Synthetic oligonucleotide
  Target: ATXN1; (-) strand; PAM type: NRG; PAM sequence: GAG
tttgaataattttgaattgt

SEQ ID NO: 77482 - DNA, 20 bp, Artificial Sequence
  Description of Artificial Sequence: Synthetic oligonucleotide
  Target: ATXN1; (-) strand; PAM type: NRG; PAM sequence: GAG
gctccagcatctgaatccct

SEQ ID NO: 77483 - DNA, 20 bp, Artificial Sequence
  Description of Artificial Sequence: Synthetic oligonucleotide
  Target: ATXN1; (-) strand; PAM type: NRG; PAM sequence: CAG
agttgcttaaccaagagctc

SEQ ID NO: 77484 - DNA, 20 bp, Artificial Sequence
  Description of Artificial Sequence: Synthetic oligonucleotide
  Target: ATXN1; (-) strand; PAM type: NRG; PAM sequence: GAG
tccaaaagttgcttaaccaa

SEQ ID NO: 77485 - DNA, 20 bp, Artificial Sequence
  Description of Artificial Sequence: Synthetic oligonucleotide
  Target: ATXN1; (-) strand; PAM type: NRG; PAM sequence: AAG
gatccaaaagttgcttaacc

SEQ ID NO: 77486 - DNA, 20 bp, Artificial Sequence
  Description of Artificial Sequence: Synthetic oligonucleotide
  Target: ATXN1; (-) strand; PAM type: NRG; PAM sequence: AAG
ctaagtatcatatgatccaa

SEQ ID NO: 77487 - DNA, 20 bp, Artificial Sequence
  Description of Artificial Sequence: Synthetic oligonucleotide
  Target: ATXN1; (-) strand; PAM type: NRG; PAM sequence: AAG
agagagatggtagttcttct

SEQ ID NO: 77488 - DNA, 20 bp, Artificial Sequence
  Description of Artificial Sequence: Synthetic oligonucleotide
  Target: ATXN1; (-) strand; PAM type: NRG; PAM sequence: TAG
cttcttactgagagagatgg

SEQ ID NO: 77489 - DNA, 20 bp, Artificial Sequence
  Description of Artificial Sequence: Synthetic oligonucleotide
  Target: ATXN1; (-) strand; PAM type: NRG; PAM sequence: TGG
aatcttcttactgagagaga

SEQ ID NO: 77490 - DNA, 20 bp, Artificial Sequence
  Description of Artificial Sequence: Synthetic oligonucleotide
  Target: ATXN1; (-) strand; PAM type: NRG; PAM sequence: GAG
tgctaatcttcttactgaga

SEQ ID NO: 77491 - DNA, 20 bp, Artificial Sequence
  Description of Artificial Sequence: Synthetic oligonucleotide
  Target: ATXN1; (-) strand; PAM type: NRG; PAM sequence: GAG
cctgctaatcttcttactga

SEQ ID NO: 77492 - DNA, 20 bp, Artificial Sequence
  Description of Artificial Sequence: Synthetic oligonucleotide
  Target: ATXN1; (-) strand; PAM type: NRG; PAM sequence: GAG
ctcctgctaatcttcttact

SEQ ID NO: 77493 - DNA, 20 bp, Artificial Sequence
  Description of Artificial Sequence: Synthetic oligonucleotide
  Target: ATXN1; (-) strand; PAM type: NRG; PAM sequence: GGG
aagctttgaggctcatccta

SEQ ID NO: 77494 - DNA, 20 bp, Artificial Sequence
  Description of Artificial Sequence: Synthetic oligonucleotide
  Target: ATXN1; (-) strand; PAM type: NRG; PAM sequence: AGG
taagctttgaggctcatcct

SEQ ID NO: 77495 - DNA, 20 bp, Artificial Sequence
  Description of Artificial Sequence: Synthetic oligonucleotide
  Target: ATXN1; (-) strand; PAM type: NRG; PAM sequence: TAG
gtaagctttgaggctcatcc

SEQ ID NO: 77496 - DNA, 20 bp, Artificial Sequence
  Description of Artificial Sequence: Synthetic oligonucleotide
  Target: ATXN1; (-) strand; PAM type: NRG; PAM sequence: AGG
cacatagctagtaagctttg

SEQ ID NO: 77497 - DNA, 20 bp, Artificial Sequence
  Description of Artificial Sequence: Synthetic oligonucleotide
  Target: ATXN1; (-) strand; PAM type: NRG; PAM sequence: GAG
ccacatagctagtaagcttt

SEQ ID NO: 77498 - DNA, 20 bp, Artificial Sequence
  Description of Artificial Sequence: Synthetic oligonucleotide
  Target: ATXN1; (-) strand; PAM type: NRG; PAM sequence: AAG
ttccagaccacatagctagt

SEQ ID NO: 77499 - DNA, 20 bp, Artificial Sequence
  Description of Artificial Sequence: Synthetic oligonucleotide
  Target: ATXN1; (-) strand; PAM type: NRG; PAM sequence: TAG
cttgttccagaccacatagc

SEQ ID NO: 77500 - DNA, 20 bp, Artificial Sequence
  Description of Artificial Sequence: Synthetic oligonucleotide
  Target: ATXN1; (-) strand; PAM type: NRG; PAM sequence: TAG
atagcttgttccagaccaca

SEQ ID NO: 77501 - DNA, 20 bp, Artificial Sequence
  Description of Artificial Sequence: Synthetic oligonucleotide
  Target: ATXN1; (-) strand; PAM type: NRG; PAM sequence: CAG
caagtttctatagcttgttc

SEQ ID NO: 77502 - DNA, 20 bp, Artificial Sequence
  Description of Artificial Sequence: Synthetic oligonucleotide
  Target: ATXN1; (-) strand; PAM type: NRG; PAM sequence: TAG
atagacccggcaagtttcta

SEQ ID NO: 77503 - DNA, 20 bp, Artificial Sequence
  Description of Artificial Sequence: Synthetic oligonucleotide
  Target: ATXN1; (-) strand; PAM type: NRG; PAM sequence: AAG
taagggaatatagacccggc

SEQ ID NO: 77504 - DNA, 20 bp, Artificial Sequence
  Description of Artificial Sequence: Synthetic oligonucleotide
  Target: ATXN1; (-) strand; PAM type: NRG; PAM sequence: CGG
cggttaagggaatatagacc

SEQ ID NO: 77505 - DNA, 20 bp, Artificial Sequence
  Description of Artificial Sequence: Synthetic oligonucleotide
  Target: ATXN1; (-) strand; PAM type: NRG; PAM sequence: TAG
attttacggttaagggaata

SEQ ID NO: 77506 - DNA, 20 bp, Artificial Sequence
  Description of Artificial Sequence: Synthetic oligonucleotide
  Target: ATXN1; (-) strand; PAM type: NRG; PAM sequence: GGG
cttggccattttacggttaa

SEQ ID NO: 77507 - DNA, 20 bp, Artificial Sequence
  Description of Artificial Sequence: Synthetic oligonucleotide
  Target: ATXN1; (-) strand; PAM type: NRG; PAM sequence: AGG
tcttggccattttacggtta

SEQ ID NO: 77508 - DNA, 20 bp, Artificial Sequence
  Description of Artificial Sequence: Synthetic oligonucleotide
  Target: ATXN1; (-) strand; PAM type: NRG; PAM sequence: AAG
atcttggccattttacggtt

SEQ ID NO: 77509 - DNA, 20 bp, Artificial Sequence
  Description of Artificial Sequence: Synthetic oligonucleotide
  Target: ATXN1; (-) strand; PAM type: NRG; PAM sequence: CGG
tcgttatcttggccatttta

SEQ ID NO: 77510 - DNA, 20 bp, Artificial Sequence
  Description of Artificial Sequence: Synthetic oligonucleotide
  Target: ATXN1; (-) strand; PAM type: NRG; PAM sequence: TGG
cctggtcagtatcgttatct

SEQ ID NO: 77511 - DNA, 20 bp, Artificial Sequence
  Description of Artificial Sequence: Synthetic oligonucleotide
  Target: ATXN1; (-) strand; PAM type: NRG; PAM sequence: CAG
catgagacactacacctggt

SEQ ID NO: 77512 - DNA, 20 bp, Artificial Sequence
  Description of Artificial Sequence: Synthetic oligonucleotide
  Target: ATXN1; (-) strand; PAM type: NRG; PAM sequence: TGG
taggcatgagacactacacc

SEQ ID NO: 77513 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattataggcat

SEQ ID NO: 77514 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattat

SEQ ID NO: 77515 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtgctgggatta

SEQ ID NO: 77516 - DNA, 20 bp, Artificial Sequence
  Description of Artificial Sequence: Synthetic oligonucleotide
  Target: ATXN1; (-) strand; PAM type: NRG; PAM sequence: GGG
tctcagcctcccaaagtgct

SEQ ID NO: 77517 - DNA, 20 bp, Artificial Sequence
  Description of Artificial Sequence: Synthetic oligonucleotide
  Target: ATXN1; (-) strand; PAM type: NRG; PAM sequence: TGG
atctcagcctcccaaagtgc

SEQ ID NO: 77518 - DNA, 20 bp, Artificial Sequence
  Description of Artificial Sequence: Synthetic oligonucleotide
  Target: ATXN1; (-) strand; PAM type: NRG; PAM sequence: AAG
cctcccatctcagcctccca

SEQ ID NO: 77519 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatcctcccatct

SEQ ID NO: 77520 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaactcctgggctc

SEQ ID NO: 77521 - DNA, 20 bp, Artificial Sequence
  Description of Artificial Sequence: Synthetic oligonucleotide
  Target: ATXN1; (-) strand; PAM type: NRG; PAM sequence: GGG
caggctggtcttgaactcct

SEQ ID NO: 77522 - DNA, 20 bp, Artificial Sequence
  Description of Artificial Sequence: Synthetic oligonucleotide
  Target: ATXN1; (-) strand; PAM type: NRG; PAM sequence: TGG
ccaggctggtcttgaactcc

SEQ ID NO: 77523 - DNA, 20 bp, Artificial Sequence
  Description of Artificial Sequence: Synthetic oligonucleotide
  Target: ATXN1; (-) strand; PAM type: NRG; PAM sequence: TGG
gtctcacatgtttcccaggc

SEQ ID NO: 77524 - DNA, 20 bp, Artificial Sequence
  Description of Artificial Sequence: Synthetic oligonucleotide
  Target: ATXN1; (-) strand; PAM type: NRG; PAM sequence: AGG
tagggtctcacatgtttccc

SEQ ID NO: 77525 - DNA, 20 bp, Artificial Sequence
  Description of Artificial Sequence: Synthetic oligonucleotide
  Target: ATXN1; (-) strand; PAM type: NRG; PAM sequence: CAG
ttagggtctcacatgtttcc

SEQ ID NO: 77526 - DNA, 20 bp, Artificial Sequence
  Description of Artificial Sequence: Synthetic oligonucleotide
  Target: ATXN1; (-) strand; PAM type: NRG; PAM sequence: GGG
aaacattatttgtaaagtta

SEQ ID NO: 77527 - DNA, 20 bp, Artificial Sequence
  Description of Artificial Sequence: Synthetic oligonucleotide
  Target: ATXN1; (-) strand; PAM type: NRG; PAM sequence: AGG
taaacattatttgtaaagtt

SEQ ID NO: 77528 - DNA, 20 bp, Artificial Sequence
  Description of Artificial Sequence: Synthetic oligonucleotide
  Target: ATXN1; (-) strand; PAM type: NRG; PAM sequence: TAG
ttaaacattatttgtaaagt

SEQ ID NO: 77529 - DNA, 20 bp, Artificial Sequence
  Description of Artificial Sequence: Synthetic oligonucleotide
  Target: ATXN1; (-) strand; PAM type: NRG; PAM sequence: AAG
ttttttaaacattatttgta

SEQ ID NO: 77530 - DNA, 20 bp, Artificial Sequence
  Description of Artificial Sequence: Synthetic oligonucleotide
  Target: ATXN1; (-) strand; PAM type: NRG; PAM sequence: TGG
tatgtacgtgccaccacacc

SEQ ID NO: 77531 - DNA, 20 bp, Artificial Sequence
  Description of Artificial Sequence: Synthetic oligonucleotide
  Target: ATXN1; (-) strand; PAM type: NRG; PAM sequence: TGG
acctcatcctcctgagtatc

SEQ ID NO: 77532 - DNA, 20 bp, Artificial Sequence
  Description of Artificial Sequence: Synthetic oligonucleotide
  Target: ATXN1; (-) strand; PAM type: NRG; PAM sequence: GAG
tccccccacctcatcctcct

SEQ ID NO: 77533 - DNA, 20 bp, Artificial Sequence
  Description of Artificial Sequence: Synthetic oligonucleotide
  Target: ATXN1; (-) strand; PAM type: NRG; PAM sequence: AAG
agccttgaactcctgggttc

SEQ ID NO: 77534 - DNA, 20 bp, Artificial Sequence
  Description of Artificial Sequence: Synthetic oligonucleotide
  Target: ATXN1; (-) strand; PAM type: NRG; PAM sequence: GGG
cacagcagccttgaactcct

SEQ ID NO: 77535 - DNA, 20 bp, Artificial Sequence
  Description of Artificial Sequence: Synthetic oligonucleotide
  Target: ATXN1; (-) strand; PAM type: NRG; PAM sequence: TGG
tcacagcagccttgaactcc

SEQ ID NO: 77536 - DNA, 20 bp, Artificial Sequence
  Description of Artificial Sequence: Synthetic oligonucleotide
  Target: ATXN1; (-) strand; PAM type: NRG; PAM sequence: CAG
ggcgtgattgtacctcacag

SEQ ID NO: 77537 - DNA, 20 bp, Artificial Sequence
  Description of Artificial Sequence: Synthetic oligonucleotide
  Target: ATXN1; (-) strand; PAM type: NRG; PAM sequence: CAG
agtggcgtgattgtacctca

SEQ ID NO: 77538 - DNA, 20 bp, Artificial Sequence
  Description of Artificial Sequence: Synthetic oligonucleotide
  Target: ATXN1; (-) strand; PAM type: NRG; PAM sequence: TGG
tactccaggctggagtgcag

SEQ ID NO: 77539 - DNA, 20 bp, Artificial Sequence
  Description of Artificial Sequence: Synthetic oligonucleotide
  Target: ATXN1; (-) strand; PAM type: NRG; PAM sequence: CAG
ctgtactccaggctggagtg

SEQ ID NO: 77540 - DNA, 20 bp, Artificial Sequence
  Description of Artificial Sequence: Synthetic oligonucleotide
  Target: ATXN1; (-) strand; PAM type: NRG; PAM sequence: GAG
acacactgtactccaggctg

SEQ ID NO: 77541 - DNA, 20 bp, Artificial Sequence
  Description of Artificial Sequence: Synthetic oligonucleotide
  Target: ATXN1; (-) strand; PAM type: NRG; PAM sequence: TGG
tgacacactgtactccaggc

SEQ ID NO: 77542 - DNA, 20 bp, Artificial Sequence
  Description of Artificial Sequence: Synthetic oligonucleotide
  Target: ATXN1; (-) strand; PAM type: NRG; PAM sequence: AGG
agagtgacacactgtactcc

SEQ ID NO: 77543 - DNA, 20 bp, Artificial Sequence
  Description of Artificial Sequence: Synthetic oligonucleotide
  Target: ATXN1; (-) strand; PAM type: NRG; PAM sequence: CAG
cagagtgacacactgtactc

SEQ ID NO: 77544 - DNA, 20 bp, Artificial Sequence
  Description of Artificial Sequence: Synthetic oligonucleotide
  Target: ATXN1; (-) strand; PAM type: NRG; PAM sequence: GAG
agggtctcgctctgtctcca

SEQ ID NO: 77545 - DNA, 20 bp, Artificial Sequence
  Description of Artificial Sequence: Synthetic oligonucleotide
  Target: ATXN1; (-) strand; PAM type: NRG; PAM sequence: CAG
acagggtctcgctctgtctc

SEQ ID NO: 77546 - DNA, 20 bp, Artificial Sequence
  Description of Artificial Sequence: Synthetic oligonucleotide
  Target: ATXN1; (-) strand; PAM type: NRG; PAM sequence: GGG
gtttgtttgtttttgagaca

SEQ ID NO: 77547 - DNA, 20 bp, Artificial Sequence
  Description of Artificial Sequence: Synthetic oligonucleotide
  Target: ATXN1; (-) strand; PAM type: NRG; PAM sequence: AGG
tgtttgtttgtttttgagac

SEQ ID NO: 77548 - DNA, 20 bp, Artificial Sequence
  Description of Artificial Sequence: Synthetic oligonucleotide
  Target: ATXN1; (-) strand; PAM type: NRG; PAM sequence: CAG
ttgtttgtttgtttttgaga

SEQ ID NO: 77549 - DNA, 20 bp, Artificial Sequence
  Description of Artificial Sequence: Synthetic oligonucleotide
  Target: ATXN1; (-) strand; PAM type: NRG; PAM sequence: GAG
ctttttgtttgtttgttttt

SEQ ID NO: 77550 - DNA, 20 bp, Artificial Sequence
  Description of Artificial Sequence: Synthetic oligonucleotide
  Target: ATXN1; (-) strand; PAM type: NRG; PAM sequence: GAG
atctcatcccataactcttt

SEQ ID NO: 77551 - DNA, 20 bp, Artificial Sequence
  Description of Artificial Sequence: Synthetic oligonucleotide
  Target: ATXN1; (-) strand; PAM type: NRG; PAM sequence: TAG
tgtgctaggtgttctaaata

SEQ ID NO: 77552 - DNA, 20 bp, Artificial Sequence
  Description of Artificial Sequence: Synthetic oligonucleotide
  Target: ATXN1; (-) strand; PAM type: NRG; PAM sequence: AGG
ttgagcctatgtcctgtgct

SEQ ID NO: 77553 - DNA, 20 bp, Artificial Sequence
  Description of Artificial Sequence: Synthetic oligonucleotide
  Target: ATXN1; (-) strand; PAM type: NRG; PAM sequence: TAG
attgagcctatgtcctgtgc

SEQ ID NO: 77554 - DNA, 20 bp, Artificial Sequence
  Description of Artificial Sequence: Synthetic oligonucleotide
  Target: ATXN1; (-) strand; PAM type: NRG; PAM sequence: GAG
ttgaatactgaatattgatt

SEQ ID NO: 77555 - DNA, 20 bp, Artificial Sequence
  Description of Artificial Sequence: Synthetic oligonucleotide
  Target: ATXN1; (-) strand; PAM type: NRG; PAM sequence: AAG
ctatgtaaggagacatagta

SEQ ID NO: 77556 - DNA, 20 bp, Artificial Sequence
  Description of Artificial Sequence: Synthetic oligonucleotide
  Target: ATXN1; (-) strand; PAM type: NRG; PAM sequence: TAG
cagcactatgtaaggagaca

SEQ ID NO: 77557 - DNA, 20 bp, Artificial Sequence
  Description of Artificial Sequence: Synthetic oligonucleotide
  Target: ATXN1; (-) strand; PAM type: NRG; PAM sequence: GAG
tcttagcagcactatgtaag

SEQ ID NO: 77558 - DNA, 20 bp, Artificial Sequence
  Description of Artificial Sequence: Synthetic oligonucleotide
  Target: ATXN1; (-) strand; PAM type: NRG; PAM sequence: AGG
tttcttagcagcactatgta

SEQ ID NO: 77559 - DNA, 20 bp, Artificial Sequence
  Description of Artificial Sequence: Synthetic oligonucleotide
  Target: ATXN1; (-) strand; PAM type: NRG; PAM sequence: AAG
ctttcttagcagcactatgt

SEQ ID NO: 77560 - DNA, 20 bp, Artificial Sequence
  Description of Artificial Sequence: Synthetic oligonucleotide
  Target: ATXN1; (-) strand; PAM type: NRG; PAM sequence: CAG
cgcaggtgaggctttcttag

SEQ ID NO: 77561 - DNA, 20 bp, Artificial Sequence
  Description of Artificial Sequence: Synthetic oligonucleotide
  Target: ATXN1; (-) strand; PAM type: NRG; PAM sequence: TAG
gttcgcaggtgaggctttct

SEQ ID NO: 77562 - DNA, 20 bp, Artificial Sequence
  Description of Artificial Sequence: Synthetic oligonucleotide
  Target: ATXN1; (-) strand; PAM type: NRG; PAM sequence: AGG
atcacatgtgttcgcaggtg

SEQ ID NO: 77563 - DNA, 20 bp, Artificial Sequence
  Description of Artificial Sequence: Synthetic oligonucleotide
  Target: ATXN1; (-) strand; PAM type: NRG; PAM sequence: GAG
catcacatgtgttcgcaggt

SEQ ID NO: 77564 - DNA, 20 bp, Artificial Sequence
  Description of Artificial Sequence: Synthetic oligonucleotide
  Target: ATXN1; (-) strand; PAM type: NRG; PAM sequence: AGG
tacccatcacatgtgttcgc

SEQ ID NO: 77565 - DNA, 20 bp, Artificial Sequence
  Description of Artificial Sequence: Synthetic oligonucleotide
  Target: ATXN1; (-) strand; PAM type: NRG; PAM sequence: CAG
gtacccatcacatgtgttcg

SEQ ID NO: 77566 - DNA, 20 bp, Artificial Sequence
  Description of Artificial Sequence: Synthetic oligonucleotide
  Target: ATXN1; (-) strand; PAM type: NRG; PAM sequence: AGG
ggaaatacgtttcaccatcc

SEQ ID NO: 77567 - DNA, 20 bp, Artificial Sequence
  Description of Artificial Sequence: Synthetic oligonucleotide
  Target: ATXN1; (-) strand; PAM type: NRG; PAM sequence: CAG
tggaaatacgtttcaccatc

SEQ ID NO: 77568 - DNA, 20 bp, Artificial Sequence
  Description of Artificial Sequence: Synthetic oligonucleotide
  Target: ATXN1; (-) strand; PAM type: NRG; PAM sequence: TGG
aaataacttagacctggtct

SEQ ID NO: 77569 - DNA, 20 bp, Artificial Sequence
  Description of Artificial Sequence: Synthetic oligonucleotide
  Target: ATXN1; (-) strand; PAM type: NRG; PAM sequence: TGG
tccatgaaataacttagacc

SEQ ID NO: 77570 - DNA, 20 bp, Artificial Sequence
  Description of Artificial Sequence: Synthetic oligonucleotide
  Target: ATXN1; (-) strand; PAM type: NRG; PAM sequence: TAG
atagtatccatgaaataact

SEQ ID NO: 77571 - DNA, 20 bp, Artificial Sequence
  Description of Artificial Sequence: Synthetic oligonucleotide
  Target: ATXN1; (-) strand; PAM type: NRG; PAM sequence: TAG
taagataacattagatttca

SEQ ID NO: 77572 - DNA, 20 bp, Artificial Sequence
  Description of Artificial Sequence: Synthetic oligonucleotide
  Target: ATXN1; (-) strand; PAM type: NRG; PAM sequence: TAG
tttggatcttaagataacat

SEQ ID NO: 77573 - DNA, 20 bp, Artificial Sequence
  Description of Artificial Sequence: Synthetic oligonucleotide
  Target: ATXN1; (-) strand; PAM type: NRG; PAM sequence: AAG
tcctctgcactttggatctt

SEQ ID NO: 77574 - DNA, 20 bp, Artificial Sequence
  Description of Artificial Sequence: Synthetic oligonucleotide
  Target: ATXN1; (-) strand; PAM type: NRG; PAM sequence: TGG
tcttaagatcctctgcactt

SEQ ID NO: 77575 - DNA, 20 bp, Artificial Sequence
  Description of Artificial Sequence: Synthetic oligonucleotide
  Target: ATXN1; (-) strand; PAM type: NRG; PAM sequence: AAG
atggctccagagctattctt

SEQ ID NO: 77576 - DNA, 20 bp, Artificial Sequence
  Description of Artificial Sequence: Synthetic oligonucleotide
  Target: ATXN1; (-) strand; PAM type: NRG; PAM sequence: GAG
ttatcccctgcatggctcca

SEQ ID NO: 77577 - DNA, 20 bp, Artificial Sequence
  Description of Artificial Sequence: Synthetic oligonucleotide
  Target: ATXN1; (-) strand; PAM type: NRG; PAM sequence: CAG
cattatcccctgcatggctc

SEQ ID NO: 77578 - DNA, 20 bp, Artificial Sequence
  Description of Artificial Sequence: Synthetic oligonucleotide
  Target: ATXN1; (-) strand; PAM type: NRG; PAM sequence: TGG
gctgcccattatcccctgca

SEQ ID NO: 77579 - DNA, 20 bp, Artificial Sequence
  Description of Artificial Sequence: Synthetic oligonucleotide
  Target: ATXN1; (-) strand; PAM type: NRG; PAM sequence: GGG
acgaacaaacaaacaaaaca

SEQ ID NO: 77580 - DNA, 20 bp, Artificial Sequence
  Description of Artificial Sequence: Synthetic oligonucleotide
  Target: ATXN1; (-) strand; PAM type: NRG; PAM sequence: AGG
aacgaacaaacaaacaaaac

SEQ ID NO: 77581 - DNA, 20 bp, Artificial Sequence
  Description of Artificial Sequence: Synthetic oligonucleotide
  Target: ATXN1; (-) strand; PAM type: NRG; PAM sequence: CAG
aaacgaacaaacaaacaaaa

SEQ ID NO: 77582 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggcgacagagc

SEQ ID NO: 77583 - DNA, 20 bp, Artificial Sequence
  Description of Artificial Sequence: Synthetic oligonucleotide
  Target: ATXN1; (-) strand; PAM type: NRG; PAM sequence: GAG
ggactccagcctgggcgaca

SEQ ID NO: 77584 - DNA, 20 bp, Artificial Sequence
  Description of Artificial Sequence: Synthetic oligonucleotide
  Target: ATXN1; (-) strand; PAM type: NRG; PAM sequence: CAG
ccggactccagcctgggcga

SEQ ID NO: 77585 - DNA, 20 bp, Artificial Sequence
  Description of Artificial Sequence: Synthetic oligonucleotide
  Target: ATXN1; (-) strand; PAM type: NRG; PAM sequence: GGG
gcaccaccggactccagcct

SEQ ID NO: 77586 - DNA, 20 bp, Artificial Sequence
  Description of Artificial Sequence: Synthetic oligonucleotide
  Target: ATXN1; (-) strand; PAM type: NRG; PAM sequence: TGG
cgcaccaccggactccagcc

SEQ ID NO: 77587 - DNA, 20 bp, Artificial Sequence
  Description of Artificial Sequence: Synthetic oligonucleotide
  Target: ATXN1; (-) strand; PAM type: NRG; PAM sequence: CAG
gagatcgcaccaccggactc

SEQ ID NO: 77588 - DNA, 20 bp, Artificial Sequence
  Description of Artificial Sequence: Synthetic oligonucleotide
  Target: ATXN1; (-) strand; PAM type: NRG; PAM sequence: CGG
gtgagccgagatcgcaccac

SEQ ID NO: 77589 - DNA, 20 bp, Artificial Sequence
  Description of Artificial Sequence: Synthetic oligonucleotide
  Target: ATXN1; (-) strand; PAM type: NRG; PAM sequence: GAG
gtcggaggtcacagtgagcc

SEQ ID NO: 77590 - DNA, 20 bp, Artificial Sequence
  Description of Artificial Sequence: Synthetic oligonucleotide
  Target: ATXN1; (-) strand; PAM type: NRG; PAM sequence: GAG
caggagtcggaggtcacagt

SEQ ID NO: 77591 - DNA, 20 bp, Artificial Sequence
  Description of Artificial Sequence: Synthetic oligonucleotide
  Target: ATXN1; (-) strand; PAM type: NRG; PAM sequence: CAG
aacccaggagtcggaggtca

SEQ ID NO: 77592 - DNA, 20 bp, Artificial Sequence
  Description of Artificial Sequence: Synthetic oligonucleotide
  Target: ATXN1; (-) strand; PAM type: NRG; PAM sequence: AGG
cacttgaacccaggagtcgg

SEQ ID NO: 77593 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacccaggagtcg

SEQ ID NO: 77594 - DNA, 20 bp, Artificial Sequence
  Description of Artificial Sequence: Synthetic oligonucleotide
  Target: ATXN1; (-) strand; PAM type: NRG; PAM sequence: CGG
aatcacttgaacccaggagt

SEQ ID NO: 77595 - DNA, 20 bp, Artificial Sequence
  Description of Artificial Sequence: Synthetic oligonucleotide
  Target: ATXN1; (-) strand; PAM type: NRG; PAM sequence: GAG
ggagaatcacttgaacccag

SEQ ID NO: 77596 - DNA, 20 bp, Artificial Sequence
  Description of Artificial Sequence: Synthetic oligonucleotide
  Target: ATXN1; (-) strand; PAM type: NRG; PAM sequence: AGG
caggagaatcacttgaaccc

SEQ ID NO: 77597 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatcacttgaacc

SEQ ID NO: 77598 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 77599 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 77600 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 77601 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 77602 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 77603 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctacttggg

SEQ ID NO: 77604 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctacttgg

SEQ ID NO: 77605 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagctactt

SEQ ID NO: 77606 - DNA, 20 bp, Artificial Sequence
  Description of Artificial Sequence: Synthetic oligonucleotide
  Target: ATXN1; (-) strand; PAM type: NRG; PAM sequence: TGG
cgcctgtagtcccagctact

SEQ ID NO: 77607 - DNA, 20 bp, Artificial Sequence
  Description of Artificial Sequence: Synthetic oligonucleotide
  Target: ATXN1; (-) strand; PAM type: NRG; PAM sequence: CAG
gtggcaggcgcctgtagtcc

SEQ ID NO: 77608 - DNA, 20 bp, Artificial Sequence
  Description of Artificial Sequence: Synthetic oligonucleotide
  Target: ATXN1; (-) strand; PAM type: NRG; PAM sequence: TAG
ggtttggtggcaggcgcctg

SEQ ID NO: 77609 - DNA, 20 bp, Artificial Sequence
  Description of Artificial Sequence: Synthetic oligonucleotide
  Target: ATXN1; (-) strand; PAM type: NRG; PAM sequence: AGG
aattagccaggtttggtggc

SEQ ID NO: 77610 - DNA, 20 bp, Artificial Sequence
  Description of Artificial Sequence: Synthetic oligonucleotide
  Target: ATXN1; (-) strand; PAM type: NRG; PAM sequence: CAG
aaattagccaggtttggtgg

SEQ ID NO: 77611 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggtttgg

SEQ ID NO: 77612 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagccaggtt

SEQ ID NO: 77613 - DNA, 20 bp, Artificial Sequence
  Description of Artificial Sequence: Synthetic oligonucleotide
  Target: ATXN1; (-) strand; PAM type: NRG; PAM sequence: AGG
aaaaatacaaaaaattagcc

SEQ ID NO: 77614 - DNA, 20 bp, Artificial Sequence
  Description of Artificial Sequence: Synthetic oligonucleotide
  Target: ATXN1; (-) strand; PAM type: NRG; PAM sequence: CAG
taaaaatacaaaaaattagc

SEQ ID NO: 77615 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatacaaaaaat

SEQ ID NO: 77616 - DNA, 20 bp, Artificial Sequence
  Description of Artificial Sequence: Synthetic oligonucleotide
  Target: ATXN1; (-) strand; PAM type: NRG; PAM sequence: CGG
caagaccgtcctggctaaca

SEQ ID NO: 77617 - DNA, 20 bp, Artificial Sequence
  Description of Artificial Sequence: Synthetic oligonucleotide
  Target: ATXN1; (-) strand; PAM type: NRG; PAM sequence: TGG
tcaggagatcaagaccgtcc

SEQ ID NO: 77618 - DNA, 20 bp, Artificial Sequence
  Description of Artificial Sequence: Synthetic oligonucleotide
  Target: ATXN1; (-) strand; PAM type: NRG; PAM sequence: AAG
gatcacgaggtcaggagatc

SEQ ID NO: 77619 - DNA, 20 bp, Artificial Sequence
  Description of Artificial Sequence: Synthetic oligonucleotide
  Target: ATXN1; (-) strand; PAM type: NRG; PAM sequence: GAG
cgggcggatcacgaggtcag

SEQ ID NO: 77620 - DNA, 20 bp, Artificial Sequence
  Description of Artificial Sequence: Synthetic oligonucleotide
  Target: ATXN1; (-) strand; PAM type: NRG; PAM sequence: AGG
ggcgggcggatcacgaggtc

SEQ ID NO: 77621 - DNA, 20 bp, Artificial Sequence
  Description of Artificial Sequence: Synthetic oligonucleotide
  Target: ATXN1; (-) strand; PAM type: NRG; PAM sequence: CAG
aggcgggcggatcacgaggt

SEQ ID NO: 77622 - DNA, 20 bp, Artificial Sequence
  Description of Artificial Sequence: Synthetic oligonucleotide
  Target: ATXN1; (-) strand; PAM type: NRG; PAM sequence: AGG
gctgaggcgggcggatcacg

SEQ ID NO: 77623 - DNA, 20 bp, Artificial Sequence
  Description of Artificial Sequence: Synthetic oligonucleotide
  Target: ATXN1; (-) strand; PAM type: NRG; PAM sequence: GAG
ggctgaggcgggcggatcac

SEQ ID NO: 77624 - DNA, 20 bp, Artificial Sequence
  Description of Artificial Sequence: Synthetic oligonucleotide
  Target: ATXN1; (-) strand; PAM type: NRG; PAM sequence: CGG
cttcgggaggctgaggcggg

SEQ ID NO: 77625 - DNA, 20 bp, Artificial Sequence
  Description of Artificial Sequence: Synthetic oligonucleotide
  Target: ATXN1; (-) strand; PAM type: NRG; PAM sequence: GGG
gcacttcgggaggctgaggc

SEQ ID NO: 77626 - DNA, 20 bp, Artificial Sequence
  Description of Artificial Sequence: Synthetic oligonucleotide
  Target: ATXN1; (-) strand; PAM type: NRG; PAM sequence: CGG
agcacttcgggaggctgagg

SEQ ID NO: 77627 - DNA, 20 bp, Artificial Sequence
  Description of Artificial Sequence: Synthetic oligonucleotide
  Target: ATXN1; (-) strand; PAM type: NRG; PAM sequence: AGG
cccagcacttcgggaggctg

SEQ ID NO: 77628 - DNA, 20 bp, Artificial Sequence
  Description of Artificial Sequence: Synthetic oligonucleotide
  Target: ATXN1; (-) strand; PAM type: NRG; PAM sequence: GAG
tcccagcacttcgggaggct

SEQ ID NO: 77629 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcacttcggg

SEQ ID NO: 77630 - DNA, 20 bp, Artificial Sequence
  Description of Artificial Sequence: Synthetic oligonucleotide
  Target: ATXN1; (-) strand; PAM type: NRG; PAM sequence: GAG
ttgtaatcccagcacttcgg

SEQ ID NO: 77631 - DNA, 20 bp, Artificial Sequence
  Description of Artificial Sequence: Synthetic oligonucleotide
  Target: ATXN1; (-) strand; PAM type: NRG; PAM sequence: GGG
gcttgtaatcccagcacttc

SEQ ID NO: 77632 - DNA, 20 bp, Artificial Sequence
  Description of Artificial Sequence: Synthetic oligonucleotide
  Target: ATXN1; (-) strand; PAM type: NRG; PAM sequence: CGG
tgcttgtaatcccagcactt

SEQ ID NO: 77633 - DNA, 20 bp, Artificial Sequence
  Description of Artificial Sequence: Synthetic oligonucleotide
  Target: ATXN1; (-) strand; PAM type: NRG; PAM sequence: CAG
atggctcatgcttgtaatcc

SEQ ID NO: 77634 - DNA, 20 bp, Artificial Sequence
  Description of Artificial Sequence: Synthetic oligonucleotide
  Target: ATXN1; (-) strand; PAM type: NRG; PAM sequence: TGG
caatttagggccgggcgtga

SEQ ID NO: 77635 - DNA, 20 bp, Artificial Sequence
  Description of Artificial Sequence: Synthetic oligonucleotide
  Target: ATXN1; (-) strand; PAM type: NRG; PAM sequence: GGG
ccaaaattcaatttagggcc

SEQ ID NO: 77636 - DNA, 20 bp, Artificial Sequence
  Description of Artificial Sequence: Synthetic oligonucleotide
  Target: ATXN1; (-) strand; PAM type: NRG; PAM sequence: CGG
cccaaaattcaatttagggc

SEQ ID NO: 77637 - DNA, 20 bp, Artificial Sequence
  Description of Artificial Sequence: Synthetic oligonucleotide
  Target: ATXN1; (-) strand; PAM type: NRG; PAM sequence: GGG
ttcccccaaaattcaattta

SEQ ID NO: 77638 - DNA, 20 bp, Artificial Sequence
  Description of Artificial Sequence: Synthetic oligonucleotide
  Target: ATXN1; (-) strand; PAM type: NRG; PAM sequence: AGG
tttcccccaaaattcaattt

SEQ ID NO: 77639 - DNA, 20 bp, Artificial Sequence
  Description of Artificial Sequence: Synthetic oligonucleotide
  Target: ATXN1; (-) strand; PAM type: NRG; PAM sequence: TAG
ctttcccccaaaattcaatt

SEQ ID NO: 77640 - DNA, 20 bp, Artificial Sequence
  Description of Artificial Sequence: Synthetic oligonucleotide
  Target: ATXN1; (-) strand; PAM type: NRG; PAM sequence: TGG
acacacacacacacaactca

SEQ ID NO: 77641 - DNA, 20 bp, Artificial Sequence
  Description of Artificial Sequence: Synthetic oligonucleotide
  Target: ATXN1; (-) strand; PAM type: NRG; PAM sequence: AAG
agcctgcgcaataagagcaa

SEQ ID NO: 77642 - DNA, 20 bp, Artificial Sequence
  Description of Artificial Sequence: Synthetic oligonucleotide
  Target: ATXN1; (-) strand; PAM type: NRG; PAM sequence: GAG
tactccagcctgcgcaataa

SEQ ID NO: 77643 - DNA, 20 bp, Artificial Sequence
  Description of Artificial Sequence: Synthetic oligonucleotide
  Target: ATXN1; (-) strand; PAM type: NRG; PAM sequence: AAG
tgtactccagcctgcgcaat

SEQ ID NO: 77644 - DNA, 20 bp, Artificial Sequence
  Description of Artificial Sequence: Synthetic oligonucleotide
  Target: ATXN1; (-) strand; PAM type: NRG; PAM sequence: CAG
aagatcgcaccattgtactc

SEQ ID NO: 77645 - DNA, 20 bp, Artificial Sequence
  Description of Artificial Sequence: Synthetic oligonucleotide
  Target: ATXN1; (-) strand; PAM type: NRG; PAM sequence: AAG
ggcagaggttgcagtgagcc

SEQ ID NO: 77646 - DNA, 20 bp, Artificial Sequence
  Description of Artificial Sequence: Synthetic oligonucleotide
  Target: ATXN1; (-) strand; PAM type: NRG; PAM sequence: GAG
cgggaggcagaggttgcagt

SEQ ID NO: 77647 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggcagaggttg

SEQ ID NO: 77648 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccgggaggcag

SEQ ID NO: 77649 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccgggaggca

SEQ ID NO: 77650 - DNA, 20 bp, Artificial Sequence
  Description of Artificial Sequence: Synthetic oligonucleotide
  Target: ATXN1; (-) strand; PAM type: NRG; PAM sequence: CAG
aatcgcttgaacccgggagg

SEQ ID NO: 77651 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccggg

SEQ ID NO: 77652 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacccgg

SEQ ID NO: 77653 - DNA, 20 bp, Artificial Sequence
  Description of Artificial Sequence: Synthetic oligonucleotide
  Target: ATXN1; (-) strand; PAM type: NRG; PAM sequence: GGG
caggagaatcgcttgaaccc

SEQ ID NO: 77654 - DNA, 20 bp, Artificial Sequence
  Description of Artificial Sequence: Synthetic oligonucleotide
  Target: ATXN1; (-) strand; PAM type: NRG; PAM sequence: CGG
gcaggagaatcgcttgaacc

SEQ ID NO: 77655 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 77656 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 77657 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 77658 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 77659 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 77660 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 77661 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 77662 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagctactt

SEQ ID NO: 77663 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagctact

SEQ ID NO: 77664 - DNA, 20 bp, Artificial Sequence
  Description of Artificial Sequence: Synthetic oligonucleotide
  Target: ATXN1; (-) strand; PAM type: NRG; PAM sequence: CAG
ttggcgcatgcctgtaatcc

SEQ ID NO: 77665 - DNA, 20 bp, Artificial Sequence
  Description of Artificial Sequence: Synthetic oligonucleotide
  Target: ATXN1; (-) strand; PAM type: NRG; PAM sequence: TGG
aaaacattagctgggcatgt

SEQ ID NO: 77666 - DNA, 20 bp, Artificial Sequence
  Description of Artificial Sequence: Synthetic oligonucleotide
  Target: ATXN1; (-) strand; PAM type: NRG; PAM sequence: GGG
aaaaatacaaaacattagct

SEQ ID NO: 77667 - DNA, 20 bp, Artificial Sequence
  Description of Artificial Sequence: Synthetic oligonucleotide
  Target: ATXN1; (-) strand; PAM type: NRG; PAM sequence: TGG
taaaaatacaaaacattagc

SEQ ID NO: 77668 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatacaaaacat

SEQ ID NO: 77669 - DNA, 20 bp, Artificial Sequence
  Description of Artificial Sequence: Synthetic oligonucleotide
  Target: ATXN1; (-) strand; PAM type: NRG; PAM sequence: TGG
tgaggtcaggagttttaaac

SEQ ID NO: 77670 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcag

SEQ ID NO: 77671 - DNA, 20 bp, Artificial Sequence
  Description of Artificial Sequence: Synthetic oligonucleotide
  Target: ATXN1; (-) strand; PAM type: NRG; PAM sequence: AGG
cgggtggatcacctgaggtc

SEQ ID NO: 77672 - DNA, 20 bp, Artificial Sequence
  Description of Artificial Sequence: Synthetic oligonucleotide
  Target: ATXN1; (-) strand; PAM type: NRG; PAM sequence: CAG
gcgggtggatcacctgaggt

SEQ ID NO: 77673 - DNA, 20 bp, Artificial Sequence
  Description of Artificial Sequence: Synthetic oligonucleotide
  Target: ATXN1; (-) strand; PAM type: NRG; PAM sequence: AGG
caaggcgggtggatcacctg

SEQ ID NO: 77674 - DNA, 20 bp, Artificial Sequence
  Description of Artificial Sequence: Synthetic oligonucleotide
  Target: ATXN1; (-) strand; PAM type: NRG; PAM sequence: GAG
ccaaggcgggtggatcacct

SEQ ID NO: 77675 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccaaggcggg

SEQ ID NO: 77676 - DNA, 20 bp, Artificial Sequence
  Description of Artificial Sequence: Synthetic oligonucleotide
  Target: ATXN1; (-) strand; PAM type: NRG; PAM sequence: GGG
acactttgggaggccaaggc

SEQ ID NO: 77677 - DNA, 20 bp, Artificial Sequence
  Description of Artificial Sequence: Synthetic oligonucleotide
  Target: ATXN1; (-) strand; PAM type: NRG; PAM sequence: CGG
aacactttgggaggccaagg

SEQ ID NO: 77678 - DNA, 20 bp, Artificial Sequence
  Description of Artificial Sequence: Synthetic oligonucleotide
  Target: ATXN1; (-) strand; PAM type: NRG; PAM sequence: AGG
cccaacactttgggaggcca

SEQ ID NO: 77679 - DNA, 20 bp, Artificial Sequence
  Description of Artificial Sequence: Synthetic oligonucleotide
  Target: ATXN1; (-) strand; PAM type: NRG; PAM sequence: AAG
tcccaacactttgggaggcc

SEQ ID NO: 77680 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccaacactttggg

SEQ ID NO: 77681 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccaacactttgg

SEQ ID NO: 77682 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccaacacttt

SEQ ID NO: 77683 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccaacactt

SEQ ID NO: 77684 - DNA, 20 bp, Artificial Sequence
  Description of Artificial Sequence: Synthetic oligonucleotide
  Target: ATXN1; (-) strand; PAM type: NRG; PAM sequence: TGG
ggctgcctggccggacgcgg

SEQ ID NO: 77685 - DNA, 20 bp, Artificial Sequence
  Description of Artificial Sequence: Synthetic oligonucleotide
  Target: ATXN1; (-) strand; PAM type: NRG; PAM sequence: CGG
cagggctgcctggccggacg

SEQ ID NO: 77686 - DNA, 20 bp, Artificial Sequence
  Description of Artificial Sequence: Synthetic oligonucleotide
  Target: ATXN1; (-) strand; PAM type: NRG; PAM sequence: CGG
atataacagggctgcctggc

SEQ ID NO: 77687 - DNA, 20 bp, Artificial Sequence
  Description of Artificial Sequence: Synthetic oligonucleotide
  Target: ATXN1; (-) strand; PAM type: NRG; PAM sequence: TGG
gcttatataacagggctgcc

SEQ ID NO: 77688 - DNA, 20 bp, Artificial Sequence
  Description of Artificial Sequence: Synthetic oligonucleotide
  Target: ATXN1; (-) strand; PAM type: NRG; PAM sequence: GGG
agagctgggcttatataaca

SEQ ID NO: 77689 - DNA, 20 bp, Artificial Sequence
  Description of Artificial Sequence: Synthetic oligonucleotide
  Target: ATXN1; (-) strand; PAM type: NRG; PAM sequence: AGG
cagagctgggcttatataac

SEQ ID NO: 77690 - DNA, 20 bp, Artificial Sequence
  Description of Artificial Sequence: Synthetic oligonucleotide
  Target: ATXN1; (-) strand; PAM type: NRG; PAM sequence: CAG
gcagagctgggcttatataa

SEQ ID NO: 77691 - DNA, 20 bp, Artificial Sequence
  Description of Artificial Sequence: Synthetic oligonucleotide
  Target: ATXN1; (-) strand; PAM type: NRG; PAM sequence: GGG
gactagtttacagcagagct

SEQ ID NO: 77692 - DNA, 20 bp, Artificial Sequence
  Description of Artificial Sequence: Synthetic oligonucleotide
  Target: ATXN1; (-) strand; PAM type: NRG; PAM sequence: TGG
ggactagtttacagcagagc

SEQ ID NO: 77693 - DNA, 20 bp, Artificial Sequence
  Description of Artificial Sequence: Synthetic oligonucleotide
  Target: ATXN1; (-) strand; PAM type: NRG; PAM sequence: GAG
caaaggactagtttacagca

SEQ ID NO: 77694 - DNA, 20 bp, Artificial Sequence
  Description of Artificial Sequence: Synthetic oligonucleotide
  Target: ATXN1; (-) strand; PAM type: NRG; PAM sequence: CAG
cacaaaggactagtttacag

SEQ ID NO: 77695 - DNA, 20 bp, Artificial Sequence
  Description of Artificial Sequence: Synthetic oligonucleotide
  Target: ATXN1; (-) strand; PAM type: NRG; PAM sequence: CAG
ggccacaaaggactagttta

SEQ ID NO: 77696 - DNA, 20 bp, Artificial Sequence
  Description of Artificial Sequence: Synthetic oligonucleotide
  Target: ATXN1; (-) strand; PAM type: NRG; PAM sequence: TAG
ttcccaaggccacaaaggac

SEQ ID NO: 77697 - DNA, 20 bp, Artificial Sequence
  Description of Artificial Sequence: Synthetic oligonucleotide
  Target: ATXN1; (-) strand; PAM type: NRG; PAM sequence: AGG
taactttcccaaggccacaa

SEQ ID NO: 77698 - DNA, 20 bp, Artificial Sequence
  Description of Artificial Sequence: Synthetic oligonucleotide
  Target: ATXN1; (-) strand; PAM type: NRG; PAM sequence: AAG
ataactttcccaaggccaca

SEQ ID NO: 77699 - DNA, 20 bp, Artificial Sequence
  Description of Artificial Sequence: Synthetic oligonucleotide
  Target: ATXN1; (-) strand; PAM type: NRG; PAM sequence: AGG
gagagggtataactttccca

SEQ ID NO: 77700 - DNA, 20 bp, Artificial Sequence
  Description of Artificial Sequence: Synthetic oligonucleotide
  Target: ATXN1; (-) strand; PAM type: NRG; PAM sequence: AAG
agagagggtataactttccc

SEQ ID NO: 77701 - DNA, 20 bp, Artificial Sequence
  Description of Artificial Sequence: Synthetic oligonucleotide
  Target: ATXN1; (-) strand; PAM type: NRG; PAM sequence: GGG
tagaaactgaggcttagaga

SEQ ID NO: 77702 - DNA, 20 bp, Artificial Sequence
  Description of Artificial Sequence: Synthetic oligonucleotide
  Target: ATXN1; (-) strand; PAM type: NRG; PAM sequence: AGG
gtagaaactgaggcttagag

SEQ ID NO: 77703 - DNA, 20 bp, Artificial Sequence
  Description of Artificial Sequence: Synthetic oligonucleotide
  Target: ATXN1; (-) strand; PAM type: NRG; PAM sequence: GAG
tgtagaaactgaggcttaga

SEQ ID NO: 77704 - DNA, 20 bp, Artificial Sequence
  Description of Artificial Sequence: Synthetic oligonucleotide
  Target: ATXN1; (-) strand; PAM type: NRG; PAM sequence: GAG
gatgtagaaactgaggctta

SEQ ID NO: 77705 - DNA, 20 bp, Artificial Sequence
  Description of Artificial Sequence: Synthetic oligonucleotide
  Target: ATXN1; (-) strand; PAM type: NRG; PAM sequence: TAG
cagatgtagaaactgaggct

SEQ ID NO: 77706 - DNA, 20 bp, Artificial Sequence
  Description of Artificial Sequence: Synthetic oligonucleotide
  Target: ATXN1; (-) strand; PAM type: NRG; PAM sequence: AGG
cttcacagatgtagaaactg

SEQ ID NO: 77707 - DNA, 20 bp, Artificial Sequence
  Description of Artificial Sequence: Synthetic oligonucleotide
  Target: ATXN1; (-) strand; PAM type: NRG; PAM sequence: GAG
acttcacagatgtagaaact

SEQ ID NO: 77708 - DNA, 20 bp, Artificial Sequence
  Description of Artificial Sequence: Synthetic oligonucleotide
  Target: ATXN1; (-) strand; PAM type: NRG; PAM sequence: TAG
accctttcacttcacagatg

SEQ ID NO: 77709 - DNA, 20 bp, Artificial Sequence
  Description of Artificial Sequence: Synthetic oligonucleotide
  Target: ATXN1; (-) strand; PAM type: NRG; PAM sequence: CAG
acgccaaccctttcacttca

SEQ ID NO: 77710 - DNA, 20 bp, Artificial Sequence
  Description of Artificial Sequence: Synthetic oligonucleotide
  Target: ATXN1; (-) strand; PAM type: NRG; PAM sequence: AGG
agctagaatggaccttggag

SEQ ID NO: 77711 - DNA, 20 bp, Artificial Sequence
  Description of Artificial Sequence: Synthetic oligonucleotide
  Target: ATXN1; (-) strand; PAM type: NRG; PAM sequence: GAG
gagctagaatggaccttgga

SEQ ID NO: 77712 - DNA, 20 bp, Artificial Sequence
  Description of Artificial Sequence: Synthetic oligonucleotide
  Target: ATXN1; (-) strand; PAM type: NRG; PAM sequence: GAG
gggagctagaatggaccttg

SEQ ID NO: 77713 - DNA, 20 bp, Artificial Sequence
  Description of Artificial Sequence: Synthetic oligonucleotide
  Target: ATXN1; (-) strand; PAM type: NRG; PAM sequence: TGG
ttgggagctagaatggacct

SEQ ID NO: 77714 - DNA, 20 bp, Artificial Sequence
  Description of Artificial Sequence: Synthetic oligonucleotide
  Target: ATXN1; (-) strand; PAM type: NRG; PAM sequence: TGG
gcagaacttgggagctagaa

SEQ ID NO: 77715 - DNA, 20 bp, Artificial Sequence
  Description of Artificial Sequence: Synthetic oligonucleotide
  Target: ATXN1; (-) strand; PAM type: NRG; PAM sequence: TAG
taattgcagaacttgggagc

SEQ ID NO: 77716 - DNA, 20 bp, Artificial Sequence
  Description of Artificial Sequence: Synthetic oligonucleotide
  Target: ATXN1; (-) strand; PAM type: NRG; PAM sequence: GAG
cacataattgcagaacttgg

SEQ ID NO: 77717 - DNA, 20 bp, Artificial Sequence
  Description of Artificial Sequence: Synthetic oligonucleotide
  Target: ATXN1; (-) strand; PAM type: NRG; PAM sequence: GGG
tgcacataattgcagaactt

SEQ ID NO: 77718 - DNA, 20 bp, Artificial Sequence
  Description of Artificial Sequence: Synthetic oligonucleotide
  Target: ATXN1; (-) strand; PAM type: NRG; PAM sequence: TGG
atgcacataattgcagaact

SEQ ID NO: 77719 - DNA, 20 bp, Artificial Sequence
  Description of Artificial Sequence: Synthetic oligonucleotide
  Target: ATXN1; (-) strand; PAM type: NRG; PAM sequence: CAG
ttttgtgatgcacataattg

SEQ ID NO: 77720 - DNA, 20 bp, Artificial Sequence
  Description of Artificial Sequence: Synthetic oligonucleotide
  Target: ATXN1; (-) strand; PAM type: NRG; PAM sequence: AGG
taattctcccttatatgtcc

SEQ ID NO: 77721 - DNA, 20 bp, Artificial Sequence
  Description of Artificial Sequence: Synthetic oligonucleotide
  Target: ATXN1; (-) strand; PAM type: NRG; PAM sequence: CAG
ttaattctcccttatatgtc

SEQ ID NO: 77722 - DNA, 20 bp, Artificial Sequence
  Description of Artificial Sequence: Synthetic oligonucleotide
  Target: ATXN1; (-) strand; PAM type: NRG; PAM sequence: TGG
gcagcgcaatatcaattaag

SEQ ID NO: 77723 - DNA, 20 bp, Artificial Sequence
  Description of Artificial Sequence: Synthetic oligonucleotide
  Target: ATXN1; (-) strand; PAM type: NRG; PAM sequence: AAG
catgcagcgcaatatcaatt

SEQ ID NO: 77724 - DNA, 20 bp, Artificial Sequence
  Description of Artificial Sequence: Synthetic oligonucleotide
  Target: ATXN1; (-) strand; PAM type: NRG; PAM sequence: CAG
ttccaagctcaattaccatg

SEQ ID NO: 77725 - DNA, 20 bp, Artificial Sequence
  Description of Artificial Sequence: Synthetic oligonucleotide
  Target: ATXN1; (-) strand; PAM type: NRG; PAM sequence: AAG
cacattgggacatgctttcc

SEQ ID NO: 77726 - DNA, 20 bp, Artificial Sequence
  Description of Artificial Sequence: Synthetic oligonucleotide
  Target: ATXN1; (-) strand; PAM type: NRG; PAM sequence: GGG
gaatataacactgacacatt

SEQ ID NO: 77727 - DNA, 20 bp, Artificial Sequence
  Description of Artificial Sequence: Synthetic oligonucleotide
  Target: ATXN1; (-) strand; PAM type: NRG; PAM sequence: TGG
tgaatataacactgacacat

SEQ ID NO: 77728 - DNA, 20 bp, Artificial Sequence
  Description of Artificial Sequence: Synthetic oligonucleotide
  Target: ATXN1; (-) strand; PAM type: NRG; PAM sequence: AAG
gacactgacattccattttg

SEQ ID NO: 77729 - DNA, 20 bp, Artificial Sequence
  Description of Artificial Sequence: Synthetic oligonucleotide
  Target: ATXN1; (-) strand; PAM type: NRG; PAM sequence: CAG
tttggatttcccacccaccc

SEQ ID NO: 77730 - DNA, 20 bp, Artificial Sequence
  Description of Artificial Sequence: Synthetic oligonucleotide
  Target: ATXN1; (-) strand; PAM type: NRG; PAM sequence: TGG
tcactcttagaacttccctt

SEQ ID NO: 77731 - DNA, 20 bp, Artificial Sequence
  Description of Artificial Sequence: Synthetic oligonucleotide
  Target: ATXN1; (-) strand; PAM type: NRG; PAM sequence: TAG
atggaaacaggcttcactct

SEQ ID NO: 77732 - DNA, 20 bp, Artificial Sequence
  Description of Artificial Sequence: Synthetic oligonucleotide
  Target: ATXN1; (-) strand; PAM type: NRG; PAM sequence: AGG
ttgacctatcagatggaaac

SEQ ID NO: 77733 - DNA, 20 bp, Artificial Sequence
  Description of Artificial Sequence: Synthetic oligonucleotide
  Target: ATXN1; (-) strand; PAM type: NRG; PAM sequence: CAG
tttgacctatcagatggaaa

SEQ ID NO: 77734 - DNA, 20 bp, Artificial Sequence
  Description of Artificial Sequence: Synthetic oligonucleotide
  Target: ATXN1; (-) strand; PAM type: NRG; PAM sequence: TGG
atgtattttgacctatcaga

SEQ ID NO: 77735 - DNA, 20 bp, Artificial Sequence
  Description of Artificial Sequence: Synthetic oligonucleotide
  Target: ATXN1; (-) strand; PAM type: NRG; PAM sequence: CAG
attcatgtattttgacctat

SEQ ID NO: 77736 - DNA, 20 bp, Artificial Sequence
  Description of Artificial Sequence: Synthetic oligonucleotide
  Target: ATXN1; (-) strand; PAM type: NRG; PAM sequence: GGG
ccatggttgcctagagagat

SEQ ID NO: 77737 - DNA, 20 bp, Artificial Sequence
  Description of Artificial Sequence: Synthetic oligonucleotide
  Target: ATXN1; (-) strand; PAM type: NRG; PAM sequence: TGG
accatggttgcctagagaga

SEQ ID NO: 77738 - DNA, 20 bp, Artificial Sequence
  Description of Artificial Sequence: Synthetic oligonucleotide
  Target: ATXN1; (-) strand; PAM type: NRG; PAM sequence: GAG
gttgaccatggttgcctaga

SEQ ID NO: 77739 - DNA, 20 bp, Artificial Sequence
  Description of Artificial Sequence: Synthetic oligonucleotide
  Target: ATXN1; (-) strand; PAM type: NRG; PAM sequence: GAG
cagttgaccatggttgccta

SEQ ID NO: 77740 - DNA, 20 bp, Artificial Sequence
  Description of Artificial Sequence: Synthetic oligonucleotide
  Target: ATXN1; (-) strand; PAM type: NRG; PAM sequence: TAG
aacagttgaccatggttgcc

SEQ ID NO: 77741 - DNA, 20 bp, Artificial Sequence
  Description of Artificial Sequence: Synthetic oligonucleotide
  Target: ATXN1; (-) strand; PAM type: NRG; PAM sequence: TGG
tggttttcaacagttgacca

SEQ ID NO: 77742 - DNA, 20 bp, Artificial Sequence
  Description of Artificial Sequence: Synthetic oligonucleotide
  Target: ATXN1; (-) strand; PAM type: NRG; PAM sequence: CAG
aagcaagaagtggttttcaa

SEQ ID NO: 77743 - DNA, 20 bp, Artificial Sequence
  Description of Artificial Sequence: Synthetic oligonucleotide
  Target: ATXN1; (-) strand; PAM type: NRG; PAM sequence: TGG
ttttgatgtaaagcaagaag

SEQ ID NO: 77744 - DNA, 20 bp, Artificial Sequence
  Description of Artificial Sequence: Synthetic oligonucleotide
  Target: ATXN1; (-) strand; PAM type: NRG; PAM sequence: AAG
acattttgatgtaaagcaag

SEQ ID NO: 77745 - DNA, 20 bp, Artificial Sequence
  Description of Artificial Sequence: Synthetic oligonucleotide
  Target: ATXN1; (-) strand; PAM type: NRG; PAM sequence: AAG
aacacattttgatgtaaagc

SEQ ID NO: 77746 - DNA, 20 bp, Artificial Sequence
  Description of Artificial Sequence: Synthetic oligonucleotide
  Target: ATXN1; (-) strand; PAM type: NRG; PAM sequence: AAG
tactaacacattttgatgta

SEQ ID NO: 77747 - DNA, 20 bp, Artificial Sequence
  Description of Artificial Sequence: Synthetic oligonucleotide
  Target: ATXN1; (-) strand; PAM type: NRG; PAM sequence: AGG
ttggggatatgcttgaccca

SEQ ID NO: 77748 - DNA, 20 bp, Artificial Sequence
  Description of Artificial Sequence: Synthetic oligonucleotide
  Target: ATXN1; (-) strand; PAM type: NRG; PAM sequence: AAG
tttggggatatgcttgaccc

SEQ ID NO: 77749 - DNA, 20 bp, Artificial Sequence
  Description of Artificial Sequence: Synthetic oligonucleotide
  Target: ATXN1; (-) strand; PAM type: NRG; PAM sequence: GGG
gagccatctttaggaatttg

SEQ ID NO: 77750 - DNA, 20 bp, Artificial Sequence
  Description of Artificial Sequence: Synthetic oligonucleotide
  Target: ATXN1; (-) strand; PAM type: NRG; PAM sequence: GGG
agagccatctttaggaattt

SEQ ID NO: 77751 - DNA, 20 bp, Artificial Sequence
  Description of Artificial Sequence: Synthetic oligonucleotide
  Target: ATXN1; (-) strand; PAM type: NRG; PAM sequence: TGG
aagagccatctttaggaatt

SEQ ID NO: 77752 - DNA, 20 bp, Artificial Sequence
  Description of Artificial Sequence: Synthetic oligonucleotide
  Target: ATXN1; (-) strand; PAM type: NRG; PAM sequence: AGG
atgagcaaagagccatcttt

SEQ ID NO: 77753 - DNA, 20 bp, Artificial Sequence
  Description of Artificial Sequence: Synthetic oligonucleotide
  Target: ATXN1; (-) strand; PAM type: NRG; PAM sequence: TAG
aatgagcaaagagccatctt

SEQ ID NO: 77754 - DNA, 20 bp, Artificial Sequence
  Description of Artificial Sequence: Synthetic oligonucleotide
  Target: ATXN1; (-) strand; PAM type: NRG; PAM sequence: GAG
gggcataaaaaatgagcaaa

SEQ ID NO: 77755 - DNA, 20 bp, Artificial Sequence
  Description of Artificial Sequence: Synthetic oligonucleotide
  Target: ATXN1; (-) strand; PAM type: NRG; PAM sequence: AAG
ttgggcataaaaaatgagca

SEQ ID NO: 77756 - DNA, 20 bp, Artificial Sequence
  Description of Artificial Sequence: Synthetic oligonucleotide
  Target: ATXN1; (-) strand; PAM type: NRG; PAM sequence: GAG
agattttgggcataaaaaat

SEQ ID NO: 77757 - DNA, 20 bp, Artificial Sequence
  Description of Artificial Sequence: Synthetic oligonucleotide
  Target: ATXN1; (-) strand; PAM type: NRG; PAM sequence: GGG
atcaatttcttagagatttt

SEQ ID NO: 77758 - DNA, 20 bp, Artificial Sequence
  Description of Artificial Sequence: Synthetic oligonucleotide
  Target: ATXN1; (-) strand; PAM type: NRG; PAM sequence: TGG
gatcaatttcttagagattt

SEQ ID NO: 77759 - DNA, 20 bp, Artificial Sequence
  Description of Artificial Sequence: Synthetic oligonucleotide
  Target: ATXN1; (-) strand; PAM type: NRG; PAM sequence: GAG
gatctgtgatcaatttctta

SEQ ID NO: 77760 - DNA, 20 bp, Artificial Sequence
  Description of Artificial Sequence: Synthetic oligonucleotide
  Target: ATXN1; (-) strand; PAM type: NRG; PAM sequence: TAG
aggatctgtgatcaatttct

SEQ ID NO: 77761 - DNA, 20 bp, Artificial Sequence
  Description of Artificial Sequence: Synthetic oligonucleotide
  Target: ATXN1; (-) strand; PAM type: NRG; PAM sequence: AGG
gacctgtggttgaccatatt

SEQ ID NO: 77762 - DNA, 20 bp, Artificial Sequence
  Description of Artificial Sequence: Synthetic oligonucleotide
  Target: ATXN1; (-) strand; PAM type: NRG; PAM sequence: TAG
agacctgtggttgaccatat

SEQ ID NO: 77763 - DNA, 20 bp, Artificial Sequence
  Description of Artificial Sequence: Synthetic oligonucleotide
  Target: ATXN1; (-) strand; PAM type: NRG; PAM sequence: TGG
tgttgtgacctgcagacctg

SEQ ID NO: 77764 - DNA, 20 bp, Artificial Sequence
  Description of Artificial Sequence: Synthetic oligonucleotide
  Target: ATXN1; (-) strand; PAM type: NRG; PAM sequence: CAG
aaaagatatgttgtgacctg

SEQ ID NO: 77765 - DNA, 20 bp, Artificial Sequence
  Description of Artificial Sequence: Synthetic oligonucleotide
  Target: ATXN1; (-) strand; PAM type: NRG; PAM sequence: AAG
catttcagaccatgcccaaa

SEQ ID NO: 77766 - DNA, 20 bp, Artificial Sequence
  Description of Artificial Sequence: Synthetic oligonucleotide
  Target: ATXN1; (-) strand; PAM type: NRG; PAM sequence: CAG
ctcggatgccttgggcattt

SEQ ID NO: 77767 - DNA, 20 bp, Artificial Sequence
  Description of Artificial Sequence: Synthetic oligonucleotide
  Target: ATXN1; (-) strand; PAM type: NRG; PAM sequence: GGG
tctttttcctcggatgcctt

SEQ ID NO: 77768 - DNA, 20 bp, Artificial Sequence
  Description of Artificial Sequence: Synthetic oligonucleotide
  Target: ATXN1; (-) strand; PAM type: NRG; PAM sequence: TGG
gtctttttcctcggatgcct

SEQ ID NO: 77769 - DNA, 20 bp, Artificial Sequence
  Description of Artificial Sequence: Synthetic oligonucleotide
  Target: ATXN1; (-) strand; PAM type: NRG; PAM sequence: CGG
accaagcacgtctttttcct

SEQ ID NO: 77770 - DNA, 20 bp, Artificial Sequence
  Description of Artificial Sequence: Synthetic oligonucleotide
  Target: ATXN1; (-) strand; PAM type: NRG; PAM sequence: AAG
ggggcctttgtctatagacc

SEQ ID NO: 77771 - DNA, 20 bp, Artificial Sequence
  Description of Artificial Sequence: Synthetic oligonucleotide
  Target: ATXN1; (-) strand; PAM type: NRG; PAM sequence: TAG
gattgaggggcctttgtcta

SEQ ID NO: 77772 - DNA, 20 bp, Artificial Sequence
  Description of Artificial Sequence: Synthetic oligonucleotide
  Target: ATXN1; (-) strand; PAM type: NRG; PAM sequence: GGG
ttgtctcaccaccgattgag

SEQ ID NO: 77773 - DNA, 20 bp, Artificial Sequence
  Description of Artificial Sequence: Synthetic oligonucleotide
  Target: ATXN1; (-) strand; PAM type: NRG; PAM sequence: GGG
attgtctcaccaccgattga

SEQ ID NO: 77774 - DNA, 20 bp, Artificial Sequence
  Description of Artificial Sequence: Synthetic oligonucleotide
  Target: ATXN1; (-) strand; PAM type: NRG; PAM sequence: AGG
tattgtctcaccaccgattg

SEQ ID NO: 77775 - DNA, 20 bp, Artificial Sequence
  Description of Artificial Sequence: Synthetic oligonucleotide
  Target: ATXN1; (-) strand; PAM type: NRG; PAM sequence: GAG
ctattgtctcaccaccgatt

SEQ ID NO: 77776 - DNA, 20 bp, Artificial Sequence
  Description of Artificial Sequence: Synthetic oligonucleotide
  Target: ATXN1; (-) strand; PAM type: NRG; PAM sequence: TAG
tggatgtcataagaagactg

SEQ ID NO: 77777 - DNA, 20 bp, Artificial Sequence
  Description of Artificial Sequence: Synthetic oligonucleotide
  Target: ATXN1; (-) strand; PAM type: NRG; PAM sequence: AAG
tgggaagtggatgtcataag

SEQ ID NO: 77778 - DNA, 20 bp, Artificial Sequence
  Description of Artificial Sequence: Synthetic oligonucleotide
  Target: ATXN1; (-) strand; PAM type: NRG; PAM sequence: AAG
atatgggaagtggatgtcat

SEQ ID NO: 77779 - DNA, 20 bp, Artificial Sequence
  Description of Artificial Sequence: Synthetic oligonucleotide
  Target: ATXN1; (-) strand; PAM type: NRG; PAM sequence: TGG
acaagattatatatgggaag

SEQ ID NO: 77780 - DNA, 20 bp, Artificial Sequence
  Description of Artificial Sequence: Synthetic oligonucleotide
  Target: ATXN1; (-) strand; PAM type: NRG; PAM sequence: AAG
ctaacaagattatatatggg

SEQ ID NO: 77781 - DNA, 20 bp, Artificial Sequence
  Description of Artificial Sequence: Synthetic oligonucleotide
  Target: ATXN1; (-) strand; PAM type: NRG; PAM sequence: GGG
ttactaacaagattatatat

SEQ ID NO: 77782 - DNA, 20 bp, Artificial Sequence
  Description of Artificial Sequence: Synthetic oligonucleotide
  Target: ATXN1; (-) strand; PAM type: NRG; PAM sequence: TGG
tttactaacaagattatata

SEQ ID NO: 77783 - DNA, 20 bp, Artificial Sequence
  Description of Artificial Sequence: Synthetic oligonucleotide
  Target: ATXN1; (-) strand; PAM type: NRG; PAM sequence: AAG
ttaatgtttcatttactaac

SEQ ID NO: 77784 - DNA, 20 bp, Artificial Sequence
  Description of Artificial Sequence: Synthetic oligonucleotide
  Target: ATXN1; (-) strand; PAM type: NRG; PAM sequence: GAG
ctgcagacttttttctccat

SEQ ID NO: 77785 - DNA, 20 bp, Artificial Sequence
  Description of Artificial Sequence: Synthetic oligonucleotide
  Target: ATXN1; (-) strand; PAM type: NRG; PAM sequence: CAG
atagcataaaacagacactg

SEQ ID NO: 77786 - DNA, 20 bp, Artificial Sequence
  Description of Artificial Sequence: Synthetic oligonucleotide
  Target: ATXN1; (-) strand; PAM type: NRG; PAM sequence: CAG
gatctgtttatagcataaaa

SEQ ID NO: 77787 - DNA, 20 bp, Artificial Sequence
  Description of Artificial Sequence: Synthetic oligonucleotide
  Target: ATXN1; (-) strand; PAM type: NRG; PAM sequence: TAG
ttcagctggagatctgttta

SEQ ID NO: 77788 - DNA, 20 bp, Artificial Sequence
  Description of Artificial Sequence: Synthetic oligonucleotide
  Target: ATXN1; (-) strand; PAM type: NRG; PAM sequence: GAG
gcacatagcaatttcagctg

SEQ ID NO: 77789 - DNA, 20 bp, Artificial Sequence
  Description of Artificial Sequence: Synthetic oligonucleotide
  Target: ATXN1; (-) strand; PAM type: NRG; PAM sequence: TGG
cagcacatagcaatttcagc

SEQ ID NO: 77790 - DNA, 20 bp, Artificial Sequence
  Description of Artificial Sequence: Synthetic oligonucleotide
  Target: ATXN1; (-) strand; PAM type: NRG; PAM sequence: CAG
cattcagcacatagcaattt

SEQ ID NO: 77791 - DNA, 20 bp, Artificial Sequence
  Description of Artificial Sequence: Synthetic oligonucleotide
  Target: ATXN1; (-) strand; PAM type: NRG; PAM sequence: TAG
ctccaatgtcattcagcaca

SEQ ID NO: 77792 - DNA, 20 bp, Artificial Sequence
  Description of Artificial Sequence: Synthetic oligonucleotide
  Target: ATXN1; (-) strand; PAM type: NRG; PAM sequence: CAG
gctcccactccaatgtcatt

SEQ ID NO: 77793 - DNA, 20 bp, Artificial Sequence
  Description of Artificial Sequence: Synthetic oligonucleotide
  Target: ATXN1; (-) strand; PAM type: NRG; PAM sequence: TGG
aggcttgcaggtaaagccag

SEQ ID NO: 77794 - DNA, 20 bp, Artificial Sequence
  Description of Artificial Sequence: Synthetic oligonucleotide
  Target: ATXN1; (-) strand; PAM type: NRG; PAM sequence: CAG
ctgaggcttgcaggtaaagc

SEQ ID NO: 77795 - DNA, 20 bp, Artificial Sequence
  Description of Artificial Sequence: Synthetic oligonucleotide
  Target: ATXN1; (-) strand; PAM type: NRG; PAM sequence: AAG
aaagctgaggcttgcaggta

SEQ ID NO: 77796 - DNA, 20 bp, Artificial Sequence
  Description of Artificial Sequence: Synthetic oligonucleotide
  Target: ATXN1; (-) strand; PAM type: NRG; PAM sequence: AGG
ggactaaagctgaggcttgc

SEQ ID NO: 77797 - DNA, 20 bp, Artificial Sequence
  Description of Artificial Sequence: Synthetic oligonucleotide
  Target: ATXN1; (-) strand; PAM type: NRG; PAM sequence: CAG
tggactaaagctgaggcttg

SEQ ID NO: 77798 - DNA, 20 bp, Artificial Sequence
  Description of Artificial Sequence: Synthetic oligonucleotide
  Target: ATXN1; (-) strand; PAM type: NRG; PAM sequence: AGG
acagatctggactaaagctg

SEQ ID NO: 77799 - DNA, 20 bp, Artificial Sequence
  Description of Artificial Sequence: Synthetic oligonucleotide
  Target: ATXN1; (-) strand; PAM type: NRG; PAM sequence: GAG
aacagatctggactaaagct

SEQ ID NO: 77800 - DNA, 20 bp, Artificial Sequence
  Description of Artificial Sequence: Synthetic oligonucleotide
  Target: ATXN1; (-) strand; PAM type: NRG; PAM sequence: AAG
cgtggaacagatctggacta

SEQ ID NO: 77801 - DNA, 20 bp, Artificial Sequence
  Description of Artificial Sequence: Synthetic oligonucleotide
  Target: ATXN1; (-) strand; PAM type: NRG; PAM sequence: TGG
agggttgcgtggaacagatc

SEQ ID NO: 77802 - DNA, 20 bp, Artificial Sequence
  Description of Artificial Sequence: Synthetic oligonucleotide
  Target: ATXN1; (-) strand; PAM type: NRG; PAM sequence: CAG
attgccagggttgcgtggaa

SEQ ID NO: 77803 - DNA, 20 bp, Artificial Sequence
  Description of Artificial Sequence: Synthetic oligonucleotide
  Target: ATXN1; (-) strand; PAM type: NRG; PAM sequence: TGG
gtaatattgccagggttgcg

SEQ ID NO: 77804 - DNA, 20 bp, Artificial Sequence
  Description of Artificial Sequence: Synthetic oligonucleotide
  Target: ATXN1; (-) strand; PAM type: NRG; PAM sequence: GGG
gaacagaggtaatattgcca

SEQ ID NO: 77805 - DNA, 20 bp, Artificial Sequence
  Description of Artificial Sequence: Synthetic oligonucleotide
  Target: ATXN1; (-) strand; PAM type: NRG; PAM sequence: AGG
agaacagaggtaatattgcc

SEQ ID NO: 77806 - DNA, 20 bp, Artificial Sequence
  Description of Artificial Sequence: Synthetic oligonucleotide
  Target: ATXN1; (-) strand; PAM type: NRG; PAM sequence: CAG
tagaacagaggtaatattgc

SEQ ID NO: 77807 - DNA, 20 bp, Artificial Sequence
  Description of Artificial Sequence: Synthetic oligonucleotide
  Target: ATXN1; (-) strand; PAM type: NRG; PAM sequence: AGG
cgcagatggttctagaacag

SEQ ID NO: 77808 - DNA, 20 bp, Artificial Sequence
  Description of Artificial Sequence: Synthetic oligonucleotide
  Target: ATXN1; (-) strand; PAM type: NRG; PAM sequence: GAG
tcgcagatggttctagaaca

SEQ ID NO: 77809 - DNA, 20 bp, Artificial Sequence
  Description of Artificial Sequence: Synthetic oligonucleotide
  Target: ATXN1; (-) strand; PAM type: NRG; PAM sequence: CAG
agtcgcagatggttctagaa

SEQ ID NO: 77810 - DNA, 20 bp, Artificial Sequence
  Description of Artificial Sequence: Synthetic oligonucleotide
  Target: ATXN1; (-) strand; PAM type: NRG; PAM sequence: TAG
atccaagtcgcagatggttc

SEQ ID NO: 77811 - DNA, 20 bp, Artificial Sequence
  Description of Artificial Sequence: Synthetic oligonucleotide
  Target: ATXN1; (-) strand; PAM type: NRG; PAM sequence: TGG
cagaacatccaagtcgcaga

SEQ ID NO: 77812 - DNA, 20 bp, Artificial Sequence
  Description of Artificial Sequence: Synthetic oligonucleotide
  Target: ATXN1; (-) strand; PAM type: NRG; PAM sequence: CAG
ttggcagaacatccaagtcg

SEQ ID NO: 77813 - DNA, 20 bp, Artificial Sequence
  Description of Artificial Sequence: Synthetic oligonucleotide
  Target: ATXN1; (-) strand; PAM type: NRG; PAM sequence: AAG
gtttgcttggcagaacatcc

SEQ ID NO: 77814 - DNA, 20 bp, Artificial Sequence
  Description of Artificial Sequence: Synthetic oligonucleotide
  Target: ATXN1; (-) strand; PAM type: NRG; PAM sequence: CAG
gagcaggtttgtttgcttgg

SEQ ID NO: 77815 - DNA, 20 bp, Artificial Sequence
  Description of Artificial Sequence: Synthetic oligonucleotide
  Target: ATXN1; (-) strand; PAM type: NRG; PAM sequence: TGG
gtagagcaggtttgtttgct

SEQ ID NO: 77816 - DNA, 20 bp, Artificial Sequence
  Description of Artificial Sequence: Synthetic oligonucleotide
  Target: ATXN1; (-) strand; PAM type: NRG; PAM sequence: AGG
taggcagacagatgtagagc

SEQ ID NO: 77817 - DNA, 20 bp, Artificial Sequence
  Description of Artificial Sequence: Synthetic oligonucleotide
  Target: ATXN1; (-) strand; PAM type: NRG; PAM sequence: CAG
ataggcagacagatgtagag

SEQ ID NO: 77818 - DNA, 20 bp, Artificial Sequence
  Description of Artificial Sequence: Synthetic oligonucleotide
  Target: ATXN1; (-) strand; PAM type: NRG; PAM sequence: GAG
tggataggcagacagatgta

SEQ ID NO: 77819 - DNA, 20 bp, Artificial Sequence
  Description of Artificial Sequence: Synthetic oligonucleotide
  Target: ATXN1; (-) strand; PAM type: NRG; PAM sequence: TAG
gctggataggcagacagatg

SEQ ID NO: 77820 - DNA, 20 bp, Artificial Sequence
  Description of Artificial Sequence: Synthetic oligonucleotide
  Target: ATXN1; (-) strand; PAM type: NRG; PAM sequence: CAG
gagagagctggataggcaga

SEQ ID NO: 77821 - DNA, 20 bp, Artificial Sequence
  Description of Artificial Sequence: Synthetic oligonucleotide
  Target: ATXN1; (-) strand; PAM type: NRG; PAM sequence: CAG
aagagagagagctggatagg

SEQ ID NO: 77822 - DNA, 20 bp, Artificial Sequence
  Description of Artificial Sequence: Synthetic oligonucleotide
  Target: ATXN1; (-) strand; PAM type: NRG; PAM sequence: AGG
agaaagagagagagctggat

SEQ ID NO: 77823 - DNA, 20 bp, Artificial Sequence
  Description of Artificial Sequence: Synthetic oligonucleotide
  Target: ATXN1; (-) strand; PAM type: NRG; PAM sequence: TAG
cagaaagagagagagctgga

SEQ ID NO: 77824 - DNA, 20 bp, Artificial Sequence
  Description of Artificial Sequence: Synthetic oligonucleotide
  Target: ATXN1; (-) strand; PAM type: NRG; PAM sequence: TGG
gagacagaaagagagagagc

SEQ ID NO: 77825 - DNA, 20 bp, Artificial Sequence
  Description of Artificial Sequence: Synthetic oligonucleotide
  Target: ATXN1; (-) strand; PAM type: NRG; PAM sequence: GAG
gagagagacagaaagagaga

SEQ ID NO: 77826 - DNA, 20 bp, Artificial Sequence
  Description of Artificial Sequence: Synthetic oligonucleotide
  Target: ATXN1; (-) strand; PAM type: NRG; PAM sequence: GAG
tggagagagacagaaagaga

SEQ ID NO: 77827 - DNA, 20 bp, Artificial Sequence
  Description of Artificial Sequence: Synthetic oligonucleotide
  Target: ATXN1; (-) strand; PAM type: NRG; PAM sequence: GAG
cttggagagagacagaaaga

SEQ ID NO: 77828 - DNA, 20 bp, Artificial Sequence
  Description of Artificial Sequence: Synthetic oligonucleotide
  Target: ATXN1; (-) strand; PAM type: NRG; PAM sequence: GAG
accttggagagagacagaaa

SEQ ID NO: 77829 - DNA, 20 bp, Artificial Sequence
  Description of Artificial Sequence: Synthetic oligonucleotide
  Target: ATXN1; (-) strand; PAM type: NRG; PAM sequence: AAG
agaccttggagagagacaga

SEQ ID NO: 77830 - DNA, 20 bp, Artificial Sequence
  Description of Artificial Sequence: Synthetic oligonucleotide
  Target: ATXN1; (-) strand; PAM type: NRG; PAM sequence: CAG
agagagaccttggagagaga

SEQ ID NO: 77831 - DNA, 20 bp, Artificial Sequence
  Description of Artificial Sequence: Synthetic oligonucleotide
  Target: ATXN1; (-) strand; PAM type: NRG; PAM sequence: GAG
aaaaagagagaccttggaga

SEQ ID NO: 77832 - DNA, 20 bp, Artificial Sequence
  Description of Artificial Sequence: Synthetic oligonucleotide
  Target: ATXN1; (-) strand; PAM type: NRG; PAM sequence: GAG
agaaaaagagagaccttgga

SEQ ID NO: 77833 - DNA, 20 bp, Artificial Sequence
  Description of Artificial Sequence: Synthetic oligonucleotide
  Target: ATXN1; (-) strand; PAM type: NRG; PAM sequence: GAG
ttagaaaaagagagaccttg

SEQ ID NO: 77834 - DNA, 20 bp, Artificial Sequence
  Description of Artificial Sequence: Synthetic oligonucleotide
  Target: ATXN1; (-) strand; PAM type: NRG; PAM sequence: TGG
acttagaaaaagagagacct

SEQ ID NO: 77835 - DNA, 20 bp, Artificial Sequence
  Description of Artificial Sequence: Synthetic oligonucleotide
  Target: ATXN1; (-) strand; PAM type: NRG; PAM sequence: GAG
aaaggtgacttagaaaaaga

SEQ ID NO: 77836 - DNA, 20 bp, Artificial Sequence
  Description of Artificial Sequence: Synthetic oligonucleotide
  Target: ATXN1; (-) strand; PAM type: NRG; PAM sequence: GAG
acaaaggtgacttagaaaaa

SEQ ID NO: 77837 - DNA, 20 bp, Artificial Sequence
  Description of Artificial Sequence: Synthetic oligonucleotide
  Target: ATXN1; (-) strand; PAM type: NRG; PAM sequence: AAG
caacaaaggtgacttagaaa

SEQ ID NO: 77838 - DNA, 20 bp, Artificial Sequence
  Description of Artificial Sequence: Synthetic oligonucleotide
  Target: ATXN1; (-) strand; PAM type: NRG; PAM sequence: TAG
gattgtcaacaaaggtgact

SEQ ID NO: 77839 - DNA, 20 bp, Artificial Sequence
  Description of Artificial Sequence: Synthetic oligonucleotide
  Target: ATXN1; (-) strand; PAM type: NRG; PAM sequence: AGG
gctgcaatgattgtcaacaa

SEQ ID NO: 77840 - DNA, 20 bp, Artificial Sequence
  Description of Artificial Sequence: Synthetic oligonucleotide
  Target: ATXN1; (-) strand; PAM type: NRG; PAM sequence: AAG
agctgcaatgattgtcaaca

SEQ ID NO: 77841 - DNA, 20 bp, Artificial Sequence
  Description of Artificial Sequence: Synthetic oligonucleotide
  Target: ATXN1; (-) strand; PAM type: NRG; PAM sequence: CAG
tttatcccttctcactggtc

SEQ ID NO: 77842 - DNA, 20 bp, Artificial Sequence
  Description of Artificial Sequence: Synthetic oligonucleotide
  Target: ATXN1; (-) strand; PAM type: NRG; PAM sequence: TGG
tctattttatcccttctcac

SEQ ID NO: 77843 - DNA, 20 bp, Artificial Sequence
  Description of Artificial Sequence: Synthetic oligonucleotide
  Target: ATXN1; (-) strand; PAM type: NRG; PAM sequence: GAG
taggcttaatgaacccagaa

SEQ ID NO: 77844 - DNA, 20 bp, Artificial Sequence
  Description of Artificial Sequence: Synthetic oligonucleotide
  Target: ATXN1; (-) strand; PAM type: NRG; PAM sequence: AAG
cataggcttaatgaacccag

SEQ ID NO: 77845 - DNA, 20 bp, Artificial Sequence
  Description of Artificial Sequence: Synthetic oligonucleotide
  Target: ATXN1; (-) strand; PAM type: NRG; PAM sequence: CAG
ggtcataggcttaatgaacc

SEQ ID NO: 77846 - DNA, 20 bp, Artificial Sequence
  Description of Artificial Sequence: Synthetic oligonucleotide
  Target: ATXN1; (-) strand; PAM type: NRG; PAM sequence: AGG
atgggcagagggtaggtcat

SEQ ID NO: 77847 - DNA, 20 bp, Artificial Sequence
  Description of Artificial Sequence: Synthetic oligonucleotide
  Target: ATXN1; (-) strand; PAM type: NRG; PAM sequence: TAG
catgggcagagggtaggtca

SEQ ID NO: 77848 - DNA, 20 bp, Artificial Sequence
  Description of Artificial Sequence: Synthetic oligonucleotide
  Target: ATXN1; (-) strand; PAM type: NRG; PAM sequence: AGG
agtgtgcatgggcagagggt

SEQ ID NO: 77849 - DNA, 20 bp, Artificial Sequence
  Description of Artificial Sequence: Synthetic oligonucleotide
  Target: ATXN1; (-) strand; PAM type: NRG; PAM sequence: TAG
aagtgtgcatgggcagaggg

SEQ ID NO: 77850 - DNA, 20 bp, Artificial Sequence
  Description of Artificial Sequence: Synthetic oligonucleotide
  Target: ATXN1; (-) strand; PAM type: NRG; PAM sequence: GGG
atcaagtgtgcatgggcaga

SEQ ID NO: 77851 - DNA, 20 bp, Artificial Sequence
  Description of Artificial Sequence: Synthetic oligonucleotide
  Target: ATXN1; (-) strand; PAM type: NRG; PAM sequence: AGG
aatcaagtgtgcatgggcag

SEQ ID NO: 77852 - DNA, 20 bp, Artificial Sequence
  Description of Artificial Sequence: Synthetic oligonucleotide
  Target: ATXN1; (-) strand; PAM type: NRG; PAM sequence: GAG
aaatcaagtgtgcatgggca

SEQ ID NO: 77853 - DNA, 20 bp, Artificial Sequence
  Description of Artificial Sequence: Synthetic oligonucleotide
  Target: ATXN1; (-) strand; PAM type: NRG; PAM sequence: CAG
agaaatcaagtgtgcatggg

SEQ ID NO: 77854 - DNA, 20 bp, Artificial Sequence
  Description of Artificial Sequence: Synthetic oligonucleotide
  Target: ATXN1; (-) strand; PAM type: NRG; PAM sequence: GGG
gatagaaatcaagtgtgcat

SEQ ID NO: 77855 - DNA, 20 bp, Artificial Sequence
  Description of Artificial Sequence: Synthetic oligonucleotide
  Target: ATXN1; (-) strand; PAM type: NRG; PAM sequence: TGG
agatagaaatcaagtgtgca

SEQ ID NO: 77856 - DNA, 20 bp, Artificial Sequence
  Description of Artificial Sequence: Synthetic oligonucleotide
  Target: ATXN1; (-) strand; PAM type: NRG; PAM sequence: AAG
aaattaagaagatagaaatc

SEQ ID NO: 77857 - DNA, 20 bp, Artificial Sequence
  Description of Artificial Sequence: Synthetic oligonucleotide
  Target: ATXN1; (-) strand; PAM type: NRG; PAM sequence: TAG
tgtagtcaaaattaagaaga

SEQ ID NO: 77858 - DNA, 20 bp, Artificial Sequence
  Description of Artificial Sequence: Synthetic oligonucleotide
  Target: ATXN1; (-) strand; PAM type: NRG; PAM sequence: AAG
acagtgtagtcaaaattaag

SEQ ID NO: 77859 - DNA, 20 bp, Artificial Sequence
  Description of Artificial Sequence: Synthetic oligonucleotide
  Target: ATXN1; (-) strand; PAM type: NRG; PAM sequence: AAG
aacacagtgtagtcaaaatt

SEQ ID NO: 77860 - DNA, 20 bp, Artificial Sequence
  Description of Artificial Sequence: Synthetic oligonucleotide
  Target: ATXN1; (-) strand; PAM type: NRG; PAM sequence: TAG
ccccacatccaaacacagtg

SEQ ID NO: 77861 - DNA, 20 bp, Artificial Sequence
  Description of Artificial Sequence: Synthetic oligonucleotide
  Target: ATXN1; (-) strand; PAM type: NRG; PAM sequence: CAG
gttctccccacatccaaaca

SEQ ID NO: 77862 - DNA, 20 bp, Artificial Sequence
  Description of Artificial Sequence: Synthetic oligonucleotide
  Target: ATXN1; (-) strand; PAM type: NRG; PAM sequence: TAG
tttgaataagagtgaaaaaa

SEQ ID NO: 77863 - DNA, 20 bp, Artificial Sequence
  Description of Artificial Sequence: Synthetic oligonucleotide
  Target: ATXN1; (-) strand; PAM type: NRG; PAM sequence: GAG
tgtcacacgtctttgaataa

SEQ ID NO: 77864 - DNA, 20 bp, Artificial Sequence
  Description of Artificial Sequence: Synthetic oligonucleotide
  Target: ATXN1; (-) strand; PAM type: NRG; PAM sequence: AAG
agtgtcacacgtctttgaat

SEQ ID NO: 77865 - DNA, 20 bp, Artificial Sequence
  Description of Artificial Sequence: Synthetic oligonucleotide
  Target: ATXN1; (-) strand; PAM type: NRG; PAM sequence: TAG
tttaaggaaacaaagaataa

SEQ ID NO: 77866 - DNA, 20 bp, Artificial Sequence
  Description of Artificial Sequence: Synthetic oligonucleotide
  Target: ATXN1; (-) strand; PAM type: NRG; PAM sequence: AAG
caacatattttaaggaaaca

SEQ ID NO: 77867 - DNA, 20 bp, Artificial Sequence
  Description of Artificial Sequence: Synthetic oligonucleotide
  Target: ATXN1; (-) strand; PAM type: NRG; PAM sequence: AGG
aagaatgccaacatatttta

SEQ ID NO: 77868 - DNA, 20 bp, Artificial Sequence
  Description of Artificial Sequence: Synthetic oligonucleotide
  Target: ATXN1; (-) strand; PAM type: NRG; PAM sequence: AAG
gaagaatgccaacatatttt

SEQ ID NO: 77869 - DNA, 20 bp, Artificial Sequence
  Description of Artificial Sequence: Synthetic oligonucleotide
  Target: ATXN1; (-) strand; PAM type: NRG; PAM sequence: AAG
cgctctcctactagggagag

SEQ ID NO: 77870 - DNA, 20 bp, Artificial Sequence
  Description of Artificial Sequence: Synthetic oligonucleotide
  Target: ATXN1; (-) strand; PAM type: NRG; PAM sequence: GAG
aggcgctctcctactaggga

SEQ ID NO: 77871 - DNA, 20 bp, Artificial Sequence
  Description of Artificial Sequence: Synthetic oligonucleotide
  Target: ATXN1; (-) strand; PAM type: NRG; PAM sequence: GAG
gcaggcgctctcctactagg

SEQ ID NO: 77872 - DNA, 20 bp, Artificial Sequence
  Description of Artificial Sequence: Synthetic oligonucleotide
  Target: ATXN1; (-) strand; PAM type: NRG; PAM sequence: GGG
ttgcaggcgctctcctacta

SEQ ID NO: 77873 - DNA, 20 bp, Artificial Sequence
  Description of Artificial Sequence: Synthetic oligonucleotide
  Target: ATXN1; (-) strand; PAM type: NRG; PAM sequence: AGG
cttgcaggcgctctcctact

SEQ ID NO: 77874 - DNA, 20 bp, Artificial Sequence
  Description of Artificial Sequence: Synthetic oligonucleotide
  Target: ATXN1; (-) strand; PAM type: NRG; PAM sequence: TAG
ccttgcaggcgctctcctac

SEQ ID NO: 77875 - DNA, 20 bp, Artificial Sequence
  Description of Artificial Sequence: Synthetic oligonucleotide
  Target: ATXN1; (-) strand; PAM type: NRG; PAM sequence: AGG
gaagcttttgtgatccttgc

SEQ ID NO: 77876 - DNA, 20 bp, Artificial Sequence
  Description of Artificial Sequence: Synthetic oligonucleotide
  Target: ATXN1; (-) strand; PAM type: NRG; PAM sequence: CAG
agaagcttttgtgatccttg

SEQ ID NO: 77877 - DNA, 20 bp, Artificial Sequence
  Description of Artificial Sequence: Synthetic oligonucleotide
  Target: ATXN1; (-) strand; PAM type: NRG; PAM sequence: AAG
agattattgcttctccccag

SEQ ID NO: 77878 - DNA, 20 bp, Artificial Sequence
  Description of Artificial Sequence: Synthetic oligonucleotide
  Target: ATXN1; (-) strand; PAM type: NRG; PAM sequence: CAG
agcagattattgcttctccc

SEQ ID NO: 77879 - DNA, 20 bp, Artificial Sequence
  Description of Artificial Sequence: Synthetic oligonucleotide
  Target: ATXN1; (-) strand; PAM type: NRG; PAM sequence: CAG
gctggggcctggttattcag

SEQ ID NO: 77880 - DNA, 20 bp, Artificial Sequence
  Description of Artificial Sequence: Synthetic oligonucleotide
  Target: ATXN1; (-) strand; PAM type: NRG; PAM sequence: CAG
gcagctggggcctggttatt

SEQ ID NO: 77881 - DNA, 20 bp, Artificial Sequence
  Description of Artificial Sequence: Synthetic oligonucleotide
  Target: ATXN1; (-) strand; PAM type: NRG; PAM sequence: TGG
ggcatttggcagctggggcc

SEQ ID NO: 77882 - DNA, 20 bp, Artificial Sequence
  Description of Artificial Sequence: Synthetic oligonucleotide
  Target: ATXN1; (-) strand; PAM type: NRG; PAM sequence: GGG
ccagtggcatttggcagctg

SEQ ID NO: 77883 - DNA, 20 bp, Artificial Sequence
  Description of Artificial Sequence: Synthetic oligonucleotide
  Target: ATXN1; (-) strand; PAM type: NRG; PAM sequence: GGG
cccagtggcatttggcagct

SEQ ID NO: 77884 - DNA, 20 bp, Artificial Sequence
  Description of Artificial Sequence: Synthetic oligonucleotide
  Target: ATXN1; (-) strand; PAM type: NRG; PAM sequence: TGG
tcccagtggcatttggcagc

SEQ ID NO: 77885 - DNA, 20 bp, Artificial Sequence
  Description of Artificial Sequence: Synthetic oligonucleotide
  Target: ATXN1; (-) strand; PAM type: NRG; PAM sequence: CAG
cttttcccagtggcatttgg

SEQ ID NO: 77886 - DNA, 20 bp, Artificial Sequence
  Description of Artificial Sequence: Synthetic oligonucleotide
  Target: ATXN1; (-) strand; PAM type: NRG; PAM sequence: TGG
gcacttttcccagtggcatt

SEQ ID NO: 77887 - DNA, 20 bp, Artificial Sequence
  Description of Artificial Sequence: Synthetic oligonucleotide
  Target: ATXN1; (-) strand; PAM type: NRG; PAM sequence: TGG
accctttgcacttttcccag

SEQ ID NO: 77888 - DNA, 20 bp, Artificial Sequence
  Description of Artificial Sequence: Synthetic oligonucleotide
  Target: ATXN1; (-) strand; PAM type: NRG; PAM sequence: CAG
ttcaccctttgcacttttcc

SEQ ID NO: 77889 - DNA, 20 bp, Artificial Sequence
  Description of Artificial Sequence: Synthetic oligonucleotide
  Target: ATXN1; (-) strand; PAM type: NRG; PAM sequence: TGG
ataatgtttatgattcagag

SEQ ID NO: 77890 - DNA, 20 bp, Artificial Sequence
  Description of Artificial Sequence: Synthetic oligonucleotide
  Target: ATXN1; (-) strand; PAM type: NRG; PAM sequence: GAG
gtaataatgtttatgattca

SEQ ID NO: 77891 - DNA, 20 bp, Artificial Sequence
  Description of Artificial Sequence: Synthetic oligonucleotide
  Target: ATXN1; (-) strand; PAM type: NRG; PAM sequence: CAG
ctgtaataatgtttatgatt

SEQ ID NO: 77892 - DNA, 20 bp, Artificial Sequence
  Description of Artificial Sequence: Synthetic oligonucleotide
  Target: ATXN1; (-) strand; PAM type: NRG; PAM sequence: CAG
aagaactctcaagtagcagc

SEQ ID NO: 77893 - DNA, 20 bp, Artificial Sequence
  Description of Artificial Sequence: Synthetic oligonucleotide
  Target: ATXN1; (-) strand; PAM type: NRG; PAM sequence: CAG
acagaagaactctcaagtag

SEQ ID NO: 77894 - DNA, 20 bp, Artificial Sequence
  Description of Artificial Sequence: Synthetic oligonucleotide
  Target: ATXN1; (-) strand; PAM type: NRG; PAM sequence: TAG
ggtacagaagaactctcaag

SEQ ID NO: 77895 - DNA, 20 bp, Artificial Sequence
  Description of Artificial Sequence: Synthetic oligonucleotide
  Target: ATXN1; (-) strand; PAM type: NRG; PAM sequence: AAG
ttaggtacagaagaactctc

SEQ ID NO: 77896 - DNA, 20 bp, Artificial Sequence
  Description of Artificial Sequence: Synthetic oligonucleotide
  Target: ATXN1; (-) strand; PAM type: NRG; PAM sequence: AAG
catggtccaattaggtacag

SEQ ID NO: 77897 - DNA, 20 bp, Artificial Sequence
  Description of Artificial Sequence: Synthetic oligonucleotide
  Target: ATXN1; (-) strand; PAM type: NRG; PAM sequence: CAG
ctgcatggtccaattaggta

SEQ ID NO: 77898 - DNA, 20 bp, Artificial Sequence
  Description of Artificial Sequence: Synthetic oligonucleotide
  Target: ATXN1; (-) strand; PAM type: NRG; PAM sequence: AGG
tcacgctgcatggtccaatt

SEQ ID NO: 77899 - DNA, 20 bp, Artificial Sequence
  Description of Artificial Sequence: Synthetic oligonucleotide
  Target: ATXN1; (-) strand; PAM type: NRG; PAM sequence: TAG
atcacgctgcatggtccaat

SEQ ID NO: 77900 - DNA, 20 bp, Artificial Sequence
  Description of Artificial Sequence: Synthetic oligonucleotide
  Target: ATXN1; (-) strand; PAM type: NRG; PAM sequence: TGG
cccaggagtatcacgctgca

SEQ ID NO: 77901 - DNA, 20 bp, Artificial Sequence
  Description of Artificial Sequence: Synthetic oligonucleotide
  Target: ATXN1; (-) strand; PAM type: NRG; PAM sequence: GAG
atccctgtaatggtccccag

SEQ ID NO: 77902 - DNA, 20 bp, Artificial Sequence
  Description of Artificial Sequence: Synthetic oligonucleotide
  Target: ATXN1; (-) strand; PAM type: NRG; PAM sequence: AGG
gtatccctgtaatggtcccc

SEQ ID NO: 77903 - DNA, 20 bp, Artificial Sequence
  Description of Artificial Sequence: Synthetic oligonucleotide
  Target: ATXN1; (-) strand; PAM type: NRG; PAM sequence: CAG
tgtatccctgtaatggtccc

SEQ ID NO: 77904 - DNA, 20 bp, Artificial Sequence
  Description of Artificial Sequence: Synthetic oligonucleotide
  Target: ATXN1; (-) strand; PAM type: NRG; PAM sequence: TGG
ctacacctgtatccctgtaa

SEQ ID NO: 77905 - DNA, 20 bp, Artificial Sequence
  Description of Artificial Sequence: Synthetic oligonucleotide
  Target: ATXN1; (-) strand; PAM type: NRG; PAM sequence: AAG
acacagcttttgtatattgt

SEQ ID NO: 77906 - DNA, 20 bp, Artificial Sequence
  Description of Artificial Sequence: Synthetic oligonucleotide
  Target: ATXN1; (-) strand; PAM type: NRG; PAM sequence: CAG
cacgtagattgtcagacaca

SEQ ID NO: 77907 - DNA, 20 bp, Artificial Sequence
  Description of Artificial Sequence: Synthetic oligonucleotide
  Target: ATXN1; (-) strand; PAM type: NRG; PAM sequence: CAG
taggcttacacgtagattgt

SEQ ID NO: 77908 - DNA, 20 bp, Artificial Sequence
  Description of Artificial Sequence: Synthetic oligonucleotide
  Target: ATXN1; (-) strand; PAM type: NRG; PAM sequence: TAG
taaaaagttaggcttacacg

SEQ ID NO: 77909 - DNA, 20 bp, Artificial Sequence
  Description of Artificial Sequence: Synthetic oligonucleotide
  Target: ATXN1; (-) strand; PAM type: NRG; PAM sequence: AGG
accaagtaatgtaaaaagtt

SEQ ID NO: 77910 - DNA, 20 bp, Artificial Sequence
  Description of Artificial Sequence: Synthetic oligonucleotide
  Target: ATXN1; (-) strand; PAM type: NRG; PAM sequence: TAG
caccaagtaatgtaaaaagt

SEQ ID NO: 77911 - DNA, 20 bp, Artificial Sequence
  Description of Artificial Sequence: Synthetic oligonucleotide
  Target: ATXN1; (-) strand; PAM type: NRG; PAM sequence: AAG
agcacaccaagtaatgtaaa

SEQ ID NO: 77912 - DNA, 20 bp, Artificial Sequence
  Description of Artificial Sequence: Synthetic oligonucleotide
  Target: ATXN1; (-) strand; PAM type: NRG; PAM sequence: AAG
ctcaggacacttagcacacc

SEQ ID NO: 77913 - DNA, 20 bp, Artificial Sequence
  Description of Artificial Sequence: Synthetic oligonucleotide
  Target: ATXN1; (-) strand; PAM type: NRG; PAM sequence: TAG
atgaactccctcaggacact

SEQ ID NO: 77914 - DNA, 20 bp, Artificial Sequence
  Description of Artificial Sequence: Synthetic oligonucleotide
  Target: ATXN1; (-) strand; PAM type: NRG; PAM sequence: AGG
tctaaataatgaactccctc

SEQ ID NO: 77915 - DNA, 20 bp, Artificial Sequence
  Description of Artificial Sequence: Synthetic oligonucleotide
  Target: ATXN1; (-) strand; PAM type: NRG; PAM sequence: CAG
ctctaaataatgaactccct

SEQ ID NO: 77916 - DNA, 20 bp, Artificial Sequence
  Description of Artificial Sequence: Synthetic oligonucleotide
  Target: ATXN1; (-) strand; PAM type: NRG; PAM sequence: GAG
attttacaaaagtatttatg

SEQ ID NO: 77917 - DNA, 20 bp, Artificial Sequence
  Description of Artificial Sequence: Synthetic oligonucleotide
  Target: ATXN1; (-) strand; PAM type: NRG; PAM sequence: TGG
gaattttacaaaagtattta

SEQ ID NO: 77918 - DNA, 20 bp, Artificial Sequence
  Description of Artificial Sequence: Synthetic oligonucleotide
  Target: ATXN1; (-) strand; PAM type: NRG; PAM sequence: AAG
gaggaatgtgaattttacaa

SEQ ID NO: 77919 - DNA, 20 bp, Artificial Sequence
  Description of Artificial Sequence: Synthetic oligonucleotide
  Target: ATXN1; (-) strand; PAM type: NRG; PAM sequence: AGG
tttacaaaacacaaatggag

SEQ ID NO: 77920 - DNA, 20 bp, Artificial Sequence
  Description of Artificial Sequence: Synthetic oligonucleotide
  Target: ATXN1; (-) strand; PAM type: NRG; PAM sequence: GAG
atttacaaaacacaaatgga

SEQ ID NO: 77921 - DNA, 20 bp, Artificial Sequence
  Description of Artificial Sequence: Synthetic oligonucleotide
  Target: ATXN1; (-) strand; PAM type: NRG; PAM sequence: GAG
aaatttacaaaacacaaatg

SEQ ID NO: 77922 - DNA, 20 bp, Artificial Sequence
  Description of Artificial Sequence: Synthetic oligonucleotide
  Target: ATXN1; (-) strand; PAM type: NRG; PAM sequence: TGG
ggaaatttacaaaacacaaa

SEQ ID NO: 77923 - DNA, 20 bp, Artificial Sequence
  Description of Artificial Sequence: Synthetic oligonucleotide
  Target: ATXN1; (-) strand; PAM type: NRG; PAM sequence: GGG
cgtgctctaaagacagagag

SEQ ID NO: 77924 - DNA, 20 bp, Artificial Sequence
  Description of Artificial Sequence: Synthetic oligonucleotide
  Target: ATXN1; (-) strand; PAM type: NRG; PAM sequence: GGG
acgtgctctaaagacagaga

SEQ ID NO: 77925 - DNA, 20 bp, Artificial Sequence
  Description of Artificial Sequence: Synthetic oligonucleotide
  Target: ATXN1; (-) strand; PAM type: NRG; PAM sequence: AGG
gacgtgctctaaagacagag

SEQ ID NO: 77926 - DNA, 20 bp, Artificial Sequence
  Description of Artificial Sequence: Synthetic oligonucleotide
  Target: ATXN1; (-) strand; PAM type: NRG; PAM sequence: GAG
tgacgtgctctaaagacaga

SEQ ID NO: 77927 - DNA, 20 bp, Artificial Sequence
  Description of Artificial Sequence: Synthetic oligonucleotide
  Target: ATXN1; (-) strand; PAM type: NRG; PAM sequence: GAG
gatgacgtgctctaaagaca

SEQ ID NO: 77928 - DNA, 20 bp, Artificial Sequence
  Description of Artificial Sequence: Synthetic oligonucleotide
  Target: ATXN1; (-) strand; PAM type: NRG; PAM sequence: CAG
ttgatgacgtgctctaaaga

SEQ ID NO: 77929 - DNA, 20 bp, Artificial Sequence
  Description of Artificial Sequence: Synthetic oligonucleotide
  Target: ATXN1; (-) strand; PAM type: NRG; PAM sequence: AAG
cagattgatgacgtgctcta

SEQ ID NO: 77930 - DNA, 20 bp, Artificial Sequence
  Description of Artificial Sequence: Synthetic oligonucleotide
  Target: ATXN1; (-) strand; PAM type: NRG; PAM sequence: CAG
atttgtgggaaatggatgtt

SEQ ID NO: 77931 - DNA, 20 bp, Artificial Sequence
  Description of Artificial Sequence: Synthetic oligonucleotide
  Target: ATXN1; (-) strand; PAM type: NRG; PAM sequence: TGG
atctttatatttgtgggaaa

SEQ ID NO: 77932 - DNA, 20 bp, Artificial Sequence
  Description of Artificial Sequence: Synthetic oligonucleotide
  Target: ATXN1; (-) strand; PAM type: NRG; PAM sequence: GGG
ccccccatctttatatttgt

SEQ ID NO: 77933 - DNA, 20 bp, Artificial Sequence
  Description of Artificial Sequence: Synthetic oligonucleotide
  Target: ATXN1; (-) strand; PAM type: NRG; PAM sequence: TGG
tccccccatctttatatttg

SEQ ID NO: 77934 - DNA, 20 bp, Artificial Sequence
  Description of Artificial Sequence: Synthetic oligonucleotide
  Target: ATXN1; (-) strand; PAM type: NRG; PAM sequence: TAG
cttttttttcagcactggtg

SEQ ID NO: 77935 - DNA, 20 bp, Artificial Sequence
  Description of Artificial Sequence: Synthetic oligonucleotide
  Target: ATXN1; (-) strand; PAM type: NRG; PAM sequence: TGG
ccctccttttttttcagcac

SEQ ID NO: 77936 - DNA, 20 bp, Artificial Sequence
  Description of Artificial Sequence: Synthetic oligonucleotide
  Target: ATXN1; (-) strand; PAM type: NRG; PAM sequence: CAG
tgggtgccctcctttttttt

SEQ ID NO: 77937 - DNA, 20 bp, Artificial Sequence
  Description of Artificial Sequence: Synthetic oligonucleotide
  Target: ATXN1; (-) strand; PAM type: NRG; PAM sequence: GGG
gtcttaatgttaaaaatgct

SEQ ID NO: 77938 - DNA, 20 bp, Artificial Sequence
  Description of Artificial Sequence: Synthetic oligonucleotide
  Target: ATXN1; (-) strand; PAM type: NRG; PAM sequence: TGG
tgtcttaatgttaaaaatgc

SEQ ID NO: 77939 - DNA, 20 bp, Artificial Sequence
  Description of Artificial Sequence: Synthetic oligonucleotide
  Target: ATXN1; (-) strand; PAM type: NRG; PAM sequence: TGG
cttttatgtgatgctttctc

SEQ ID NO: 77940 - DNA, 20 bp, Artificial Sequence
  Description of Artificial Sequence: Synthetic oligonucleotide
  Target: ATXN1; (-) strand; PAM type: NRG; PAM sequence: CAG
cccaacacacatttctgatt

SEQ ID NO: 77941 - DNA, 20 bp, Artificial Sequence
  Description of Artificial Sequence: Synthetic oligonucleotide
  Target: ATXN1; (-) strand; PAM type: NRG; PAM sequence: GAG
tgtgccaccttttcaagaaa

SEQ ID NO: 77942 - DNA, 20 bp, Artificial Sequence
  Description of Artificial Sequence: Synthetic oligonucleotide
  Target: ATXN1; (-) strand; PAM type: NRG; PAM sequence: AAG
gctgtgccaccttttcaaga

SEQ ID NO: 77943 - DNA, 20 bp, Artificial Sequence
  Description of Artificial Sequence: Synthetic oligonucleotide
  Target: ATXN1; (-) strand; PAM type: NRG; PAM sequence: AAG
cagtgctgtgccaccttttc

SEQ ID NO: 77944 - DNA, 20 bp, Artificial Sequence
  Description of Artificial Sequence: Synthetic oligonucleotide
  Target: ATXN1; (-) strand; PAM type: NRG; PAM sequence: CAG
tctcttcttgtttcttctca

SEQ ID NO: 77945 - DNA, 20 bp, Artificial Sequence
  Description of Artificial Sequence: Synthetic oligonucleotide
  Target: ATXN1; (-) strand; PAM type: NRG; PAM sequence: CAG
atttctaaccagtgctctgt

SEQ ID NO: 77946 - DNA, 20 bp, Artificial Sequence
  Description of Artificial Sequence: Synthetic oligonucleotide
  Target: ATXN1; (-) strand; PAM type: NRG; PAM sequence: CAG
attttaggaagatttctaac

SEQ ID NO: 77947 - DNA, 20 bp, Artificial Sequence
  Description of Artificial Sequence: Synthetic oligonucleotide
  Target: ATXN1; (-) strand; PAM type: NRG; PAM sequence: AAG
agcgttcagtccattttagg

SEQ ID NO: 77948 - DNA, 20 bp, Artificial Sequence
  Description of Artificial Sequence: Synthetic oligonucleotide
  Target: ATXN1; (-) strand; PAM type: NRG; PAM sequence: AGG
tccagcgttcagtccatttt

SEQ ID NO: 77949 - DNA, 20 bp, Artificial Sequence
  Description of Artificial Sequence: Synthetic oligonucleotide
  Target: ATXN1; (-) strand; PAM type: NRG; PAM sequence: TAG
ctccagcgttcagtccattt

SEQ ID NO: 77950 - DNA, 20 bp, Artificial Sequence
  Description of Artificial Sequence: Synthetic oligonucleotide
  Target: ATXN1; (-) strand; PAM type: NRG; PAM sequence: CAG
ctgctctcacctccagcgtt

SEQ ID NO: 77951 - DNA, 20 bp, Artificial Sequence
  Description of Artificial Sequence: Synthetic oligonucleotide
  Target: ATXN1; (-) strand; PAM type: NRG; PAM sequence: CAG
tgctagcctgctctcacctc

SEQ ID NO: 77952 - DNA, 20 bp, Artificial Sequence
  Description of Artificial Sequence: Synthetic oligonucleotide
  Target: ATXN1; (-) strand; PAM type: NRG; PAM sequence: TAG
ccagacactatctggtttgc

SEQ ID NO: 77953 - DNA, 20 bp, Artificial Sequence
  Description of Artificial Sequence: Synthetic oligonucleotide
  Target: ATXN1; (-) strand; PAM type: NRG; PAM sequence: TGG
cctggacaccagacactatc

SEQ ID NO: 77954 - DNA, 20 bp, Artificial Sequence
  Description of Artificial Sequence: Synthetic oligonucleotide
  Target: ATXN1; (-) strand; PAM type: NRG; PAM sequence: CAG
aatgtgaatgccctggacac

SEQ ID NO: 77955 - DNA, 20 bp, Artificial Sequence
  Description of Artificial Sequence: Synthetic oligonucleotide
  Target: ATXN1; (-) strand; PAM type: NRG; PAM sequence: TGG
ccttccgaatgtgaatgccc

SEQ ID NO: 77956 - DNA, 20 bp, Artificial Sequence
  Description of Artificial Sequence: Synthetic oligonucleotide
  Target: ATXN1; (-) strand; PAM type: NRG; PAM sequence: TAG
cttatgcttggttctcttct

SEQ ID NO: 77957 - DNA, 20 bp, Artificial Sequence
  Description of Artificial Sequence: Synthetic oligonucleotide
  Target: ATXN1; (-) strand; PAM type: NRG; PAM sequence: TGG
gggcatggaggacttatgct

SEQ ID NO: 77958 - DNA, 20 bp, Artificial Sequence
  Description of Artificial Sequence: Synthetic oligonucleotide
  Target: ATXN1; (-) strand; PAM type: NRG; PAM sequence: AGG
ccagatggccatgggcatgg

SEQ ID NO: 77959 - DNA, 20 bp, Artificial Sequence
  Description of Artificial Sequence: Synthetic oligonucleotide
  Target: ATXN1; (-) strand; PAM type: NRG; PAM sequence: GAG
accagatggccatgggcatg

SEQ ID NO: 77960 - DNA, 20 bp, Artificial Sequence
  Description of Artificial Sequence: Synthetic oligonucleotide
  Target: ATXN1; (-) strand; PAM type: NRG; PAM sequence: TGG
ccaccagatggccatgggca

SEQ ID NO: 77961 - DNA, 20 bp, Artificial Sequence
  Description of Artificial Sequence: Synthetic oligonucleotide
  Target: ATXN1; (-) strand; PAM type: NRG; PAM sequence: GGG
acatcccaccagatggccat

SEQ ID NO: 77962 - DNA, 20 bp, Artificial Sequence
  Description of Artificial Sequence: Synthetic oligonucleotide
  Target: ATXN1; (-) strand; PAM type: NRG; PAM sequence: TGG
cacatcccaccagatggcca

SEQ ID NO: 77963 - DNA, 20 bp, Artificial Sequence
  Description of Artificial Sequence: Synthetic oligonucleotide
  Target: ATXN1; (-) strand; PAM type: NRG; PAM sequence: TGG
acatctcacatcccaccaga

SEQ ID NO: 77964 - DNA, 20 bp, Artificial Sequence
  Description of Artificial Sequence: Synthetic oligonucleotide
  Target: ATXN1; (-) strand; PAM type: NRG; PAM sequence: CAG
agagacatctcacatcccac

SEQ ID NO: 77965 - DNA, 20 bp, Artificial Sequence
  Description of Artificial Sequence: Synthetic oligonucleotide
  Target: ATXN1; (-) strand; PAM type: NRG; PAM sequence: GAG
tcagagtcctgctatgtaga

SEQ ID NO: 77966 - DNA, 20 bp, Artificial Sequence
  Description of Artificial Sequence: Synthetic oligonucleotide
  Target: ATXN1; (-) strand; PAM type: NRG; PAM sequence: GAG
catcagagtcctgctatgta

SEQ ID NO: 77967 - DNA, 20 bp, Artificial Sequence
  Description of Artificial Sequence: Synthetic oligonucleotide
  Target: ATXN1; (-) strand; PAM type: NRG; PAM sequence: TAG
ggcatcagagtcctgctatg

SEQ ID NO: 77968 - DNA, 20 bp, Artificial Sequence
  Description of Artificial Sequence: Synthetic oligonucleotide
  Target: ATXN1; (-) strand; PAM type: NRG; PAM sequence: GAG
gatgcatttttctggcatca

SEQ ID NO: 77969 - DNA, 20 bp, Artificial Sequence
  Description of Artificial Sequence: Synthetic oligonucleotide
  Target: ATXN1; (-) strand; PAM type: NRG; PAM sequence: CAG
aggatgcatttttctggcat

SEQ ID NO: 77970 - DNA, 20 bp, Artificial Sequence
  Description of Artificial Sequence: Synthetic oligonucleotide
  Target: ATXN1; (-) strand; PAM type: NRG; PAM sequence: TGG
tagcagaggatgcatttttc

SEQ ID NO: 77971 - DNA, 20 bp, Artificial Sequence
  Description of Artificial Sequence: Synthetic oligonucleotide
  Target: ATXN1; (-) strand; PAM type: NRG; PAM sequence: AGG
ccaagccccctttgtagcag

SEQ ID NO: 77972 - DNA, 20 bp, Artificial Sequence
  Description of Artificial Sequence: Synthetic oligonucleotide
  Target: ATXN1; (-) strand; PAM type: NRG; PAM sequence: GAG
tccaagccccctttgtagca

SEQ ID NO: 77973 - DNA, 20 bp, Artificial Sequence
  Description of Artificial Sequence: Synthetic oligonucleotide
  Target: ATXN1; (-) strand; PAM type: NRG; PAM sequence: CAG
actccaagccccctttgtag

SEQ ID NO: 77974 - DNA, 20 bp, Artificial Sequence
  Description of Artificial Sequence: Synthetic oligonucleotide
  Target: ATXN1; (-) strand; PAM type: NRG; PAM sequence: TAG
ttcactccaagccccctttg

SEQ ID NO: 77975 - DNA, 20 bp, Artificial Sequence
  Description of Artificial Sequence: Synthetic oligonucleotide
  Target: ATXN1; (-) strand; PAM type: NRG; PAM sequence: AAG
cctgaccctagcttcactcc

SEQ ID NO: 77976 - DNA, 20 bp, Artificial Sequence
  Description of Artificial Sequence: Synthetic oligonucleotide
  Target: ATXN1; (-) strand; PAM type: NRG; PAM sequence: TAG
tctgaacttctccctgaccc

SEQ ID NO: 77977 - DNA, 20 bp, Artificial Sequence
  Description of Artificial Sequence: Synthetic oligonucleotide
  Target: ATXN1; (-) strand; PAM type: NRG; PAM sequence: TGG
agccatcgtgcaagagacag

SEQ ID NO: 77978 - DNA, 20 bp, Artificial Sequence
  Description of Artificial Sequence: Synthetic oligonucleotide
  Target: ATXN1; (-) strand; PAM type: NRG; PAM sequence: CAG
tgaagccatcgtgcaagaga

SEQ ID NO: 77979 - DNA, 20 bp, Artificial Sequence
  Description of Artificial Sequence: Synthetic oligonucleotide
  Target: ATXN1; (-) strand; PAM type: NRG; PAM sequence: GAG
tgggtgaagccatcgtgcaa

SEQ ID NO: 77980 - DNA, 20 bp, Artificial Sequence
  Description of Artificial Sequence: Synthetic oligonucleotide
  Target: ATXN1; (-) strand; PAM type: NRG; PAM sequence: AAG
aatgggtgaagccatcgtgc

SEQ ID NO: 77981 - DNA, 20 bp, Artificial Sequence
  Description of Artificial Sequence: Synthetic oligonucleotide
  Target: ATXN1; (-) strand; PAM type: NRG; PAM sequence: AAG
ttgctgcttggcaatgggtg

SEQ ID NO: 77982 - DNA, 20 bp, Artificial Sequence
  Description of Artificial Sequence: Synthetic oligonucleotide
  Target: ATXN1; (-) strand; PAM type: NRG; PAM sequence: GGG
catggttgctgcttggcaat

SEQ ID NO: 77983 - DNA, 20 bp, Artificial Sequence
  Description of Artificial Sequence: Synthetic oligonucleotide
  Target: ATXN1; (-) strand; PAM type: NRG; PAM sequence: TGG
gcatggttgctgcttggcaa

SEQ ID NO: 77984 - DNA, 20 bp, Artificial Sequence
  Description of Artificial Sequence: Synthetic oligonucleotide
  Target: ATXN1; (-) strand; PAM type: NRG; PAM sequence: TGG
ttccttgcatggttgctgct

SEQ ID NO: 77985 - DNA, 20 bp, Artificial Sequence
  Description of Artificial Sequence: Synthetic oligonucleotide
  Target: ATXN1; (-) strand; PAM type: NRG; PAM sequence: TGG
tattggggttcttccttgca

SEQ ID NO: 77986 - DNA, 20 bp, Artificial Sequence
  Description of Artificial Sequence: Synthetic oligonucleotide
  Target: ATXN1; (-) strand; PAM type: NRG; PAM sequence: GGG
ccacagggcaatctctattg

SEQ ID NO: 77987 - DNA, 20 bp, Artificial Sequence
  Description of Artificial Sequence: Synthetic oligonucleotide
  Target: ATXN1; (-) strand; PAM type: NRG; PAM sequence: GGG
gccacagggcaatctctatt

SEQ ID NO: 77988 - DNA, 20 bp, Artificial Sequence
  Description of Artificial Sequence: Synthetic oligonucleotide
  Target: ATXN1; (-) strand; PAM type: NRG; PAM sequence: TGG
agccacagggcaatctctat

SEQ ID NO: 77989 - DNA, 20 bp, Artificial Sequence
  Description of Artificial Sequence: Synthetic oligonucleotide
  Target: ATXN1; (-) strand; PAM type: NRG; PAM sequence: GGG
tgtagggagctggagccaca

SEQ ID NO: 77990 - DNA, 20 bp, Artificial Sequence
  Description of Artificial Sequence: Synthetic oligonucleotide
  Target: ATXN1; (-) strand; PAM type: NRG; PAM sequence: AGG
ttgtagggagctggagccac

SEQ ID NO: 77991 - DNA, 20 bp, Artificial Sequence
  Description of Artificial Sequence: Synthetic oligonucleotide
  Target: ATXN1; (-) strand; PAM type: NRG; PAM sequence: CAG
tttgtagggagctggagcca

SEQ ID NO: 77992 - DNA, 20 bp, Artificial Sequence
  Description of Artificial Sequence: Synthetic oligonucleotide
  Target: ATXN1; (-) strand; PAM type: NRG; PAM sequence: GAG
cacaaatttgtagggagctg

SEQ ID NO: 77993 - DNA, 20 bp, Artificial Sequence
  Description of Artificial Sequence: Synthetic oligonucleotide
  Target: ATXN1; (-) strand; PAM type: NRG; PAM sequence: TGG
tgcacaaatttgtagggagc

SEQ ID NO: 77994 - DNA, 20 bp, Artificial Sequence
  Description of Artificial Sequence: Synthetic oligonucleotide
  Target: ATXN1; (-) strand; PAM type: NRG; PAM sequence: GAG
cagctgcacaaatttgtagg

SEQ ID NO: 77995 - DNA, 20 bp, Artificial Sequence
  Description of Artificial Sequence: Synthetic oligonucleotide
  Target: ATXN1; (-) strand; PAM type: NRG; PAM sequence: GGG
agcagctgcacaaatttgta

SEQ ID NO: 77996 - DNA, 20 bp, Artificial Sequence
  Description of Artificial Sequence: Synthetic oligonucleotide
  Target: ATXN1; (-) strand; PAM type: NRG; PAM sequence: AGG
cagcagctgcacaaatttgt

SEQ ID NO: 77997 - DNA, 20 bp, Artificial Sequence
  Description of Artificial Sequence: Synthetic oligonucleotide
  Target: ATXN1; (-) strand; PAM type: NRG; PAM sequence: TAG
tcagcagctgcacaaatttg

SEQ ID NO: 77998 - DNA, 20 bp, Artificial Sequence
  Description of Artificial Sequence: Synthetic oligonucleotide
  Target: ATXN1; (-) strand; PAM type: NRG; PAM sequence: CAG
agaccaggtgtgtttttcag

SEQ ID NO: 77999 - DNA, 20 bp, Artificial Sequence
  Description of Artificial Sequence: Synthetic oligonucleotide
  Target: ATXN1; (-) strand; PAM type: NRG; PAM sequence: CAG
actagaccaggtgtgttttt

SEQ ID NO: 78000 - DNA, 20 bp, Artificial Sequence
  Description of Artificial Sequence: Synthetic oligonucleotide
  Target: ATXN1; (-) strand; PAM type: NRG; PAM sequence: AGG
tcttaaaaatgtactagacc

SEQ ID NO: 78001 - DNA, 20 bp, Artificial Sequence
  Description of Artificial Sequence: Synthetic oligonucleotide
  Target: ATXN1; (-) strand; PAM type: NRG; PAM sequence: CAG
ttcttaaaaatgtactagac

SEQ ID NO: 78002 - DNA, 20 bp, Artificial Sequence
  Description of Artificial Sequence: Synthetic oligonucleotide
  Target: ATXN1; (-) strand; PAM type: NRG; PAM sequence: TAG
ctttgttcttaaaaatgtac

SEQ ID NO: 78003 - DNA, 20 bp, Artificial Sequence
  Description of Artificial Sequence: Synthetic oligonucleotide
  Target: ATXN1; (-) strand; PAM type: NRG; PAM sequence: AGG
tttcctcggtcttaagctga

SEQ ID NO: 78004 - DNA, 20 bp, Artificial Sequence
  Description of Artificial Sequence: Synthetic oligonucleotide
  Target: ATXN1; (-) strand; PAM type: NRG; PAM sequence: AAG
ctttcctcggtcttaagctg

SEQ ID NO: 78005 - DNA, 20 bp, Artificial Sequence
  Description of Artificial Sequence: Synthetic oligonucleotide
  Target: ATXN1; (-) strand; PAM type: NRG; PAM sequence: AAG
ggactcctttcctcggtctt

SEQ ID NO: 78006 - DNA, 20 bp, Artificial Sequence
  Description of Artificial Sequence: Synthetic oligonucleotide
  Target: ATXN1; (-) strand; PAM type: NRG; PAM sequence: CGG
aaaggttggactcctttcct

SEQ ID NO: 78007 - DNA, 20 bp, Artificial Sequence
  Description of Artificial Sequence: Synthetic oligonucleotide
  Target: ATXN1; (-) strand; PAM type: NRG; PAM sequence: TGG
ctgtaccattagggaaaggt

SEQ ID NO: 78008 - DNA, 20 bp, Artificial Sequence
  Description of Artificial Sequence: Synthetic oligonucleotide
  Target: ATXN1; (-) strand; PAM type: NRG; PAM sequence: AGG
atctctgtaccattagggaa

SEQ ID NO: 78009 - DNA, 20 bp, Artificial Sequence
  Description of Artificial Sequence: Synthetic oligonucleotide
  Target: ATXN1; (-) strand; PAM type: NRG; PAM sequence: AAG
aatctctgtaccattaggga

SEQ ID NO: 78010 - DNA, 20 bp, Artificial Sequence
  Description of Artificial Sequence: Synthetic oligonucleotide
  Target: ATXN1; (-) strand; PAM type: NRG; PAM sequence: GGG
aaataatctctgtaccatta

SEQ ID NO: 78011 - DNA, 20 bp, Artificial Sequence
  Description of Artificial Sequence: Synthetic oligonucleotide
  Target: ATXN1; (-) strand; PAM type: NRG; PAM sequence: AGG
caaataatctctgtaccatt

SEQ ID NO: 78012 - DNA, 20 bp, Artificial Sequence
  Description of Artificial Sequence: Synthetic oligonucleotide
  Target: ATXN1; (-) strand; PAM type: NRG; PAM sequence: TAG
tcaaataatctctgtaccat

SEQ ID NO: 78013 - DNA, 20 bp, Artificial Sequence
  Description of Artificial Sequence: Synthetic oligonucleotide
  Target: ATXN1; (-) strand; PAM type: NRG; PAM sequence: TGG
atgggagggctagcccgccc

SEQ ID NO: 78014 - DNA, 20 bp, Artificial Sequence
  Description of Artificial Sequence: Synthetic oligonucleotide
  Target: ATXN1; (-) strand; PAM type: NRG; PAM sequence: TAG
tcattgaatgatgggagggc

SEQ ID NO: 78015 - DNA, 20 bp, Artificial Sequence
  Description of Artificial Sequence: Synthetic oligonucleotide
  Target: ATXN1; (-) strand; PAM type: NRG; PAM sequence: GGG
ctcatcattgaatgatggga

SEQ ID NO: 78016 - DNA, 20 bp, Artificial Sequence
  Description of Artificial Sequence: Synthetic oligonucleotide
  Target: ATXN1; (-) strand; PAM type: NRG; PAM sequence: AGG
gctcatcattgaatgatggg

SEQ ID NO: 78017 - DNA, 20 bp, Artificial Sequence
  Description of Artificial Sequence: Synthetic oligonucleotide
  Target: ATXN1; (-) strand; PAM type: NRG; PAM sequence: GAG
tgctcatcattgaatgatgg

SEQ ID NO: 78018 - DNA, 20 bp, Artificial Sequence
  Description of Artificial Sequence: Synthetic oligonucleotide
  Target: ATXN1; (-) strand; PAM type: NRG; PAM sequence: GGG
tctgctcatcattgaatgat

SEQ ID NO: 78019 - DNA, 20 bp, Artificial Sequence
  Description of Artificial Sequence: Synthetic oligonucleotide
  Target: ATXN1; (-) strand; PAM type: NRG; PAM sequence: TGG
gtctgctcatcattgaatga

SEQ ID NO: 78020 - DNA, 20 bp, Artificial Sequence
  Description of Artificial Sequence: Synthetic oligonucleotide
  Target: ATXN1; (-) strand; PAM type: NRG; PAM sequence: GGG
agcccaatgttgccagtttt

SEQ ID NO: 78021 - DNA, 20 bp, Artificial Sequence
  Description of Artificial Sequence: Synthetic oligonucleotide
  Target: ATXN1; (-) strand; PAM type: NRG; PAM sequence: TGG
aagcccaatgttgccagttt

SEQ ID NO: 78022 - DNA, 20 bp, Artificial Sequence
  Description of Artificial Sequence: Synthetic oligonucleotide
  Target: ATXN1; (-) strand; PAM type: NRG; PAM sequence: CAG
ccttataagcccaatgttgc

SEQ ID NO: 78023 - DNA, 20 bp, Artificial Sequence
  Description of Artificial Sequence: Synthetic oligonucleotide
  Target: ATXN1; (-) strand; PAM type: NRG; PAM sequence: AAG
tttgttaaccaagtccttat

SEQ ID NO: 78024 - DNA, 20 bp, Artificial Sequence
  Description of Artificial Sequence: Synthetic oligonucleotide
  Target: ATXN1; (-) strand; PAM type: NRG; PAM sequence: AAG
tgtttcttgttttgttaacc

SEQ ID NO: 78025 - DNA, 20 bp, Artificial Sequence
  Description of Artificial Sequence: Synthetic oligonucleotide
  Target: ATXN1; (-) strand; PAM type: NRG; PAM sequence: TGG
cgtcttcttcctttatttct

SEQ ID NO: 78026 - DNA, 20 bp, Artificial Sequence
  Description of Artificial Sequence: Synthetic oligonucleotide
  Target: ATXN1; (-) strand; PAM type: NRG; PAM sequence: TAG
aaacttgtttctatttccag

SEQ ID NO: 78027 - DNA, 20 bp, Artificial Sequence
  Description of Artificial Sequence: Synthetic oligonucleotide
  Target: ATXN1; (-) strand; PAM type: NRG; PAM sequence: CAG
ctgaaacttgtttctatttc

SEQ ID NO: 78028 - DNA, 20 bp, Artificial Sequence
  Description of Artificial Sequence: Synthetic oligonucleotide
  Target: ATXN1; (-) strand; PAM type: NRG; PAM sequence: AGG
ttttcctcctccttcttcaa

SEQ ID NO: 78029 - DNA, 20 bp, Artificial Sequence
  Description of Artificial Sequence: Synthetic oligonucleotide
  Target: ATXN1; (-) strand; PAM type: NRG; PAM sequence: AAG
tttttcctcctccttcttca

SEQ ID NO: 78030 - DNA, 20 bp, Artificial Sequence
  Description of Artificial Sequence: Synthetic oligonucleotide
  Target: ATXN1; (-) strand; PAM type: NRG; PAM sequence: GGG
tgtcattcacgcctaagtct

SEQ ID NO: 78031 - DNA, 20 bp, Artificial Sequence
  Description of Artificial Sequence: Synthetic oligonucleotide
  Target: ATXN1; (-) strand; PAM type: NRG; PAM sequence: TGG
ttgtcattcacgcctaagtc

SEQ ID NO: 78032 - DNA, 20 bp, Artificial Sequence
  Description of Artificial Sequence: Synthetic oligonucleotide
  Target: ATXN1; (-) strand; PAM type: NRG; PAM sequence: AAG
tttacttgtcattcacgcct

SEQ ID NO: 78033 - DNA, 20 bp, Artificial Sequence
  Description of Artificial Sequence: Synthetic oligonucleotide
  Target: ATXN1; (-) strand; PAM type: NRG; PAM sequence: TGG
cctaatttttttttgtaagt

SEQ ID NO: 78034 - DNA, 20 bp, Artificial Sequence
  Description of Artificial Sequence: Synthetic oligonucleotide
  Target: ATXN1; (-) strand; PAM type: NRG; PAM sequence: AAG
aaatcctaatttttttttgt

SEQ ID NO: 78035 - DNA, 20 bp, Artificial Sequence
  Description of Artificial Sequence: Synthetic oligonucleotide
  Target: ATXN1; (-) strand; PAM type: NRG; PAM sequence: CAG
taaataatactttggaaaat

SEQ ID NO: 78036 - DNA, 20 bp, Artificial Sequence
  Description of Artificial Sequence: Synthetic oligonucleotide
  Target: ATXN1; (-) strand; PAM type: NRG; PAM sequence: TGG
tgtagttttaaataatactt

SEQ ID NO: 78037 - DNA, 20 bp, Artificial Sequence
  Description of Artificial Sequence: Synthetic oligonucleotide
  Target: ATXN1; (-) strand; PAM type: NRG; PAM sequence: TAG
ccttttcattgcatcgaatg

SEQ ID NO: 78038 - DNA, 20 bp, Artificial Sequence
  Description of Artificial Sequence: Synthetic oligonucleotide
  Target: ATXN1; (-) strand; PAM type: NRG; PAM sequence: AGG
ttgctggtttgatgctccaa

SEQ ID NO: 78039 - DNA, 20 bp, Artificial Sequence
  Description of Artificial Sequence: Synthetic oligonucleotide
  Target: ATXN1; (-) strand; PAM type: NRG; PAM sequence: AAG
cttgctggtttgatgctcca

SEQ ID NO: 78040 - DNA, 20 bp, Artificial Sequence
  Description of Artificial Sequence: Synthetic oligonucleotide
  Target: ATXN1; (-) strand; PAM type: NRG; PAM sequence: TGG
caggtttgttcttcacttgc

SEQ ID NO: 78041 - DNA, 20 bp, Artificial Sequence
  Description of Artificial Sequence: Synthetic oligonucleotide
  Target: ATXN1; (-) strand; PAM type: NRG; PAM sequence: AGG
gccttttgggagactttttc

SEQ ID NO: 78042 - DNA, 20 bp, Artificial Sequence
  Description of Artificial Sequence: Synthetic oligonucleotide
  Target: ATXN1; (-) strand; PAM type: NRG; PAM sequence: CAG
tgccttttgggagacttttt

SEQ ID NO: 78043 - DNA, 20 bp, Artificial Sequence
  Description of Artificial Sequence: Synthetic oligonucleotide
  Target: ATXN1; (-) strand; PAM type: NRG; PAM sequence: GAG
ttttttccagtgccttttgg

SEQ ID NO: 78044 - DNA, 20 bp, Artificial Sequence
  Description of Artificial Sequence: Synthetic oligonucleotide
  Target: ATXN1; (-) strand; PAM type: NRG; PAM sequence: GGG
tcttttttccagtgcctttt

SEQ ID NO: 78045 - DNA, 20 bp, Artificial Sequence
  Description of Artificial Sequence: Synthetic oligonucleotide
  Target: ATXN1; (-) strand; PAM type: NRG; PAM sequence: TGG
atcttttttccagtgccttt

SEQ ID NO: 78046 - DNA, 20 bp, Artificial Sequence
  Description of Artificial Sequence: Synthetic oligonucleotide
  Target: ATXN1; (-) strand; PAM type: NRG; PAM sequence: CAG
tatacttttcatcttttttc

SEQ ID NO: 78047 - DNA, 20 bp, Artificial Sequence
  Description of Artificial Sequence: Synthetic oligonucleotide
  Target: ATXN1; (-) strand; PAM type: NRG; PAM sequence: TAG
actttgtctcctgtatccat

SEQ ID NO: 78048 - DNA, 20 bp, Artificial Sequence
  Description of Artificial Sequence: Synthetic oligonucleotide
  Target: ATXN1; (-) strand; PAM type: NRG; PAM sequence: TGG
caatcatgctatctctatgt

SEQ ID NO: 78049 - DNA, 20 bp, Artificial Sequence
  Description of Artificial Sequence: Synthetic oligonucleotide
  Target: ATXN1; (-) strand; PAM type: NRG; PAM sequence: TGG
ttctttaataattgcttctg

SEQ ID NO: 78050 - DNA, 20 bp, Artificial Sequence
  Description of Artificial Sequence: Synthetic oligonucleotide
  Target: ATXN1; (-) strand; PAM type: NRG; PAM sequence: TAG
tactctgtatttcttcagtt

SEQ ID NO: 78051 - DNA, 20 bp, Artificial Sequence
  Description of Artificial Sequence: Synthetic oligonucleotide
  Target: ATXN1; (-) strand; PAM type: NRG; PAM sequence: CAG
tggtttactctgtatttctt

SEQ ID NO: 78052 - DNA, 20 bp, Artificial Sequence
  Description of Artificial Sequence: Synthetic oligonucleotide
  Target: ATXN1; (-) strand; PAM type: NRG; PAM sequence: TGG
tggttggttggttggttggt

SEQ ID NO: 78053 - DNA, 20 bp, Artificial Sequence
  Description of Artificial Sequence: Synthetic oligonucleotide
  Target: ATXN1; (-) strand; PAM type: NRG; PAM sequence: TGG
tggttggttggttggttggt

SEQ ID NO: 78054 - DNA, 20 bp, Artificial Sequence
  Description of Artificial Sequence: Synthetic oligonucleotide
  Target: ATXN1; (-) strand; PAM type: NRG; PAM sequence: TGG
tttttggttggttggttggt

SEQ ID NO: 78055 - DNA, 20 bp, Artificial Sequence
  Description of Artificial Sequence: Synthetic oligonucleotide
  Target: ATXN1; (-) strand; PAM type: NRG; PAM sequence: TGG
tgagtttttggttggttggt

SEQ ID NO: 78056 - DNA, 20 bp, Artificial Sequence
  Description of Artificial Sequence: Synthetic oligonucleotide
  Target: ATXN1; (-) strand; PAM type: NRG; PAM sequence: TGG
agagtgagtttttggttggt

SEQ ID NO: 78057 - DNA, 20 bp, Artificial Sequence
  Description of Artificial Sequence: Synthetic oligonucleotide
  Target: ATXN1; (-) strand; PAM type: NRG; PAM sequence: TGG
gtatagagtgagtttttggt

SEQ ID NO: 78058 - DNA, 20 bp, Artificial Sequence
  Description of Artificial Sequence: Synthetic oligonucleotide
  Target: ATXN1; (-) strand; PAM type: NRG; PAM sequence: TGG
tcttgtatagagtgagtttt

SEQ ID NO: 78059 - DNA, 20 bp, Artificial Sequence
  Description of Artificial Sequence: Synthetic oligonucleotide
  Target: ATXN1; (-) strand; PAM type: NRG; PAM sequence: GAG
tttttcttcttgtatagagt

SEQ ID NO: 78060 - DNA, 20 bp, Artificial Sequence
  Description of Artificial Sequence: Synthetic oligonucleotide
  Target: ATXN1; (-) strand; PAM type: NRG; PAM sequence: GAG
catttttttcttcttgtata

SEQ ID NO: 78061 - DNA, 20 bp, Artificial Sequence
  Description of Artificial Sequence: Synthetic oligonucleotide
  Target: ATXN1; (-) strand; PAM type: NRG; PAM sequence: TAG
ttcatttttttcttcttgta

SEQ ID NO: 78062 - DNA, 20 bp, Artificial Sequence
  Description of Artificial Sequence: Synthetic oligonucleotide
  Target: ATXN1; (-) strand; PAM type: NRG; PAM sequence: CAG
atttatattaatatttatat

SEQ ID NO: 78063 - DNA, 20 bp, Artificial Sequence
  Description of Artificial Sequence: Synthetic oligonucleotide
  Target: ATXN1; (-) strand; PAM type: NRG; PAM sequence: AAG
gaaggtaaataaatagatgg

SEQ ID NO: 78064 - DNA, 20 bp, Artificial Sequence
  Description of Artificial Sequence: Synthetic oligonucleotide
  Target: ATXN1; (-) strand; PAM type: NRG; PAM sequence: TGG
ccagaaggtaaataaataga

SEQ ID NO: 78065 - DNA, 20 bp, Artificial Sequence
  Description of Artificial Sequence: Synthetic oligonucleotide
  Target: ATXN1; (-) strand; PAM type: NRG; PAM sequence: TAG
tgcaccagaaggtaaataaa

SEQ ID NO: 78066 - DNA, 20 bp, Artificial Sequence
  Description of Artificial Sequence: Synthetic oligonucleotide
  Target: ATXN1; (-) strand; PAM type: NRG; PAM sequence: AGG
acctcaaaagttgcaccaga

SEQ ID NO: 78067 - DNA, 20 bp, Artificial Sequence
  Description of Artificial Sequence: Synthetic oligonucleotide
  Target: ATXN1; (-) strand; PAM type: NRG; PAM sequence: AAG
gacctcaaaagttgcaccag

SEQ ID NO: 78068 - DNA, 20 bp, Artificial Sequence
  Description of Artificial Sequence: Synthetic oligonucleotide
  Target: ATXN1; (-) strand; PAM type: NRG; PAM sequence: CAG
tttgacctcaaaagttgcac

SEQ ID NO: 78069 - DNA, 20 bp, Artificial Sequence
  Description of Artificial Sequence: Synthetic oligonucleotide
  Target: ATXN1; (-) strand; PAM type: NRG; PAM sequence: AAG
atgagttgttttgacctcaa

SEQ ID NO: 78070 - DNA, 20 bp, Artificial Sequence
  Description of Artificial Sequence: Synthetic oligonucleotide
  Target: ATXN1; (-) strand; PAM type: NRG; PAM sequence: GAG
cctcctcactgaatgcttat

SEQ ID NO: 78071 - DNA, 20 bp, Artificial Sequence
  Description of Artificial Sequence: Synthetic oligonucleotide
  Target: ATXN1; (-) strand; PAM type: NRG; PAM sequence: TGG
ttttttccaccttggtgacc

SEQ ID NO: 78072 - DNA, 20 bp, Artificial Sequence
  Description of Artificial Sequence: Synthetic oligonucleotide
  Target: ATXN1; (-) strand; PAM type: NRG; PAM sequence: TGG
atctgattttttttccacct

SEQ ID NO: 78073 - DNA, 20 bp, Artificial Sequence
  Description of Artificial Sequence: Synthetic oligonucleotide
  Target: ATXN1; (-) strand; PAM type: NRG; PAM sequence: CAG
tgttttatttcttctattgt

SEQ ID NO: 78074 - DNA, 20 bp, Artificial Sequence
  Description of Artificial Sequence: Synthetic oligonucleotide
  Target: ATXN1; (-) strand; PAM type: NRG; PAM sequence: TAG
cctttgccattagagctgtg

SEQ ID NO: 78075 - DNA, 20 bp, Artificial Sequence
  Description of Artificial Sequence: Synthetic oligonucleotide
  Target: ATXN1; (-) strand; PAM type: NRG; PAM sequence: GAG
atcagaaccctttgccatta

SEQ ID NO: 78076 - DNA, 20 bp, Artificial Sequence
  Description of Artificial Sequence: Synthetic oligonucleotide
  Target: ATXN1; (-) strand; PAM type: NRG; PAM sequence: TAG
gtatcagaaccctttgccat

SEQ ID NO: 78077 - DNA, 20 bp, Artificial Sequence
  Description of Artificial Sequence: Synthetic oligonucleotide
  Target: ATXN1; (-) strand; PAM type: NRG; PAM sequence: CAG
ttagtttggaatttttgtat

SEQ ID NO: 78078 - DNA, 20 bp, Artificial Sequence
  Description of Artificial Sequence: Synthetic oligonucleotide
  Target: ATXN1; (-) strand; PAM type: NRG; PAM sequence: TGG
agtaggaaagttggttagtt

SEQ ID NO: 78079 - DNA, 20 bp, Artificial Sequence
  Description of Artificial Sequence: Synthetic oligonucleotide
  Target: ATXN1; (-) strand; PAM type: NRG; PAM sequence: TAG
accttagtaggaaagttggt

SEQ ID NO: 78080 - DNA, 20 bp, Artificial Sequence
  Description of Artificial Sequence: Synthetic oligonucleotide
  Target: ATXN1; (-) strand; PAM type: NRG; PAM sequence: TGG
tcataccttagtaggaaagt

SEQ ID NO: 78081 - DNA, 20 bp, Artificial Sequence
  Description of Artificial Sequence: Synthetic oligonucleotide
  Target: ATXN1; (-) strand; PAM type: NRG; PAM sequence: AAG
actctcataccttagtagga

SEQ ID NO: 78082 - DNA, 20 bp, Artificial Sequence
  Description of Artificial Sequence: Synthetic oligonucleotide
  Target: ATXN1; (-) strand; PAM type: NRG; PAM sequence: AGG
tttaactctcataccttagt

SEQ ID NO: 78083 - DNA, 20 bp, Artificial Sequence
  Description of Artificial Sequence: Synthetic oligonucleotide
  Target: ATXN1; (-) strand; PAM type: NRG; PAM sequence: TAG
ttttaactctcataccttag

SEQ ID NO: 78084 - DNA, 20 bp, Artificial Sequence
  Description of Artificial Sequence: Synthetic oligonucleotide
  Target: ATXN1; (-) strand; PAM type: NRG; PAM sequence: TAG
attttttaactctcatacct

SEQ ID NO: 78085 - DNA, 20 bp, Artificial Sequence
  Description of Artificial Sequence: Synthetic oligonucleotide
  Target: ATXN1; (-) strand; PAM type: NRG; PAM sequence: AAG
tttgttgctccttgggatcc

SEQ ID NO: 78086 - DNA, 20 bp, Artificial Sequence
  Description of Artificial Sequence: Synthetic oligonucleotide
  Target: ATXN1; (-) strand; PAM type: NRG; PAM sequence: GGG
ttgtgtttttgttgctcctt

SEQ ID NO: 78087 - DNA, 20 bp, Artificial Sequence
  Description of Artificial Sequence: Synthetic oligonucleotide
  Target: ATXN1; (-) strand; PAM type: NRG; PAM sequence: TGG
attgtgtttttgttgctcct

SEQ ID NO: 78088 - DNA, 20 bp, Artificial Sequence
  Description of Artificial Sequence: Synthetic oligonucleotide
  Target: ATXN1; (-) strand; PAM type: NRG; PAM sequence: GAG
taaatttttgattgattagg

SEQ ID NO: 78089 - DNA, 20 bp, Artificial Sequence
  Description of Artificial Sequence: Synthetic oligonucleotide
  Target: ATXN1; (-) strand; PAM type: NRG; PAM sequence: GGG
attaaatttttgattgatta

SEQ ID NO: 78090 - DNA, 20 bp, Artificial Sequence
  Description of Artificial Sequence: Synthetic oligonucleotide
  Target: ATXN1; (-) strand; PAM type: NRG; PAM sequence: AGG
aattaaatttttgattgatt

SEQ ID NO: 78091 - DNA, 20 bp, Artificial Sequence
  Description of Artificial Sequence: Synthetic oligonucleotide
  Target: ATXN1; (-) strand; PAM type: NRG; PAM sequence: TAG
aaattaaatttttgattgat

SEQ ID NO: 78092 - DNA, 20 bp, Artificial Sequence
  Description of Artificial Sequence: Synthetic oligonucleotide
  Target: ATXN1; (-) strand; PAM type: NRG; PAM sequence: AAG
ccatattgtgaactgtttta

SEQ ID NO: 78093 - DNA, 20 bp, Artificial Sequence
  Description of Artificial Sequence: Synthetic oligonucleotide
  Target: ATXN1; (-) strand; PAM type: NRG; PAM sequence: GGG
cagggatgagcccctgtgct

SEQ ID NO: 78094 - DNA, 20 bp, Artificial Sequence
  Description of Artificial Sequence: Synthetic oligonucleotide
  Target: ATXN1; (-) strand; PAM type: NRG; PAM sequence: TGG
acagggatgagcccctgtgc

SEQ ID NO: 78095 - DNA, 20 bp, Artificial Sequence
  Description of Artificial Sequence: Synthetic oligonucleotide
  Target: ATXN1; (-) strand; PAM type: NRG; PAM sequence: GAG
agttctgggattacagggat

SEQ ID NO: 78096 - DNA, 20 bp, Artificial Sequence
  Description of Artificial Sequence: Synthetic oligonucleotide
  Target: ATXN1; (-) strand; PAM type: NRG; PAM sequence: GGG
cccaaagttctgggattaca

SEQ ID NO: 78097 - DNA, 20 bp, Artificial Sequence
  Description of Artificial Sequence: Synthetic oligonucleotide
  Target: ATXN1; (-) strand; PAM type: NRG; PAM sequence: AGG
tcccaaagttctgggattac

SEQ ID NO: 78098 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagttctgggatta

SEQ ID NO: 78099 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagttct

SEQ ID NO: 78100 - DNA, 20 bp, Artificial Sequence
  Description of Artificial Sequence: Synthetic oligonucleotide
  Target: ATXN1; (-) strand; PAM type: NRG; PAM sequence: TGG
acctcggcctcccaaagttc

SEQ ID NO: 78101 - DNA, 20 bp, Artificial Sequence
  Description of Artificial Sequence: Synthetic oligonucleotide
  Target: ATXN1; (-) strand; PAM type: NRG; PAM sequence: AAG
cctcccacctcggcctccca

SEQ ID NO: 78102 - DNA, 20 bp, Artificial Sequence
  Description of Artificial Sequence: Synthetic oligonucleotide
  Target: ATXN1; (-) strand; PAM type: NRG; PAM sequence: CGG
ctcaagcaatcctcccacct

SEQ ID NO: 78103 - DNA, 20 bp, Artificial Sequence
  Description of Artificial Sequence: Synthetic oligonucleotide
  Target: ATXN1; (-) strand; PAM type: NRG; PAM sequence: AAG
ggttttaaactcttggcctc

SEQ ID NO: 78104 - DNA, 20 bp, Artificial Sequence
  Description of Artificial Sequence: Synthetic oligonucleotide
  Target: ATXN1; (-) strand; PAM type: NRG; PAM sequence: TGG
cccgggtggttttaaactct

SEQ ID NO: 78105 - DNA, 20 bp, Artificial Sequence
  Description of Artificial Sequence: Synthetic oligonucleotide
  Target: ATXN1; (-) strand; PAM type: NRG; PAM sequence: TGG
tctcgatgtgttgtcccggg

SEQ ID NO: 78106 - DNA, 20 bp, Artificial Sequence
  Description of Artificial Sequence: Synthetic oligonucleotide
  Target: ATXN1; (-) strand; PAM type: NRG; PAM sequence: GGG
acgtctcgatgtgttgtccc

SEQ ID NO: 78107 - DNA, 20 bp, Artificial Sequence
  Description of Artificial Sequence: Synthetic oligonucleotide
  Target: ATXN1; (-) strand; PAM type: NRG; PAM sequence: CGG
gacgtctcgatgtgttgtcc

SEQ ID NO: 78108 - DNA, 20 bp, Artificial Sequence
  Description of Artificial Sequence: Synthetic oligonucleotide
  Target: ATXN1; (-) strand; PAM type: NRG; PAM sequence: TAG
atttttttttttttttttta

SEQ ID NO: 78109 - DNA, 20 bp, Artificial Sequence
  Description of Artificial Sequence: Synthetic oligonucleotide
  Target: ATXN1; (-) strand; PAM type: NRG; PAM sequence: TGG
caggcacacagccccacgcc

SEQ ID NO: 78110 - DNA, 20 bp, Artificial Sequence
  Description of Artificial Sequence: Synthetic oligonucleotide
  Target: ATXN1; (-) strand; PAM type: NRG; PAM sequence: CAG
tagctgggactacaggcaca

SEQ ID NO: 78111 - DNA, 20 bp, Artificial Sequence
  Description of Artificial Sequence: Synthetic oligonucleotide
  Target: ATXN1; (-) strand; PAM type: NRG; PAM sequence: AGG
tcctaagtagctgggactac

SEQ ID NO: 78112 - DNA, 20 bp, Artificial Sequence
  Description of Artificial Sequence: Synthetic oligonucleotide
  Target: ATXN1; (-) strand; PAM type: NRG; PAM sequence: CAG
ctcctaagtagctgggacta

SEQ ID NO: 78113 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctaagtagct

SEQ ID NO: 78114 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcctaagtagc

SEQ ID NO: 78115 - DNA, 20 bp, Artificial Sequence
  Description of Artificial Sequence: Synthetic oligonucleotide
  Target: ATXN1; (-) strand; PAM type: NRG; PAM sequence: TAG
ccccacctcagcctcctaag

SEQ ID NO: 78116 - DNA, 20 bp, Artificial Sequence
  Description of Artificial Sequence: Synthetic oligonucleotide
  Target: ATXN1; (-) strand; PAM type: NRG; PAM sequence: AAG
atcccccacctcagcctcct

SEQ ID NO: 78117 - DNA, 20 bp, Artificial Sequence
  Description of Artificial Sequence: Synthetic oligonucleotide
  Target: ATXN1; (-) strand; PAM type: NRG; PAM sequence: CAG
ctctaaaggatcccccacct

SEQ ID NO: 78118 - DNA, 20 bp, Artificial Sequence
  Description of Artificial Sequence: Synthetic oligonucleotide
  Target: ATXN1; (-) strand; PAM type: NRG; PAM sequence: AGG
ccttgacctcctggctctaa

SEQ ID NO: 78119 - DNA, 20 bp, Artificial Sequence
  Description of Artificial Sequence: Synthetic oligonucleotide
  Target: ATXN1; (-) strand; PAM type: NRG; PAM sequence: AAG
gccttgacctcctggctcta

SEQ ID NO: 78120 - DNA, 20 bp, Artificial Sequence
  Description of Artificial Sequence: Synthetic oligonucleotide
  Target: ATXN1; (-) strand; PAM type: NRG; PAM sequence: TGG
tcgctgcagccttgacctcc

SEQ ID NO: 78121 - DNA, 20 bp, Artificial Sequence
  Description of Artificial Sequence: Synthetic oligonucleotide
  Target: ATXN1; (-) strand; PAM type: NRG; PAM sequence: CAG
ggtgggatcataactcgctg

SEQ ID NO: 78122 - DNA, 20 bp, Artificial Sequence
  Description of Artificial Sequence: Synthetic oligonucleotide
  Target: ATXN1; (-) strand; PAM type: NRG; PAM sequence: GGG
gcagcctggagtgcactggt

SEQ ID NO: 78123 - DNA, 20 bp, Artificial Sequence
  Description of Artificial Sequence: Synthetic oligonucleotide
  Target: ATXN1; (-) strand; PAM type: NRG; PAM sequence: TGG
tgcagcctggagtgcactgg

SEQ ID NO: 78124 - DNA, 20 bp, Artificial Sequence
  Description of Artificial Sequence: Synthetic oligonucleotide
  Target: ATXN1; (-) strand; PAM type: NRG; PAM sequence: TGG
tggtgcagcctggagtgcac

SEQ ID NO: 78125 - DNA, 20 bp, Artificial Sequence
  Description of Artificial Sequence: Synthetic oligonucleotide
  Target: ATXN1; (-) strand; PAM type: NRG; PAM sequence: GAG
ttgctctgtggtgcagcctg

SEQ ID NO: 78126 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgtggtgcagcc

SEQ ID NO: 78127 - DNA, 20 bp, Artificial Sequence
  Description of Artificial Sequence: Synthetic oligonucleotide
  Target: ATXN1; (-) strand; PAM type: NRG; PAM sequence: CAG
cagggtcttgctctgtggtg

SEQ ID NO: 78128 - DNA, 20 bp, Artificial Sequence
  Description of Artificial Sequence: Synthetic oligonucleotide
  Target: ATXN1; (-) strand; PAM type: NRG; PAM sequence: TGG
agagacagggtcttgctctg

SEQ ID NO: 78129 - DNA, 20 bp, Artificial Sequence
  Description of Artificial Sequence: Synthetic oligonucleotide
  Target: ATXN1; (-) strand; PAM type: NRG; PAM sequence: GGG
tatatttttctctagagaca

SEQ ID NO: 78130 - DNA, 20 bp, Artificial Sequence
  Description of Artificial Sequence: Synthetic oligonucleotide
  Target: ATXN1; (-) strand; PAM type: NRG; PAM sequence: AGG
atatatttttctctagagac

SEQ ID NO: 78131 - DNA, 20 bp, Artificial Sequence
  Description of Artificial Sequence: Synthetic oligonucleotide
  Target: ATXN1; (-) strand; PAM type: NRG; PAM sequence: CAG
tatatatttttctctagaga

SEQ ID NO: 78132 - DNA, 20 bp, Artificial Sequence
  Description of Artificial Sequence: Synthetic oligonucleotide
  Target: ATXN1; (-) strand; PAM type: NRG; PAM sequence: GAG
tgtgtatatatttttctcta

SEQ ID NO: 78133 - DNA, 20 bp, Artificial Sequence
  Description of Artificial Sequence: Synthetic oligonucleotide
  Target: ATXN1; (-) strand; PAM type: NRG; PAM sequence: TAG
tatgtgtatatatttttctc

SEQ ID NO: 78134 - DNA, 20 bp, Artificial Sequence
  Description of Artificial Sequence: Synthetic oligonucleotide
  Target: ATXN1; (-) strand; PAM type: NRG; PAM sequence: CAG
ttcctttttataacgatatt

SEQ ID NO: 78135 - DNA, 20 bp, Artificial Sequence
  Description of Artificial Sequence: Synthetic oligonucleotide
  Target: ATXN1; (-) strand; PAM type: NRG; PAM sequence: AGG
ttatgtaacttttcttaata

SEQ ID NO: 78136 - DNA, 20 bp, Artificial Sequence
  Description of Artificial Sequence: Synthetic oligonucleotide
  Target: ATXN1; (-) strand; PAM type: NRG; PAM sequence: AAG
attatgtaacttttcttaat

SEQ ID NO: 78137 - DNA, 20 bp, Artificial Sequence
  Description of Artificial Sequence: Synthetic oligonucleotide
  Target: ATXN1; (-) strand; PAM type: NRG; PAM sequence: CAG
gacatatagatgttttgatc

SEQ ID NO: 78138 - DNA, 20 bp, Artificial Sequence
  Description of Artificial Sequence: Synthetic oligonucleotide
  Target: ATXN1; (-) strand; PAM type: NRG; PAM sequence: TAG
taaagttagatatagacata

SEQ ID NO: 78139 - DNA, 20 bp, Artificial Sequence
  Description of Artificial Sequence: Synthetic oligonucleotide
  Target: ATXN1; (-) strand; PAM type: NRG; PAM sequence: TAG
ttcttttttaaagttagata

SEQ ID NO: 78140 - DNA, 20 bp, Artificial Sequence
  Description of Artificial Sequence: Synthetic oligonucleotide
  Target: ATXN1; (-) strand; PAM type: NRG; PAM sequence: TAG
ctccttttcttttttaaagt

SEQ ID NO: 78141 - DNA, 20 bp, Artificial Sequence
  Description of Artificial Sequence: Synthetic oligonucleotide
  Target: ATXN1; (-) strand; PAM type: NRG; PAM sequence: AAG
aattctccttttctttttta

SEQ ID NO: 78142 - DNA, 20 bp, Artificial Sequence
  Description of Artificial Sequence: Synthetic oligonucleotide
  Target: ATXN1; (-) strand; PAM type: NRG; PAM sequence: TGG
taacacattttattctcctt

SEQ ID NO: 78143 - DNA, 20 bp, Artificial Sequence
  Description of Artificial Sequence: Synthetic oligonucleotide
  Target: ATXN1; (-) strand; PAM type: NRG; PAM sequence: AAG
acctcctccctgtataagat

SEQ ID NO: 78144 - DNA, 20 bp, Artificial Sequence
  Description of Artificial Sequence: Synthetic oligonucleotide
  Target: ATXN1; (-) strand; PAM type: NRG; PAM sequence: AAG
accatacctcctccctgtat

SEQ ID NO: 78145 - DNA, 20 bp, Artificial Sequence
  Description of Artificial Sequence: Synthetic oligonucleotide
  Target: ATXN1; (-) strand; PAM type: NRG; PAM sequence: TGG
tatgagcaaagtgaggaagc

SEQ ID NO: 78146 - DNA, 20 bp, Artificial Sequence
  Description of Artificial Sequence: Synthetic oligonucleotide
  Target: ATXN1; (-) strand; PAM type: NRG; PAM sequence: AAG
tctgtatgagcaaagtgagg

SEQ ID NO: 78147 - DNA, 20 bp, Artificial Sequence
  Description of Artificial Sequence: Synthetic oligonucleotide
  Target: ATXN1; (-) strand; PAM type: NRG; PAM sequence: AGG
atttctgtatgagcaaagtg

SEQ ID NO: 78148 - DNA, 20 bp, Artificial Sequence
  Description of Artificial Sequence: Synthetic oligonucleotide
  Target: ATXN1; (-) strand; PAM type: NRG; PAM sequence: GAG
tatttctgtatgagcaaagt

SEQ ID NO: 78149 - DNA, 20 bp, Artificial Sequence
  Description of Artificial Sequence: Synthetic oligonucleotide
  Target: ATXN1; (-) strand; PAM type: NRG; PAM sequence: AAG
cctatatttctgtatgagca

SEQ ID NO: 78150 - DNA, 20 bp, Artificial Sequence
  Description of Artificial Sequence: Synthetic oligonucleotide
  Target: ATXN1; (-) strand; PAM type: NRG; PAM sequence: GAG
tatgacctatatttctgtat

SEQ ID NO: 78151 - DNA, 20 bp, Artificial Sequence
  Description of Artificial Sequence: Synthetic oligonucleotide
  Target: ATXN1; (-) strand; PAM type: NRG; PAM sequence: TAG
ataccttatatttaatcttc

SEQ ID NO: 78152 - DNA, 20 bp, Artificial Sequence
  Description of Artificial Sequence: Synthetic oligonucleotide
  Target: ATXN1; (-) strand; PAM type: NRG; PAM sequence: TGG
ttgtcatctttttattcttt

SEQ ID NO: 78153 - DNA, 20 bp, Artificial Sequence
  Description of Artificial Sequence: Synthetic oligonucleotide
  Target: ATXN1; (-) strand; PAM type: NRG; PAM sequence: GAG
cttaatttatgacaccatct

SEQ ID NO: 78154 - DNA, 20 bp, Artificial Sequence
  Description of Artificial Sequence: Synthetic oligonucleotide
  Target: ATXN1; (-) strand; PAM type: NRG; PAM sequence: GGG
gtttcttgcagatagtctaa

SEQ ID NO: 78155 - DNA, 20 bp, Artificial Sequence
  Description of Artificial Sequence: Synthetic oligonucleotide
  Target: ATXN1; (-) strand; PAM type: NRG; PAM sequence: AGG
ggtttcttgcagatagtcta

SEQ ID NO: 78156 - DNA, 20 bp, Artificial Sequence
  Description of Artificial Sequence: Synthetic oligonucleotide
  Target: ATXN1; (-) strand; PAM type: NRG; PAM sequence: AAG
gggtttcttgcagatagtct

SEQ ID NO: 78157 - DNA, 20 bp, Artificial Sequence
  Description of Artificial Sequence: Synthetic oligonucleotide
  Target: ATXN1; (-) strand; PAM type: NRG; PAM sequence: TAG
ttttatgggtttcttgcaga

SEQ ID NO: 78158 - DNA, 20 bp, Artificial Sequence
  Description of Artificial Sequence: Synthetic oligonucleotide
  Target: ATXN1; (-) strand; PAM type: NRG; PAM sequence: CAG
taacttttatgggtttcttg

SEQ ID NO: 78159 - DNA, 20 bp, Artificial Sequence
  Description of Artificial Sequence: Synthetic oligonucleotide
  Target: ATXN1; (-) strand; PAM type: NRG; PAM sequence: GGG
aatcttcttgtaacttttat

SEQ ID NO: 78160 - DNA, 20 bp, Artificial Sequence
  Description of Artificial Sequence: Synthetic oligonucleotide
  Target: ATXN1; (-) strand; PAM type: NRG; PAM sequence: TGG
caatcttcttgtaactttta

SEQ ID NO: 78161 - DNA, 20 bp, Artificial Sequence
  Description of Artificial Sequence: Synthetic oligonucleotide
  Target: ATXN1; (-) strand; PAM type: NRG; PAM sequence: TGG
cttctaaatgtgcagtttcc

SEQ ID NO: 78162 - DNA, 20 bp, Artificial Sequence
  Description of Artificial Sequence: Synthetic oligonucleotide
  Target: ATXN1; (-) strand; PAM type: NRG; PAM sequence: CAG
aactgtcacttctaaatgtg

SEQ ID NO: 78163 - DNA, 20 bp, Artificial Sequence
  Description of Artificial Sequence: Synthetic oligonucleotide
  Target: ATXN1; (-) strand; PAM type: NRG; PAM sequence: CAG
taatactgattttgtattaa

SEQ ID NO: 78164 - DNA, 20 bp, Artificial Sequence
  Description of Artificial Sequence: Synthetic oligonucleotide
  Target: ATXN1; (-) strand; PAM type: NRG; PAM sequence: TAG
ttcacccctgttgaatgctt

SEQ ID NO: 78165 - DNA, 20 bp, Artificial Sequence
  Description of Artificial Sequence: Synthetic oligonucleotide
  Target: ATXN1; (-) strand; PAM type: NRG; PAM sequence: CAG
ctttggaatgtatctcttgt

SEQ ID NO: 78166 - DNA, 20 bp, Artificial Sequence
  Description of Artificial Sequence: Synthetic oligonucleotide
  Target: ATXN1; (-) strand; PAM type: NRG; PAM sequence: TGG
acaattttgacttaattctt

SEQ ID NO: 78167 - DNA, 20 bp, Artificial Sequence
  Description of Artificial Sequence: Synthetic oligonucleotide
  Target: ATXN1; (-) strand; PAM type: NRG; PAM sequence: TAG
aaggactgaatgcagtgggg

SEQ ID NO: 78168 - DNA, 20 bp, Artificial Sequence
  Description of Artificial Sequence: Synthetic oligonucleotide
  Target: ATXN1; (-) strand; PAM type: NRG; PAM sequence: GGG
tccaaggactgaatgcagtg

SEQ ID NO: 78169 - DNA, 20 bp, Artificial Sequence
  Description of Artificial Sequence: Synthetic oligonucleotide
  Target: ATXN1; (-) strand; PAM type: NRG; PAM sequence: GGG
ttccaaggactgaatgcagt

SEQ ID NO: 78170 - DNA, 20 bp, Artificial Sequence
  Description of Artificial Sequence: Synthetic oligonucleotide
  Target: ATXN1; (-) strand; PAM type: NRG; PAM sequence: TGG
tttccaaggactgaatgcag

SEQ ID NO: 78171 - DNA, 20 bp, Artificial Sequence
  Description of Artificial Sequence: Synthetic oligonucleotide
  Target: ATXN1; (-) strand; PAM type: NRG; PAM sequence: CAG
atttttccaaggactgaatg

SEQ ID NO: 78172 - DNA, 20 bp, Artificial Sequence
  Description of Artificial Sequence: Synthetic oligonucleotide
  Target: ATXN1; (-) strand; PAM type: NRG; PAM sequence: AGG
ttcatctgcttatttttcca

SEQ ID NO: 78173 - DNA, 20 bp, Artificial Sequence
  Description of Artificial Sequence: Synthetic oligonucleotide
  Target: ATXN1; (-) strand; PAM type: NRG; PAM sequence: AAG
tttcatctgcttatttttcc

SEQ ID NO: 78174 - DNA, 20 bp, Artificial Sequence
  Description of Artificial Sequence: Synthetic oligonucleotide
  Target: ATXN1; (-) strand; PAM type: NRG; PAM sequence: GAG
tccagaatgggcaacagagt

SEQ ID NO: 78175 - DNA, 20 bp, Artificial Sequence
  Description of Artificial Sequence: Synthetic oligonucleotide
  Target: ATXN1; (-) strand; PAM type: NRG; PAM sequence: GAG
gcactccagaatgggcaaca

SEQ ID NO: 78176 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagaatgggcaa

SEQ ID NO: 78177 - DNA, 20 bp, Artificial Sequence
  Description of Artificial Sequence: Synthetic oligonucleotide
  Target: ATXN1; (-) strand; PAM type: NRG; PAM sequence: GGG
gagccactgcactccagaat

SEQ ID NO: 78178 - DNA, 20 bp, Artificial Sequence
  Description of Artificial Sequence: Synthetic oligonucleotide
  Target: ATXN1; (-) strand; PAM type: NRG; PAM sequence: TGG
ggagccactgcactccagaa

SEQ ID NO: 78179 - DNA, 20 bp, Artificial Sequence
  Description of Artificial Sequence: Synthetic oligonucleotide
  Target: ATXN1; (-) strand; PAM type: NRG; PAM sequence: CAG
gagatggagccactgcactc

SEQ ID NO: 78180 - DNA, 20 bp, Artificial Sequence
  Description of Artificial Sequence: Synthetic oligonucleotide
  Target: ATXN1; (-) strand; PAM type: NRG; PAM sequence: GAG
gcttgcagtgagccgagatg

SEQ ID NO: 78181 - DNA, 20 bp, Artificial Sequence
  Description of Artificial Sequence: Synthetic oligonucleotide
  Target: ATXN1; (-) strand; PAM type: NRG; PAM sequence: TGG
gagcttgcagtgagccgaga

SEQ ID NO: 78182 - DNA, 20 bp, Artificial Sequence
  Description of Artificial Sequence: Synthetic oligonucleotide
  Target: ATXN1; (-) strand; PAM type: NRG; PAM sequence: GAG
ggcggagcttgcagtgagcc

SEQ ID NO: 78183 - DNA, 20 bp, Artificial Sequence
  Description of Artificial Sequence: Synthetic oligonucleotide
  Target: ATXN1; (-) strand; PAM type: NRG; PAM sequence: GAG
caggaggcggagcttgcagt

SEQ ID NO: 78184 - DNA, 20 bp, Artificial Sequence
  Description of Artificial Sequence: Synthetic oligonucleotide
  Target: ATXN1; (-) strand; PAM type: NRG; PAM sequence: CAG
aacccaggaggcggagcttg

SEQ ID NO: 78185 - DNA, 20 bp, Artificial Sequence
  Description of Artificial Sequence: Synthetic oligonucleotide
  Target: ATXN1; (-) strand; PAM type: NRG; PAM sequence: GAG
tggcatgaacccaggaggcg

SEQ ID NO: 78186 - DNA, 20 bp, Artificial Sequence
  Description of Artificial Sequence: Synthetic oligonucleotide
  Target: ATXN1; (-) strand; PAM type: NRG; PAM sequence: CGG
aatggcatgaacccaggagg

SEQ ID NO: 78187 - DNA, 20 bp, Artificial Sequence
  Description of Artificial Sequence: Synthetic oligonucleotide
  Target: ATXN1; (-) strand; PAM type: NRG; PAM sequence: AGG
gagaatggcatgaacccagg

SEQ ID NO: 78188 - DNA, 20 bp, Artificial Sequence
  Description of Artificial Sequence: Synthetic oligonucleotide
  Target: ATXN1; (-) strand; PAM type: NRG; PAM sequence: GAG
ggagaatggcatgaacccag

SEQ ID NO: 78189 - DNA, 20 bp, Artificial Sequence
  Description of Artificial Sequence: Synthetic oligonucleotide
  Target: ATXN1; (-) strand; PAM type: NRG; PAM sequence: AGG
caggagaatggcatgaaccc

SEQ ID NO: 78190 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatggcatgaacc

SEQ ID NO: 78191 - DNA, 20 bp, Artificial Sequence
  Description of Artificial Sequence: Synthetic oligonucleotide
  Target: ATXN1; (-) strand; PAM type: NRG; PAM sequence: TGG
gaaaggctgaggcaggagaa

SEQ ID NO: 78192 - DNA, 20 bp, Artificial Sequence
  Description of Artificial Sequence: Synthetic oligonucleotide
  Target: ATXN1; (-) strand; PAM type: NRG; PAM sequence: GAG
tactcgaaaggctgaggcag

SEQ ID NO: 78193 - DNA, 20 bp, Artificial Sequence
  Description of Artificial Sequence: Synthetic oligonucleotide
  Target: ATXN1; (-) strand; PAM type: NRG; PAM sequence: AGG
gctactcgaaaggctgaggc

SEQ ID NO: 78194 - DNA, 20 bp, Artificial Sequence
  Description of Artificial Sequence: Synthetic oligonucleotide
  Target: ATXN1; (-) strand; PAM type: NRG; PAM sequence: CAG
agctactcgaaaggctgagg

SEQ ID NO: 78195 - DNA, 20 bp, Artificial Sequence
  Description of Artificial Sequence: Synthetic oligonucleotide
  Target: ATXN1; (-) strand; PAM type: NRG; PAM sequence: AGG
cccagctactcgaaaggctg

SEQ ID NO: 78196 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcgaaaggct

SEQ ID NO: 78197 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctactcgaa

SEQ ID NO: 78198 - DNA, 20 bp, Artificial Sequence
  Description of Artificial Sequence: Synthetic oligonucleotide
  Target: ATXN1; (-) strand; PAM type: NRG; PAM sequence: AAG
ctgtagtcccagctactcga

SEQ ID NO: 78199 - DNA, 20 bp, Artificial Sequence
  Description of Artificial Sequence: Synthetic oligonucleotide
  Target: ATXN1; (-) strand; PAM type: NRG; PAM sequence: CAG
gtggcgggcacctgtagtcc

SEQ ID NO: 78200 - DNA, 20 bp, Artificial Sequence
  Description of Artificial Sequence: Synthetic oligonucleotide
  Target: ATXN1; (-) strand; PAM type: NRG; PAM sequence: TAG
ggtgtggtggcgggcacctg

SEQ ID NO: 78201 - DNA, 20 bp, Artificial Sequence
  Description of Artificial Sequence: Synthetic oligonucleotide
  Target: ATXN1; (-) strand; PAM type: NRG; PAM sequence: GGG
aattagccgggtgtggtggc

SEQ ID NO: 78202 - DNA, 20 bp, Artificial Sequence
  Description of Artificial Sequence: Synthetic oligonucleotide
  Target: ATXN1; (-) strand; PAM type: NRG; PAM sequence: CGG
aaattagccgggtgtggtgg

SEQ ID NO: 78203 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccgggtgtgg

SEQ ID NO: 78204 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagccgggtg

SEQ ID NO: 78205 - DNA, 20 bp, Artificial Sequence
  Description of Artificial Sequence: Synthetic oligonucleotide
  Target: ATXN1; (-) strand; PAM type: NRG; PAM sequence: GGG
aaaaatacaaaaaattagcc

SEQ ID NO: 78206 - DNA, 20 bp, Artificial Sequence
  Description of Artificial Sequence: Synthetic oligonucleotide
  Target: ATXN1; (-) strand; PAM type: NRG; PAM sequence: CGG
taaaaatacaaaaaattagc

SEQ ID NO: 78207 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatacaaaaaat

SEQ ID NO: 78208 - DNA, 20 bp, Artificial Sequence
  Description of Artificial Sequence: Synthetic oligonucleotide
  Target: ATXN1; (-) strand; PAM type: NRG; PAM sequence: TGG
cgagaccgtcctgactaaca

SEQ ID NO: 78209 - DNA, 20 bp, Artificial Sequence
  Description of Artificial Sequence: Synthetic oligonucleotide
  Target: ATXN1; (-) strand; PAM type: NRG; PAM sequence: GAG
catcatgaggtcaggagatc

SEQ ID NO: 78210 - DNA, 20 bp, Artificial Sequence
  Description of Artificial Sequence: Synthetic oligonucleotide
  Target: ATXN1; (-) strand; PAM type: NRG; PAM sequence: GAG
caggcgcatcatgaggtcag

SEQ ID NO: 78211 - DNA, 20 bp, Artificial Sequence
  Description of Artificial Sequence: Synthetic oligonucleotide
  Target: ATXN1; (-) strand; PAM type: NRG; PAM sequence: AGG
ggcaggcgcatcatgaggtc

SEQ ID NO: 78212 - DNA, 20 bp, Artificial Sequence
  Description of Artificial Sequence: Synthetic oligonucleotide
  Target: ATXN1; (-) strand; PAM type: NRG; PAM sequence: CAG
aggcaggcgcatcatgaggt

SEQ ID NO: 78213 - DNA, 20 bp, Artificial Sequence
  Description of Artificial Sequence: Synthetic oligonucleotide
  Target: ATXN1; (-) strand; PAM type: NRG; PAM sequence: AGG
gctgaggcaggcgcatcatg

SEQ ID NO: 78214 - DNA, 20 bp, Artificial Sequence
  Description of Artificial Sequence: Synthetic oligonucleotide
  Target: ATXN1; (-) strand; PAM type: NRG; PAM sequence: GAG
ggctgaggcaggcgcatcat

SEQ ID NO: 78215 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggctgaggc

SEQ ID NO: 78216 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggctgagg

SEQ ID NO: 78217 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggctg

SEQ ID NO: 78218 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggct

SEQ ID NO: 78219 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 78220 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 78221 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 78222 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagcactt

SEQ ID NO: 78223 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatcc

SEQ ID NO: 78224 - DNA, 20 bp, Artificial Sequence
  Description of Artificial Sequence: Synthetic oligonucleotide
  Target: ATXN1; (-) strand; PAM type: NRG; PAM sequence: TGG
catctgctggccgggcgcgg

SEQ ID NO: 78225 - DNA, 20 bp, Artificial Sequence
  Description of Artificial Sequence: Synthetic oligonucleotide
  Target: ATXN1; (-) strand; PAM type: NRG; PAM sequence: CGG
tttcatctgctggccgggcg

SEQ ID NO: 78226 - DNA, 20 bp, Artificial Sequence
  Description of Artificial Sequence: Synthetic oligonucleotide
  Target: ATXN1; (-) strand; PAM type: NRG; PAM sequence: GGG
taaattttcatctgctggcc

SEQ ID NO: 78227 - DNA, 20 bp, Artificial Sequence
  Description of Artificial Sequence: Synthetic oligonucleotide
  Target: ATXN1; (-) strand; PAM type: NRG; PAM sequence: CGG
ttaaattttcatctgctggc

SEQ ID NO: 78228 - DNA, 20 bp, Artificial Sequence
  Description of Artificial Sequence: Synthetic oligonucleotide
  Target: ATXN1; (-) strand; PAM type: NRG; PAM sequence: TGG
tttattaaattttcatctgc

SEQ ID NO: 78229 - DNA, 20 bp, Artificial Sequence
  Description of Artificial Sequence: Synthetic oligonucleotide
  Target: ATXN1; (-) strand; PAM type: NRG; PAM sequence: CAG
aatcaggcttatcttgtcat

SEQ ID NO: 78230 - DNA, 20 bp, Artificial Sequence
  Description of Artificial Sequence: Synthetic oligonucleotide
  Target: ATXN1; (-) strand; PAM type: NRG; PAM sequence: AGG
tgctctaattaaatctaatc

SEQ ID NO: 78231 - DNA, 20 bp, Artificial Sequence
  Description of Artificial Sequence: Synthetic oligonucleotide
  Target: ATXN1; (-) strand; PAM type: NRG; PAM sequence: CAG
atgctctaattaaatctaat

SEQ ID NO: 78232 - DNA, 20 bp, Artificial Sequence
  Description of Artificial Sequence: Synthetic oligonucleotide
  Target: ATXN1; (-) strand; PAM type: NRG; PAM sequence: AAG
ttccatgagcccctgtatag

SEQ ID NO: 78233 - DNA, 20 bp, Artificial Sequence
  Description of Artificial Sequence: Synthetic oligonucleotide
  Target: ATXN1; (-) strand; PAM type: NRG; PAM sequence: TAG
atgttccatgagcccctgta

SEQ ID NO: 78234 - DNA, 20 bp, Artificial Sequence
  Description of Artificial Sequence: Synthetic oligonucleotide
  Target: ATXN1; (-) strand; PAM type: NRG; PAM sequence: GAG
catttttgttaatgttccat

SEQ ID NO: 78235 - DNA, 20 bp, Artificial Sequence
  Description of Artificial Sequence: Synthetic oligonucleotide
  Target: ATXN1; (-) strand; PAM type: NRG; PAM sequence: AGG
tttattttatgttccaatac

SEQ ID NO: 78236 - DNA, 20 bp, Artificial Sequence
  Description of Artificial Sequence: Synthetic oligonucleotide
  Target: ATXN1; (-) strand; PAM type: NRG; PAM sequence: CAG
atttattttatgttccaata

SEQ ID NO: 78237 - DNA, 20 bp, Artificial Sequence
  Description of Artificial Sequence: Synthetic oligonucleotide
  Target: ATXN1; (-) strand; PAM type: NRG; PAM sequence: TAG
ggtcacagaatattgaaagg

SEQ ID NO: 78238 - DNA, 20 bp, Artificial Sequence
  Description of Artificial Sequence: Synthetic oligonucleotide
  Target: ATXN1; (-) strand; PAM type: NRG; PAM sequence: AGG
tgtggtcacagaatattgaa

SEQ ID NO: 78239 - DNA, 20 bp, Artificial Sequence
  Description of Artificial Sequence: Synthetic oligonucleotide
  Target: ATXN1; (-) strand; PAM type: NRG; PAM sequence: AAG
ttgtggtcacagaatattga

SEQ ID NO: 78240 - DNA, 20 bp, Artificial Sequence
  Description of Artificial Sequence: Synthetic oligonucleotide
  Target: ATXN1; (-) strand; PAM type: NRG; PAM sequence: CAG
gttttgttgcattgtggtca

SEQ ID NO: 78241 - DNA, 20 bp, Artificial Sequence
  Description of Artificial Sequence: Synthetic oligonucleotide
  Target: ATXN1; (-) strand; PAM type: NRG; PAM sequence: TGG
taatgagttttgttgcattg

SEQ ID NO: 78242 - DNA, 20 bp, Artificial Sequence
  Description of Artificial Sequence: Synthetic oligonucleotide
  Target: ATXN1; (-) strand; PAM type: NRG; PAM sequence: GAG
ttacacttctgtctattaat

SEQ ID NO: 78243 - DNA, 20 bp, Artificial Sequence
  Description of Artificial Sequence: Synthetic oligonucleotide
  Target: ATXN1; (-) strand; PAM type: NRG; PAM sequence: AAG
agaattctttttgaatgtac

SEQ ID NO: 78244 - DNA, 20 bp, Artificial Sequence
  Description of Artificial Sequence: Synthetic oligonucleotide
  Target: ATXN1; (-) strand; PAM type: NRG; PAM sequence: AAG
tatactctacacctatttag

SEQ ID NO: 78245 - DNA, 20 bp, Artificial Sequence
  Description of Artificial Sequence: Synthetic oligonucleotide
  Target: ATXN1; (-) strand; PAM type: NRG; PAM sequence: TAG
ttttatactctacacctatt

SEQ ID NO: 78246 - DNA, 20 bp, Artificial Sequence
  Description of Artificial Sequence: Synthetic oligonucleotide
  Target: ATXN1; (-) strand; PAM type: NRG; PAM sequence: CAG
tctcattatctttattgtct

SEQ ID NO: 78247 - DNA, 20 bp, Artificial Sequence
  Description of Artificial Sequence: Synthetic oligonucleotide
  Target: ATXN1; (-) strand; PAM type: NRG; PAM sequence: AAG
agatatttgcctctgactgt

SEQ ID NO: 78248 - DNA, 20 bp, Artificial Sequence
  Description of Artificial Sequence: Synthetic oligonucleotide
  Target: ATXN1; (-) strand; PAM type: NRG; PAM sequence: AAG
tcttaatgataaaaatacta

SEQ ID NO: 78249 - DNA, 20 bp, Artificial Sequence
  Description of Artificial Sequence: Synthetic oligonucleotide
  Target: ATXN1; (-) strand; PAM type: NRG; PAM sequence: GAG
acccccttttctaatttatt

SEQ ID NO: 78250 - DNA, 20 bp, Artificial Sequence
  Description of Artificial Sequence: Synthetic oligonucleotide
  Target: ATXN1; (-) strand; PAM type: NRG; PAM sequence: GAG
tgctgggattacaaaggtgt

SEQ ID NO: 78251 - DNA, 20 bp, Artificial Sequence
  Description of Artificial Sequence: Synthetic oligonucleotide
  Target: ATXN1; (-) strand; PAM type: NRG; PAM sequence: AGG
ccaaagtgctgggattacaa

SEQ ID NO: 78252 - DNA, 20 bp, Artificial Sequence
  Description of Artificial Sequence: Synthetic oligonucleotide
  Target: ATXN1; (-) strand; PAM type: NRG; PAM sequence: AAG
cccaaagtgctgggattaca

SEQ ID NO: 78253 - DNA, 20 bp, Artificial Sequence
  Description of Artificial Sequence: Synthetic oligonucleotide
  Target: ATXN1; (-) strand; PAM type: NRG; PAM sequence: GGG
gcccgacctcccaaagtgct

SEQ ID NO: 78254 - DNA, 20 bp, Artificial Sequence
  Description of Artificial Sequence: Synthetic oligonucleotide
  Target: ATXN1; (-) strand; PAM type: NRG; PAM sequence: TGG
tgcccgacctcccaaagtgc

SEQ ID NO: 78255 - DNA, 20 bp, Artificial Sequence
  Description of Artificial Sequence: Synthetic oligonucleotide
  Target: ATXN1; (-) strand; PAM type: NRG; PAM sequence: AAG
tctgcctgcccgacctccca

SEQ ID NO: 78256 - DNA, 20 bp, Artificial Sequence
  Description of Artificial Sequence: Synthetic oligonucleotide
  Target: ATXN1; (-) strand; PAM type: NRG; PAM sequence: TGG
ttttgccatgttggccagga

SEQ ID NO: 78257 - DNA, 20 bp, Artificial Sequence
  Description of Artificial Sequence: Synthetic oligonucleotide
  Target: ATXN1; (-) strand; PAM type: NRG; PAM sequence: AGG
ggagttttgccatgttggcc

SEQ ID NO: 78258 - DNA, 20 bp, Artificial Sequence
  Description of Artificial Sequence: Synthetic oligonucleotide
  Target: ATXN1; (-) strand; PAM type: NRG; PAM sequence: CAG
tggagttttgccatgttggc

SEQ ID NO: 78259 - DNA, 20 bp, Artificial Sequence
  Description of Artificial Sequence: Synthetic oligonucleotide
  Target: ATXN1; (-) strand; PAM type: NRG; PAM sequence: TGG
cagatggagttttgccatgt

SEQ ID NO: 78260 - DNA, 20 bp, Artificial Sequence
  Description of Artificial Sequence: Synthetic oligonucleotide
  Target: ATXN1; (-) strand; PAM type: NRG; PAM sequence: GAG
ttgtatttttagtacagatg

SEQ ID NO: 78261 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtacaga

SEQ ID NO: 78262 - DNA, 20 bp, Artificial Sequence
  Description of Artificial Sequence: Synthetic oligonucleotide
  Target: ATXN1; (-) strand; PAM type: NRG; PAM sequence: CAG
taatttttgtatttttagta

SEQ ID NO: 78263 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 78264 - DNA, 20 bp, Artificial Sequence
  Description of Artificial Sequence: Synthetic oligonucleotide
  Target: ATXN1; (-) strand; PAM type: NRG; PAM sequence: CAG
caggtgcgtgccaccatgcc

SEQ ID NO: 78265 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggactac

SEQ ID NO: 78266 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggacta

SEQ ID NO: 78267 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 78268 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 78269 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 78270 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 78271 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 78272 - DNA, 20 bp, Artificial Sequence
  Description of Artificial Sequence: Synthetic oligonucleotide
  Target: ATXN1; (-) strand; PAM type: NRG; PAM sequence: AAG
aacctccaccttacgggttc

SEQ ID NO: 78273 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccaccttac

SEQ ID NO: 78274 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctccacctta

SEQ ID NO: 78275 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggtgcactct

SEQ ID NO: 78276 - DNA, 20 bp, Artificial Sequence
  Description of Artificial Sequence: Synthetic oligonucleotide
  Target: ATXN1; (-) strand; PAM type: NRG; PAM sequence: TGG
gtcaccaggctggagtgcag

SEQ ID NO: 78277 - DNA, 20 bp, Artificial Sequence
  Description of Artificial Sequence: Synthetic oligonucleotide
  Target: ATXN1; (-) strand; PAM type: NRG; PAM sequence: CAG
tctgtcaccaggctggagtg

SEQ ID NO: 78278 - DNA, 20 bp, Artificial Sequence
  Description of Artificial Sequence: Synthetic oligonucleotide
  Target: ATXN1; (-) strand; PAM type: NRG; PAM sequence: GAG
ctctctctgtcaccaggctg

SEQ ID NO: 78279 - DNA, 20 bp, Artificial Sequence
  Description of Artificial Sequence: Synthetic oligonucleotide
  Target: ATXN1; (-) strand; PAM type: NRG; PAM sequence: TGG
gtctctctctgtcaccaggc

SEQ ID NO: 78280 - DNA, 20 bp, Artificial Sequence
  Description of Artificial Sequence: Synthetic oligonucleotide
  Target: ATXN1; (-) strand; PAM type: NRG; PAM sequence: AGG
cagagtctctctctgtcacc

SEQ ID NO: 78281 - DNA, 20 bp, Artificial Sequence
  Description of Artificial Sequence: Synthetic oligonucleotide
  Target: ATXN1; (-) strand; PAM type: NRG; PAM sequence: CAG
acagagtctctctctgtcac

SEQ ID NO: 78282 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttaagaca

SEQ ID NO: 78283 - DNA, 20 bp, Artificial Sequence
  Description of Artificial Sequence: Synthetic oligonucleotide
  Target: ATXN1; (-) strand; PAM type: NRG; PAM sequence: CAG
ctttttttttttttttaaga

SEQ ID NO: 78284 - DNA, 20 bp, Artificial Sequence
  Description of Artificial Sequence: Synthetic oligonucleotide
  Target: ATXN1; (-) strand; PAM type: NRG; PAM sequence: AAG
ctttcttttttttttttttt

SEQ ID NO: 78285 - DNA, 20 bp, Artificial Sequence
  Description of Artificial Sequence: Synthetic oligonucleotide
  Target: ATXN1; (-) strand; PAM type: NRG; PAM sequence: AGG
tcctttatattgcttttctt

SEQ ID NO: 78286 - DNA, 20 bp, Artificial Sequence
  Description of Artificial Sequence: Synthetic oligonucleotide
  Target: ATXN1; (-) strand; PAM type: NRG; PAM sequence: TAG
ttcctttatattgcttttct

SEQ ID NO: 78287 - DNA, 20 bp, Artificial Sequence
  Description of Artificial Sequence: Synthetic oligonucleotide
  Target: ATXN1; (-) strand; PAM type: NRG; PAM sequence: TAG
atttttatctcacatttgga

SEQ ID NO: 78288 - DNA, 20 bp, Artificial Sequence
  Description of Artificial Sequence: Synthetic oligonucleotide
  Target: ATXN1; (-) strand; PAM type: NRG; PAM sequence: TGG
aataatttttatctcacatt

SEQ ID NO: 78289 - DNA, 20 bp, Artificial Sequence
  Description of Artificial Sequence: Synthetic oligonucleotide
  Target: ATXN1; (-) strand; PAM type: NRG; PAM sequence: CGG
caggcgtgagccaccgcgcc

SEQ ID NO: 78290 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 78291 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 78292 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 78293 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 78294 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 78295 - DNA, 20 bp, Artificial Sequence
  Description of Artificial Sequence: Synthetic oligonucleotide
  Target: ATXN1; (-) strand; PAM type: NRG; PAM sequence: AAG
ccacccgcctcggcctccca

SEQ ID NO: 78296 - DNA, 20 bp, Artificial Sequence
  Description of Artificial Sequence: Synthetic oligonucleotide
  Target: ATXN1; (-) strand; PAM type: NRG; PAM sequence: CGG
acctcatgatccacccgcct

SEQ ID NO: 78297 - DNA, 20 bp, Artificial Sequence
  Description of Artificial Sequence: Synthetic oligonucleotide
  Target: ATXN1; (-) strand; PAM type: NRG; PAM sequence: TGG
tttcaccttgttagccagga

SEQ ID NO: 78298 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccttgttagcc

SEQ ID NO: 78299 - DNA, 20 bp, Artificial Sequence
  Description of Artificial Sequence: Synthetic oligonucleotide
  Target: ATXN1; (-) strand; PAM type: NRG; PAM sequence: CAG
cggggtttcaccttgttagc

SEQ ID NO: 78300 - DNA, 20 bp, Artificial Sequence
  Description of Artificial Sequence: Synthetic oligonucleotide
  Target: ATXN1; (-) strand; PAM type: NRG; PAM sequence: TAG
gagacggggtttcaccttgt

SEQ ID NO: 78301 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagacg

SEQ ID NO: 78302 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 78303 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 78304 - DNA, 20 bp, Artificial Sequence
  Description of Artificial Sequence: Synthetic oligonucleotide
  Target: ATXN1; (-) strand; PAM type: NRG; PAM sequence: GAG
aattttttgtatttttagta

SEQ ID NO: 78305 - DNA, 20 bp, Artificial Sequence
  Description of Artificial Sequence: Synthetic oligonucleotide
  Target: ATXN1; (-) strand; PAM type: NRG; PAM sequence: TAG
ctaattttttgtatttttag

SEQ ID NO: 78306 - DNA, 20 bp, Artificial Sequence
  Description of Artificial Sequence: Synthetic oligonucleotide
  Target: ATXN1; (-) strand; PAM type: NRG; PAM sequence: TAG
cggctaattttttgtatttt

SEQ ID NO: 78307 - DNA, 20 bp, Artificial Sequence
  Description of Artificial Sequence: Synthetic oligonucleotide
  Target: ATXN1; (-) strand; PAM type: NRG; PAM sequence: CGG
caggcgcccgccaccgcgcc

SEQ ID NO: 78308 - DNA, 20 bp, Artificial Sequence
  Description of Artificial Sequence: Synthetic oligonucleotide
  Target: ATXN1; (-) strand; PAM type: NRG; PAM sequence: AGG
tcccgagtggctgggactac

SEQ ID NO: 78309 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtggctgggacta

SEQ ID NO: 78310 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtggct

SEQ ID NO: 78311 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtggc

SEQ ID NO: 78312 - DNA, 20 bp, Artificial Sequence
  Description of Artificial Sequence: Synthetic oligonucleotide
  Target: ATXN1; (-) strand; PAM type: NRG; PAM sequence: TGG
tcctgcctcagcctcccgag

SEQ ID NO: 78313 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 78314 - DNA, 20 bp, Artificial Sequence
  Description of Artificial Sequence: Synthetic oligonucleotide
  Target: ATXN1; (-) strand; PAM type: NRG; PAM sequence: CAG
ttcacgccattctcctgcct

SEQ ID NO: 78315 - DNA, 20 bp, Artificial Sequence
  Description of Artificial Sequence: Synthetic oligonucleotide
  Target: ATXN1; (-) strand; PAM type: NRG; PAM sequence: GGG
cactgcaagctccgcttccc

SEQ ID NO: 78316 - DNA, 20 bp, Artificial Sequence
  Description of Artificial Sequence: Synthetic oligonucleotide
  Target: ATXN1; (-) strand; PAM type: NRG; PAM sequence: CGG
tcactgcaagctccgcttcc

SEQ ID NO: 78317 - DNA, 20 bp, Artificial Sequence
  Description of Artificial Sequence: Synthetic oligonucleotide
  Target: ATXN1; (-) strand; PAM type: NRG; PAM sequence: AAG
gcacaatctcggctcactgc

SEQ ID NO: 78318 - DNA, 20 bp, Artificial Sequence
  Description of Artificial Sequence: Synthetic oligonucleotide
  Target: ATXN1; (-) strand; PAM type: NRG; PAM sequence: CGG
ggactgcagtggcacaatct

SEQ ID NO: 78319 - DNA, 20 bp, Artificial Sequence
  Description of Artificial Sequence: Synthetic oligonucleotide
  Target: ATXN1; (-) strand; PAM type: NRG; PAM sequence: TGG
ggccggactgcggactgcag

SEQ ID NO: 78320 - DNA, 20 bp, Artificial Sequence
  Description of Artificial Sequence: Synthetic oligonucleotide
  Target: ATXN1; (-) strand; PAM type: NRG; PAM sequence: CAG
ccaggccggactgcggactg

SEQ ID NO: 78321 - DNA, 20 bp, Artificial Sequence
  Description of Artificial Sequence: Synthetic oligonucleotide
  Target: ATXN1; (-) strand; PAM type: NRG; PAM sequence: CGG
ctgtcgcccaggccggactg

SEQ ID NO: 78322 - DNA, 20 bp, Artificial Sequence
  Description of Artificial Sequence: Synthetic oligonucleotide
  Target: ATXN1; (-) strand; PAM type: NRG; PAM sequence: CGG
tctcgctctgtcgcccaggc

SEQ ID NO: 78323 - DNA, 20 bp, Artificial Sequence
  Description of Artificial Sequence: Synthetic oligonucleotide
  Target: ATXN1; (-) strand; PAM type: NRG; PAM sequence: AGG
ggagtctcgctctgtcgccc

SEQ ID NO: 78324 - DNA, 20 bp, Artificial Sequence
  Description of Artificial Sequence: Synthetic oligonucleotide
  Target: ATXN1; (-) strand; PAM type: NRG; PAM sequence: CAG
cggagtctcgctctgtcgcc

SEQ ID NO: 78325 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagacg

SEQ ID NO: 78326 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttttgaga

SEQ ID NO: 78327 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 78328 - DNA, 20 bp, Artificial Sequence
  Description of Artificial Sequence: Synthetic oligonucleotide
  Target: ATXN1; (-) strand; PAM type: NRG; PAM sequence: TAG
acttactgctagctaattaa

SEQ ID NO: 78329 - DNA, 20 bp, Artificial Sequence
  Description of Artificial Sequence: Synthetic oligonucleotide
  Target: ATXN1; (-) strand; PAM type: NRG; PAM sequence: TAG
aaataagatagacttactgc

SEQ ID NO: 78330 - DNA, 20 bp, Artificial Sequence
  Description of Artificial Sequence: Synthetic oligonucleotide
  Target: ATXN1; (-) strand; PAM type: NRG; PAM sequence: TAG
aaatatatgcaaaaataaga

SEQ ID NO: 78331 - DNA, 20 bp, Artificial Sequence
  Description of Artificial Sequence: Synthetic oligonucleotide
  Target: ATXN1; (-) strand; PAM type: NRG; PAM sequence: AAG
tttaaaatatatgcaaaaat

SEQ ID NO: 78332 - DNA, 20 bp, Artificial Sequence
  Description of Artificial Sequence: Synthetic oligonucleotide
  Target: ATXN1; (-) strand; PAM type: NRG; PAM sequence: AAG
acttaagattagctagcagt

SEQ ID NO: 78333 - DNA, 20 bp, Artificial Sequence
  Description of Artificial Sequence: Synthetic oligonucleotide
  Target: ATXN1; (-) strand; PAM type: NRG; PAM sequence: CAG
tgaaacttaagattagctag

SEQ ID NO: 78334 - DNA, 20 bp, Artificial Sequence
  Description of Artificial Sequence: Synthetic oligonucleotide
  Target: ATXN1; (-) strand; PAM type: NRG; PAM sequence: TAG
ctctgaaacttaagattagc

SEQ ID NO: 78335 - DNA, 20 bp, Artificial Sequence
  Description of Artificial Sequence: Synthetic oligonucleotide
  Target: ATXN1; (-) strand; PAM type: NRG; PAM sequence: TAG
tgttctctgaaacttaagat

SEQ ID NO: 78336 - DNA, 20 bp, Artificial Sequence
  Description of Artificial Sequence: Synthetic oligonucleotide
  Target: ATXN1; (-) strand; PAM type: NRG; PAM sequence: AAG
tggtttgttctctgaaactt

SEQ ID NO: 78337 - DNA, 20 bp, Artificial Sequence
  Description of Artificial Sequence: Synthetic oligonucleotide
  Target: ATXN1; (-) strand; PAM type: NRG; PAM sequence: TGG
tccacttcttatttttaatt

SEQ ID NO: 78338 - DNA, 20 bp, Artificial Sequence
  Description of Artificial Sequence: Synthetic oligonucleotide
  Target: ATXN1; (-) strand; PAM type: NRG; PAM sequence: CAG
tattcaaaattttgttaaca

SEQ ID NO: 78339 - DNA, 20 bp, Artificial Sequence
  Description of Artificial Sequence: Synthetic oligonucleotide
  Target: ATXN1; (-) strand; PAM type: NRG; PAM sequence: CGG
ggattacaggtgtgagccac

SEQ ID NO: 78340 - DNA, 20 bp, Artificial Sequence
  Description of Artificial Sequence: Synthetic oligonucleotide
  Target: ATXN1; (-) strand; PAM type: NRG; PAM sequence: GAG
agcatggggattacaggtgt

SEQ ID NO: 78341 - DNA, 20 bp, Artificial Sequence
  Description of Artificial Sequence: Synthetic oligonucleotide
  Target: ATXN1; (-) strand; PAM type: NRG; PAM sequence: AGG
tcccaaagcatggggattac

SEQ ID NO: 78342 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagcatggggatta

SEQ ID NO: 78343 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagcatg

SEQ ID NO: 78344 - DNA, 20 bp, Artificial Sequence
  Description of Artificial Sequence: Synthetic oligonucleotide
  Target: ATXN1; (-) strand; PAM type: NRG; PAM sequence: GGG
gcctcagcctcccaaagcat

SEQ ID NO: 78345 - DNA, 20 bp, Artificial Sequence
  Description of Artificial Sequence: Synthetic oligonucleotide
  Target: ATXN1; (-) strand; PAM type: NRG; PAM sequence: TGG
tgcctcagcctcccaaagca

SEQ ID NO: 78346 - DNA, 20 bp, Artificial Sequence
  Description of Artificial Sequence: Synthetic oligonucleotide
  Target: ATXN1; (-) strand; PAM type: NRG; PAM sequence: AAG
aatcctgcctcagcctccca

SEQ ID NO: 78347 - DNA, 20 bp, Artificial Sequence
  Description of Artificial Sequence: Synthetic oligonucleotide
  Target: ATXN1; (-) strand; PAM type: NRG; PAM sequence: CAG
tgccttgagcaatcctgcct

SEQ ID NO: 78348 - DNA, 20 bp, Artificial Sequence
  Description of Artificial Sequence: Synthetic oligonucleotide
  Target: ATXN1; (-) strand; PAM type: NRG; PAM sequence: GAG
tggtctcaaactcctgcctt

SEQ ID NO: 78349 - DNA, 20 bp, Artificial Sequence
  Description of Artificial Sequence: Synthetic oligonucleotide
  Target: ATXN1; (-) strand; PAM type: NRG; PAM sequence: TGG
tctcactatattgctcaggc

SEQ ID NO: 78350 - DNA, 20 bp, Artificial Sequence
  Description of Artificial Sequence: Synthetic oligonucleotide
  Target: ATXN1; (-) strand; PAM type: NRG; PAM sequence: AGG
ggggtctcactatattgctc

SEQ ID NO: 78351 - DNA, 20 bp, Artificial Sequence
  Description of Artificial Sequence: Synthetic oligonucleotide
  Target: ATXN1; (-) strand; PAM type: NRG; PAM sequence: CAG
tggggtctcactatattgct

SEQ ID NO: 78352 - DNA, 20 bp, Artificial Sequence
  Description of Artificial Sequence: Synthetic oligonucleotide
  Target: ATXN1; (-) strand; PAM type: NRG; PAM sequence: GGG
ttaacttttttgtagagatg

SEQ ID NO: 78353 - DNA, 20 bp, Artificial Sequence
  Description of Artificial Sequence: Synthetic oligonucleotide
  Target: ATXN1; (-) strand; PAM type: NRG; PAM sequence: GGG
tttaacttttttgtagagat

SEQ ID NO: 78354 - DNA, 20 bp, Artificial Sequence
  Description of Artificial Sequence: Synthetic oligonucleotide
  Target: ATXN1; (-) strand; PAM type: NRG; PAM sequence: TGG
ttttaacttttttgtagaga

SEQ ID NO: 78355 - DNA, 20 bp, Artificial Sequence
  Description of Artificial Sequence: Synthetic oligonucleotide
  Target: ATXN1; (-) strand; PAM type: NRG; PAM sequence: GAG
tcttttttaacttttttgta

SEQ ID NO: 78356 - DNA, 20 bp, Artificial Sequence
  Description of Artificial Sequence: Synthetic oligonucleotide
  Target: ATXN1; (-) strand; PAM type: NRG; PAM sequence: TAG
tttcttttttaacttttttg

SEQ ID NO: 78357 - DNA, 20 bp, Artificial Sequence
  Description of Artificial Sequence: Synthetic oligonucleotide
  Target: ATXN1; (-) strand; PAM type: NRG; PAM sequence: TGG
caggtgcatgccactatgcc

SEQ ID NO: 78358 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggactgc

SEQ ID NO: 78359 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggactg

SEQ ID NO: 78360 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 78361 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 78362 - DNA, 20 bp, Artificial Sequence
  Description of Artificial Sequence: Synthetic oligonucleotide
  Target: ATXN1; (-) strand; PAM type: NRG; PAM sequence: TAG
tcccgcctcagcctcccaag

SEQ ID NO: 78363 - DNA, 20 bp, Artificial Sequence
  Description of Artificial Sequence: Synthetic oligonucleotide
  Target: ATXN1; (-) strand; PAM type: NRG; PAM sequence: AAG
tcctcccgcctcagcctccc

SEQ ID NO: 78364 - DNA, 20 bp, Artificial Sequence
  Description of Artificial Sequence: Synthetic oligonucleotide
  Target: ATXN1; (-) strand; PAM type: NRG; PAM sequence: CAG
ctcaagcaatcctcccgcct

SEQ ID NO: 78365 - DNA, 20 bp, Artificial Sequence
  Description of Artificial Sequence: Synthetic oligonucleotide
  Target: ATXN1; (-) strand; PAM type: NRG; PAM sequence: AAG
aaccttgaacccctgggctc

SEQ ID NO: 78366 - DNA, 20 bp, Artificial Sequence
  Description of Artificial Sequence: Synthetic oligonucleotide
  Target: ATXN1; (-) strand; PAM type: NRG; PAM sequence: GGG
cactgcaaccttgaacccct

SEQ ID NO: 78367 - DNA, 20 bp, Artificial Sequence
  Description of Artificial Sequence: Synthetic oligonucleotide
  Target: ATXN1; (-) strand; PAM type: NRG; PAM sequence: TGG
tcactgcaaccttgaacccc

SEQ ID NO: 78368 - DNA, 20 bp, Artificial Sequence
  Description of Artificial Sequence: Synthetic oligonucleotide
  Target: ATXN1; (-) strand; PAM type: NRG; PAM sequence: TAG
ggagtgcagtggtgcagtca

SEQ ID NO: 78369 - DNA, 20 bp, Artificial Sequence
  Description of Artificial Sequence: Synthetic oligonucleotide
  Target: ATXN1; (-) strand; PAM type: NRG; PAM sequence: CAG
caggctggagtgcagtggtg

SEQ ID NO: 78370 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcag

SEQ ID NO: 78371 - DNA, 20 bp, Artificial Sequence
  Description of Artificial Sequence: Synthetic oligonucleotide
  Target: ATXN1; (-) strand; PAM type: NRG; PAM sequence: CAG
ctgttgcccaggctggagtg

SEQ ID NO: 78372 - DNA, 20 bp, Artificial Sequence
  Description of Artificial Sequence: Synthetic oligonucleotide
  Target: ATXN1; (-) strand; PAM type: NRG; PAM sequence: GAG
ttgctctgttgcccaggctg

SEQ ID NO: 78373 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgttgcccaggc

SEQ ID NO: 78374 - DNA, 20 bp, Artificial Sequence
  Description of Artificial Sequence: Synthetic oligonucleotide
  Target: ATXN1; (-) strand; PAM type: NRG; PAM sequence: AGG
agggtcttgctctgttgccc

SEQ ID NO: 78375 - DNA, 20 bp, Artificial Sequence
  Description of Artificial Sequence: Synthetic oligonucleotide
  Target: ATXN1; (-) strand; PAM type: NRG; PAM sequence: CAG
cagggtcttgctctgttgcc

SEQ ID NO: 78376 - DNA, 20 bp, Artificial Sequence
  Description of Artificial Sequence: Synthetic oligonucleotide
  Target: ATXN1; (-) strand; PAM type: NRG; PAM sequence: GGG
tattttattttatcaagaca

SEQ ID NO: 78377 - DNA, 20 bp, Artificial Sequence
  Description of Artificial Sequence: Synthetic oligonucleotide
  Target: ATXN1; (-) strand; PAM type: NRG; PAM sequence: AGG
ttattttattttatcaagac

SEQ ID NO: 78378 - DNA, 20 bp, Artificial Sequence
  Description of Artificial Sequence: Synthetic oligonucleotide
  Target: ATXN1; (-) strand; PAM type: NRG; PAM sequence: CAG
attattttattttatcaaga

SEQ ID NO: 78379 - DNA, 20 bp, Artificial Sequence
  Description of Artificial Sequence: Synthetic oligonucleotide
  Target: ATXN1; (-) strand; PAM type: NRG; PAM sequence: AAG
ttatattattttattttatc

SEQ ID NO: 78380 - DNA, 20 bp, Artificial Sequence
  Description of Artificial Sequence: Synthetic oligonucleotide
  Target: ATXN1; (-) strand; PAM type: NRG; PAM sequence: TAG
ttaaagcattttaatgtttc

SEQ ID NO: 78381 - DNA, 20 bp, Artificial Sequence
  Description of Artificial Sequence: Synthetic oligonucleotide
  Target: ATXN1; (-) strand; PAM type: NRG; PAM sequence: AAG
tacttcttaaattaatatta

SEQ ID NO: 78382 - DNA, 20 bp, Artificial Sequence
  Description of Artificial Sequence: Synthetic oligonucleotide
  Target: ATXN1; (-) strand; PAM type: NRG; PAM sequence: AGG
ctataataatttttttgatc

SEQ ID NO: 78383 - DNA, 20 bp, Artificial Sequence
  Description of Artificial Sequence: Synthetic oligonucleotide
  Target: ATXN1; (-) strand; PAM type: NRG; PAM sequence: CAG
tctataataatttttttgat

SEQ ID NO: 78384 - DNA, 20 bp, Artificial Sequence
  Description of Artificial Sequence: Synthetic oligonucleotide
  Target: ATXN1; (-) strand; PAM type: NRG; PAM sequence: AAG
gaaagcctccccacccctaa

SEQ ID NO: 78385 - DNA, 20 bp, Artificial Sequence
  Description of Artificial Sequence: Synthetic oligonucleotide
  Target: ATXN1; (-) strand; PAM type: NRG; PAM sequence: AAG
ttttggttgttatattatga

SEQ ID NO: 78386 - DNA, 20 bp, Artificial Sequence
  Description of Artificial Sequence: Synthetic oligonucleotide
  Target: ATXN1; (-) strand; PAM type: NRG; PAM sequence: TGG
attagaattatgtcattttt

SEQ ID NO: 78387 - DNA, 20 bp, Artificial Sequence
  Description of Artificial Sequence: Synthetic oligonucleotide
  Target: ATXN1; (-) strand; PAM type: NRG; PAM sequence: TAG
ttacctgtccccaaagttat

SEQ ID NO: 78388 - DNA, 20 bp, Artificial Sequence
  Description of Artificial Sequence: Synthetic oligonucleotide
  Target: ATXN1; (-) strand; PAM type: NRG; PAM sequence: AAG
tttgaaattacctgtcccca

SEQ ID NO: 78389 - DNA, 20 bp, Artificial Sequence
  Description of Artificial Sequence: Synthetic oligonucleotide
  Target: ATXN1; (-) strand; PAM type: NRG; PAM sequence: AAG
aggcacatgtagcatcctgg

SEQ ID NO: 78390 - DNA, 20 bp, Artificial Sequence
  Description of Artificial Sequence: Synthetic oligonucleotide
  Target: ATXN1; (-) strand; PAM type: NRG; PAM sequence: TGG
ttaaggcacatgtagcatcc

SEQ ID NO: 78391 - DNA, 20 bp, Artificial Sequence
  Description of Artificial Sequence: Synthetic oligonucleotide
  Target: ATXN1; (-) strand; PAM type: NRG; PAM sequence: TAG
tgcccccattaaggcacatg

SEQ ID NO: 78392 - DNA, 20 bp, Artificial Sequence
  Description of Artificial Sequence: Synthetic oligonucleotide
  Target: ATXN1; (-) strand; PAM type: NRG; PAM sequence: AGG
gggtacctttgcccccatta

SEQ ID NO: 78393 - DNA, 20 bp, Artificial Sequence
  Description of Artificial Sequence: Synthetic oligonucleotide
  Target: ATXN1; (-) strand; PAM type: NRG; PAM sequence: AAG
agggtacctttgcccccatt

SEQ ID NO: 78394 - DNA, 20 bp, Artificial Sequence
  Description of Artificial Sequence: Synthetic oligonucleotide
  Target: ATXN1; (-) strand; PAM type: NRG; PAM sequence: GGG
agaaaagtgagagaaaggaa

SEQ ID NO: 78395 - DNA, 20 bp, Artificial Sequence
  Description of Artificial Sequence: Synthetic oligonucleotide
  Target: ATXN1; (-) strand; PAM type: NRG; PAM sequence: AGG
aagaaaagtgagagaaagga

SEQ ID NO: 78396 - DNA, 20 bp, Artificial Sequence
  Description of Artificial Sequence: Synthetic oligonucleotide
  Target: ATXN1; (-) strand; PAM type: NRG; PAM sequence: AAG
gaagaaaagtgagagaaagg

SEQ ID NO: 78397 - DNA, 20 bp, Artificial Sequence
  Description of Artificial Sequence: Synthetic oligonucleotide
  Target: ATXN1; (-) strand; PAM type: NRG; PAM sequence: AGG
ggagaagaaaagtgagagaa

SEQ ID NO: 78398 - DNA, 20 bp, Artificial Sequence
  Description of Artificial Sequence: Synthetic oligonucleotide
  Target: ATXN1; (-) strand; PAM type: NRG; PAM sequence: AAG
aggagaagaaaagtgagaga

SEQ ID NO: 78399 - DNA, 20 bp, Artificial Sequence
  Description of Artificial Sequence: Synthetic oligonucleotide
  Target: ATXN1; (-) strand; PAM type: NRG; PAM sequence: GAG
ctcaaggagaagaaaagtga

SEQ ID NO: 78400 - DNA, 20 bp, Artificial Sequence
  Description of Artificial Sequence: Synthetic oligonucleotide
  Target: ATXN1; (-) strand; PAM type: NRG; PAM sequence: GAG
gcctcaaggagaagaaaagt

SEQ ID NO: 78401 - DNA, 20 bp, Artificial Sequence
  Description of Artificial Sequence: Synthetic oligonucleotide
  Target: ATXN1; (-) strand; PAM type: NRG; PAM sequence: AAG
agttgcctcaaggagaagaa

SEQ ID NO: 78402 - DNA, 20 bp, Artificial Sequence
  Description of Artificial Sequence: Synthetic oligonucleotide
  Target: ATXN1; (-) strand; PAM type: NRG; PAM sequence: AAG
ctctgagttgcctcaaggag

SEQ ID NO: 78403 - DNA, 20 bp, Artificial Sequence
  Description of Artificial Sequence: Synthetic oligonucleotide
  Target: ATXN1; (-) strand; PAM type: NRG; PAM sequence: GAG
ctcctctgagttgcctcaag

SEQ ID NO: 78404 - DNA, 20 bp, Artificial Sequence
  Description of Artificial Sequence: Synthetic oligonucleotide
  Target: ATXN1; (-) strand; PAM type: NRG; PAM sequence: AGG
cgctcctctgagttgcctca

SEQ ID NO: 78405 - DNA, 20 bp, Artificial Sequence
  Description of Artificial Sequence: Synthetic oligonucleotide
  Target: ATXN1; (-) strand; PAM type: NRG; PAM sequence: AAG
tcgctcctctgagttgcctc

SEQ ID NO: 78406 - DNA, 20 bp, Artificial Sequence
  Description of Artificial Sequence: Synthetic oligonucleotide
  Target: ATXN1; (-) strand; PAM type: NRG; PAM sequence: GAG
atttccacaatcgctcctct

SEQ ID NO: 78407 - DNA, 20 bp, Artificial Sequence
  Description of Artificial Sequence: Synthetic oligonucleotide
  Target: ATXN1; (-) strand; PAM type: NRG; PAM sequence: CGG
aagctgacatatagcagctt

SEQ ID NO: 78408 - DNA, 20 bp, Artificial Sequence
  Description of Artificial Sequence: Synthetic oligonucleotide
  Target: ATXN1; (-) strand; PAM type: NRG; PAM sequence: CAG
atgggcaagctgacatatag

SEQ ID NO: 78409 - DNA, 20 bp, Artificial Sequence
  Description of Artificial Sequence: Synthetic oligonucleotide
  Target: ATXN1; (-) strand; PAM type: NRG; PAM sequence: TAG
caaatgggcaagctgacata

SEQ ID NO: 78410 - DNA, 20 bp, Artificial Sequence
  Description of Artificial Sequence: Synthetic oligonucleotide
  Target: ATXN1; (-) strand; PAM type: NRG; PAM sequence: AAG
gaaattccatacaaatgggc

SEQ ID NO: 78411 - DNA, 20 bp, Artificial Sequence
  Description of Artificial Sequence: Synthetic oligonucleotide
  Target: ATXN1; (-) strand; PAM type: NRG; PAM sequence: GGG
ccatgaaattccatacaaat

SEQ ID NO: 78412 - DNA, 20 bp, Artificial Sequence
  Description of Artificial Sequence: Synthetic oligonucleotide
  Target: ATXN1; (-) strand; PAM type: NRG; PAM sequence: TGG
accatgaaattccatacaaa

SEQ ID NO: 78413 - DNA, 20 bp, Artificial Sequence
  Description of Artificial Sequence: Synthetic oligonucleotide
  Target: ATXN1; (-) strand; PAM type: NRG; PAM sequence: AAG
caagatgcgatgatgacaaa

SEQ ID NO: 78414 - DNA, 20 bp, Artificial Sequence
  Description of Artificial Sequence: Synthetic oligonucleotide
  Target: ATXN1; (-) strand; PAM type: NRG; PAM sequence: AAG
ttcccttcctctctactctc

SEQ ID NO: 78415 - DNA, 20 bp, Artificial Sequence
  Description of Artificial Sequence: Synthetic oligonucleotide
  Target: ATXN1; (-) strand; PAM type: NRG; PAM sequence: CAG
ccagaagcctctgatagtaa

SEQ ID NO: 78416 - DNA, 20 bp, Artificial Sequence
  Description of Artificial Sequence: Synthetic oligonucleotide
  Target: ATXN1; (-) strand; PAM type: NRG; PAM sequence: TAG
ggatttccagaagcctctga

SEQ ID NO: 78417 - DNA, 20 bp, Artificial Sequence
  Description of Artificial Sequence: Synthetic oligonucleotide
  Target: ATXN1; (-) strand; PAM type: NRG; PAM sequence: AAG
catcaagcggggatttccag

SEQ ID NO: 78418 - DNA, 20 bp, Artificial Sequence
  Description of Artificial Sequence: Synthetic oligonucleotide
  Target: ATXN1; (-) strand; PAM type: NRG; PAM sequence: CAG
taccatcaagcggggatttc

SEQ ID NO: 78419 - DNA, 20 bp, Artificial Sequence
  Description of Artificial Sequence: Synthetic oligonucleotide
  Target: ATXN1; (-) strand; PAM type: NRG; PAM sequence: GGG
gagtcatgtaccatcaagcg

SEQ ID NO: 78420 - DNA, 20 bp, Artificial Sequence
  Description of Artificial Sequence: Synthetic oligonucleotide
  Target: ATXN1; (-) strand; PAM type: NRG; PAM sequence: GGG
agagtcatgtaccatcaagc

SEQ ID NO: 78421 - DNA, 20 bp, Artificial Sequence
  Description of Artificial Sequence: Synthetic oligonucleotide
  Target: ATXN1; (-) strand; PAM type: NRG; PAM sequence: CGG
aagagtcatgtaccatcaag

SEQ ID NO: 78422 - DNA, 20 bp, Artificial Sequence
  Description of Artificial Sequence: Synthetic oligonucleotide
  Target: ATXN1; (-) strand; PAM type: NRG; PAM sequence: AAG
agaaagagtcatgtaccatc

SEQ ID NO: 78423 - DNA, 20 bp, Artificial Sequence
  Description of Artificial Sequence: Synthetic oligonucleotide
  Target: ATXN1; (-) strand; PAM type: NRG; PAM sequence: GAG
agagaaccattcttaagaaa

SEQ ID NO: 78424 - DNA, 20 bp, Artificial Sequence
  Description of Artificial Sequence: Synthetic oligonucleotide
  Target: ATXN1; (-) strand; PAM type: NRG; PAM sequence: AAG
aaagagaaccattcttaaga

SEQ ID NO: 78425 - DNA, 20 bp, Artificial Sequence
  Description of Artificial Sequence: Synthetic oligonucleotide
  Target: ATXN1; (-) strand; PAM type: NRG; PAM sequence: AAG
cataaaagagaaccattctt

SEQ ID NO: 78426 - DNA, 20 bp, Artificial Sequence
  Description of Artificial Sequence: Synthetic oligonucleotide
  Target: ATXN1; (-) strand; PAM type: NRG; PAM sequence: GAG
caaaatggcaacccataaaa

SEQ ID NO: 78427 - DNA, 20 bp, Artificial Sequence
  Description of Artificial Sequence: Synthetic oligonucleotide
  Target: ATXN1; (-) strand; PAM type: NRG; PAM sequence: AAG
accaaaatggcaacccataa

SEQ ID NO: 78428 - DNA, 20 bp, Artificial Sequence
  Description of Artificial Sequence: Synthetic oligonucleotide
  Target: ATXN1; (-) strand; PAM type: NRG; PAM sequence: TGG
tgcaccaattgtcaccaaaa

SEQ ID NO: 78429 - DNA, 20 bp, Artificial Sequence
  Description of Artificial Sequence: Synthetic oligonucleotide
  Target: ATXN1; (-) strand; PAM type: NRG; PAM sequence: GAG
gcccaccaagaggtagagct

SEQ ID NO: 78430 - DNA, 20 bp, Artificial Sequence
  Description of Artificial Sequence: Synthetic oligonucleotide
  Target: ATXN1; (-) strand; PAM type: NRG; PAM sequence: GAG
ctggggcccaccaagaggta

SEQ ID NO: 78431 - DNA, 20 bp, Artificial Sequence
  Description of Artificial Sequence: Synthetic oligonucleotide
  Target: ATXN1; (-) strand; PAM type: NRG; PAM sequence: TAG
cactggggcccaccaagagg

SEQ ID NO: 78432 - DNA, 20 bp, Artificial Sequence
  Description of Artificial Sequence: Synthetic oligonucleotide
  Target: ATXN1; (-) strand; PAM type: NRG; PAM sequence: AGG
gtacactggggcccaccaag

SEQ ID NO: 78433 - DNA, 20 bp, Artificial Sequence
  Description of Artificial Sequence: Synthetic oligonucleotide
  Target: ATXN1; (-) strand; PAM type: NRG; PAM sequence: GAG
agtacactggggcccaccaa

SEQ ID NO: 78434 - DNA, 20 bp, Artificial Sequence
  Description of Artificial Sequence: Synthetic oligonucleotide
  Target: ATXN1; (-) strand; PAM type: NRG; PAM sequence: AAG
gaagtacactggggcccacc

SEQ ID NO: 78435 - DNA, 20 bp, Artificial Sequence
  Description of Artificial Sequence: Synthetic oligonucleotide
  Target: ATXN1; (-) strand; PAM type: NRG; PAM sequence: GGG
gatcatgctgaagtacactg

SEQ ID NO: 78436 - DNA, 20 bp, Artificial Sequence
  Description of Artificial Sequence: Synthetic oligonucleotide
  Target: ATXN1; (-) strand; PAM type: NRG; PAM sequence: GGG
agatcatgctgaagtacact

SEQ ID NO: 78437 - DNA, 20 bp, Artificial Sequence
  Description of Artificial Sequence: Synthetic oligonucleotide
  Target: ATXN1; (-) strand; PAM type: NRG; PAM sequence: TGG
gagatcatgctgaagtacac

SEQ ID NO: 78438 - DNA, 20 bp, Artificial Sequence
  Description of Artificial Sequence: Synthetic oligonucleotide
  Target: ATXN1; (-) strand; PAM type: NRG; PAM sequence: AAG
aaagaactgagatcatgctg

SEQ ID NO: 78439 - DNA, 20 bp, Artificial Sequence
  Description of Artificial Sequence: Synthetic oligonucleotide
  Target: ATXN1; (-) strand; PAM type: NRG; PAM sequence: GAG
tggtagagaaagaaagaact

SEQ ID NO: 78440 - DNA, 20 bp, Artificial Sequence
  Description of Artificial Sequence: Synthetic oligonucleotide
  Target: ATXN1; (-) strand; PAM type: NRG; PAM sequence: AAG
tggaaactggtagagaaaga

SEQ ID NO: 78441 - DNA, 20 bp, Artificial Sequence
  Description of Artificial Sequence: Synthetic oligonucleotide
  Target: ATXN1; (-) strand; PAM type: NRG; PAM sequence: AAG
atcatggaaactggtagaga

SEQ ID NO: 78442 - DNA, 20 bp, Artificial Sequence
  Description of Artificial Sequence: Synthetic oligonucleotide
  Target: ATXN1; (-) strand; PAM type: NRG; PAM sequence: GAG
atgtatcatggaaactggta

SEQ ID NO: 78443 - DNA, 20 bp, Artificial Sequence
  Description of Artificial Sequence: Synthetic oligonucleotide
  Target: ATXN1; (-) strand; PAM type: NRG; PAM sequence: TAG
gtatgtatcatggaaactgg

SEQ ID NO: 78444 - DNA, 20 bp, Artificial Sequence
  Description of Artificial Sequence: Synthetic oligonucleotide
  Target: ATXN1; (-) strand; PAM type: NRG; PAM sequence: TGG
gatgtatgtatcatggaaac

SEQ ID NO: 78445 - DNA, 20 bp, Artificial Sequence
  Description of Artificial Sequence: Synthetic oligonucleotide
  Target: ATXN1; (-) strand; PAM type: NRG; PAM sequence: TGG
ttttcaggatgtatgtatca

SEQ ID NO: 78446 - DNA, 20 bp, Artificial Sequence
  Description of Artificial Sequence: Synthetic oligonucleotide
  Target: ATXN1; (-) strand; PAM type: NRG; PAM sequence: AGG
atggtgatgctgtgattttc

SEQ ID NO: 78447 - DNA, 20 bp, Artificial Sequence
  Description of Artificial Sequence: Synthetic oligonucleotide
  Target: ATXN1; (-) strand; PAM type: NRG; PAM sequence: CAG
aatggtgatgctgtgatttt

SEQ ID NO: 78448 - DNA, 20 bp, Artificial Sequence
  Description of Artificial Sequence: Synthetic oligonucleotide
  Target: ATXN1; (-) strand; PAM type: NRG; PAM sequence: TGG
gataatttttgtctattgaa

SEQ ID NO: 78449 - DNA, 20 bp, Artificial Sequence
  Description of Artificial Sequence: Synthetic oligonucleotide
  Target: ATXN1; (-) strand; PAM type: NRG; PAM sequence: TGG
tatttaagagaaaacctttt

SEQ ID NO: 78450 - DNA, 20 bp, Artificial Sequence
  Description of Artificial Sequence: Synthetic oligonucleotide
  Target: ATXN1; (-) strand; PAM type: NRG; PAM sequence: GAG
ctttcccacagaatatttaa

SEQ ID NO: 78451 - DNA, 20 bp, Artificial Sequence
  Description of Artificial Sequence: Synthetic oligonucleotide
  Target: ATXN1; (-) strand; PAM type: NRG; PAM sequence: AAG
ctctttcccacagaatattt

SEQ ID NO: 78452 - DNA, 20 bp, Artificial Sequence
  Description of Artificial Sequence: Synthetic oligonucleotide
  Target: ATXN1; (-) strand; PAM type: NRG; PAM sequence: CAG
attttcaaccctctttccca

SEQ ID NO: 78453 - DNA, 20 bp, Artificial Sequence
  Description of Artificial Sequence: Synthetic oligonucleotide
  Target: ATXN1; (-) strand; PAM type: NRG; PAM sequence: TAG
cttttactgtggcaaataca

SEQ ID NO: 78454 - DNA, 20 bp, Artificial Sequence
  Description of Artificial Sequence: Synthetic oligonucleotide
  Target: ATXN1; (-) strand; PAM type: NRG; PAM sequence: TGG
gtggtagatatcttttactg

SEQ ID NO: 78455 - DNA, 20 bp, Artificial Sequence
  Description of Artificial Sequence: Synthetic oligonucleotide
  Target: ATXN1; (-) strand; PAM type: NRG; PAM sequence: TAG
tattggctactggtttgtgg

SEQ ID NO: 78456 - DNA, 20 bp, Artificial Sequence
  Description of Artificial Sequence: Synthetic oligonucleotide
  Target: ATXN1; (-) strand; PAM type: NRG; PAM sequence: TGG
taatattggctactggtttg

SEQ ID NO: 78457 - DNA, 20 bp, Artificial Sequence
  Description of Artificial Sequence: Synthetic oligonucleotide
  Target: ATXN1; (-) strand; PAM type: NRG; PAM sequence: TGG
tttaatataatattggctac

SEQ ID NO: 78458 - DNA, 20 bp, Artificial Sequence
  Description of Artificial Sequence: Synthetic oligonucleotide
  Target: ATXN1; (-) strand; PAM type: NRG; PAM sequence: TGG
tttaacttttaatataatat

SEQ ID NO: 78459 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccaccgcatg

SEQ ID NO: 78460 - DNA, 20 bp, Artificial Sequence
  Description of Artificial Sequence: Synthetic oligonucleotide
  Target: ATXN1; (-) strand; PAM type: NRG; PAM sequence: GAG
agtgctggggttacaggcat

SEQ ID NO: 78461 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctggggttac

SEQ ID NO: 78462 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctggggtta

SEQ ID NO: 78463 - DNA, 20 bp, Artificial Sequence
  Description of Artificial Sequence: Synthetic oligonucleotide
  Target: ATXN1; (-) strand; PAM type: NRG; PAM sequence: GGG
ttcagcctcccaaagtgctg

SEQ ID NO: 78464 - DNA, 20 bp, Artificial Sequence
  Description of Artificial Sequence: Synthetic oligonucleotide
  Target: ATXN1; (-) strand; PAM type: NRG; PAM sequence: GGG
cttcagcctcccaaagtgct

SEQ ID NO: 78465 - DNA, 20 bp, Artificial Sequence
  Description of Artificial Sequence: Synthetic oligonucleotide
  Target: ATXN1; (-) strand; PAM type: NRG; PAM sequence: TGG
gcttcagcctcccaaagtgc

SEQ ID NO: 78466 - DNA, 20 bp, Artificial Sequence
  Description of Artificial Sequence: Synthetic oligonucleotide
  Target: ATXN1; (-) strand; PAM type: NRG; PAM sequence: AAG
ccacccgcttcagcctccca

SEQ ID NO: 78467 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatccacccgctt

SEQ ID NO: 78468 - DNA, 20 bp, Artificial Sequence
  Description of Artificial Sequence: Synthetic oligonucleotide
  Target: ATXN1; (-) strand; PAM type: NRG; PAM sequence: AAG
ggtctcaaactcctgacctc

SEQ ID NO: 78469 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttcgccaggc

SEQ ID NO: 78470 - DNA, 20 bp, Artificial Sequence
  Description of Artificial Sequence: Synthetic oligonucleotide
  Target: ATXN1; (-) strand; PAM type: NRG; PAM sequence: AGG
ggagtttcaccatgttcgcc

SEQ ID NO: 78471 - DNA, 20 bp, Artificial Sequence
  Description of Artificial Sequence: Synthetic oligonucleotide
  Target: ATXN1; (-) strand; PAM type: NRG; PAM sequence: CAG
cggagtttcaccatgttcgc

SEQ ID NO: 78472 - DNA, 20 bp, Artificial Sequence
  Description of Artificial Sequence: Synthetic oligonucleotide
  Target: ATXN1; (-) strand; PAM type: NRG; PAM sequence: GAG
ttgtatttttagtagagacg

SEQ ID NO: 78473 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 78474 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 78475 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 78476 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtatttt

SEQ ID NO: 78477 - DNA, 20 bp, Artificial Sequence
  Description of Artificial Sequence: Synthetic oligonucleotide
  Target: ATXN1; (-) strand; PAM type: NRG; PAM sequence: TGG
caggcatgcaacaccacgcc

SEQ ID NO: 78478 - DNA, 20 bp, Artificial Sequence
  Description of Artificial Sequence: Synthetic oligonucleotide
  Target: ATXN1; (-) strand; PAM type: NRG; PAM sequence: AGG
tcccaagtatctgggattac

SEQ ID NO: 78479 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtatctgggatta

SEQ ID NO: 78480 - DNA, 20 bp, Artificial Sequence
  Description of Artificial Sequence: Synthetic oligonucleotide
  Target: ATXN1; (-) strand; PAM type: NRG; PAM sequence: GGG
cctcagactcccaagtatct

SEQ ID NO: 78481 - DNA, 20 bp, Artificial Sequence
  Description of Artificial Sequence: Synthetic oligonucleotide
  Target: ATXN1; (-) strand; PAM type: NRG; PAM sequence: TGG
gcctcagactcccaagtatc

SEQ ID NO: 78482 - DNA, 20 bp, Artificial Sequence
  Description of Artificial Sequence: Synthetic oligonucleotide
  Target: ATXN1; (-) strand; PAM type: NRG; PAM sequence: AAG
ttctccggcctcagactccc

SEQ ID NO: 78483 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgattctccggcct

SEQ ID NO: 78484 - DNA, 20 bp, Artificial Sequence
  Description of Artificial Sequence: Synthetic oligonucleotide
  Target: ATXN1; (-) strand; PAM type: NRG; PAM sequence: CGG
cccaggctcaagtgattctc

SEQ ID NO: 78485 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccaggctc

SEQ ID NO: 78486 - DNA, 20 bp, Artificial Sequence
  Description of Artificial Sequence: Synthetic oligonucleotide
  Target: ATXN1; (-) strand; PAM type: NRG; PAM sequence: AGG
cattgcaacctctgcctccc

SEQ ID NO: 78487 - DNA, 20 bp, Artificial Sequence
  Description of Artificial Sequence: Synthetic oligonucleotide
  Target: ATXN1; (-) strand; PAM type: NRG; PAM sequence: CAG
tcattgcaacctctgcctcc

SEQ ID NO: 78488 - DNA, 20 bp, Artificial Sequence
  Description of Artificial Sequence: Synthetic oligonucleotide
  Target: ATXN1; (-) strand; PAM type: NRG; PAM sequence: TGG
agtgcagtggcacacgatct

SEQ ID NO: 78489 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcag

SEQ ID NO: 78490 - DNA, 20 bp, Artificial Sequence
  Description of Artificial Sequence: Synthetic oligonucleotide
  Target: ATXN1; (-) strand; PAM type: NRG; PAM sequence: CAG
ctgttgcccaggctggagtg

SEQ ID NO: 78491 - DNA, 20 bp, Artificial Sequence
  Description of Artificial Sequence: Synthetic oligonucleotide
  Target: ATXN1; (-) strand; PAM type: NRG; PAM sequence: GAG
ttgctctgttgcccaggctg

SEQ ID NO: 78492 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgttgcccaggc

SEQ ID NO: 78493 - DNA, 20 bp, Artificial Sequence
  Description of Artificial Sequence: Synthetic oligonucleotide
  Target: ATXN1; (-) strand; PAM type: NRG; PAM sequence: AGG
agggtcttgctctgttgccc

SEQ ID NO: 78494 - DNA, 20 bp, Artificial Sequence
  Description of Artificial Sequence: Synthetic oligonucleotide
  Target: ATXN1; (-) strand; PAM type: NRG; PAM sequence: CAG
cagggtcttgctctgttgcc

SEQ ID NO: 78495 - DNA, 20 bp, Artificial Sequence
  Description of Artificial Sequence: Synthetic oligonucleotide
  Target: ATXN1; (-) strand; PAM type: NRG; PAM sequence: GGG
cattttattttatcaagaca

SEQ ID NO: 78496 - DNA, 20 bp, Artificial Sequence
  Description of Artificial Sequence: Synthetic oligonucleotide
  Target: ATXN1; (-) strand; PAM type: NRG; PAM sequence: AGG
tcattttattttatcaagac

SEQ ID NO: 78497 - DNA, 20 bp, Artificial Sequence
  Description of Artificial Sequence: Synthetic oligonucleotide
  Target: ATXN1; (-) strand; PAM type: NRG; PAM sequence: CAG
ttcattttattttatcaaga

SEQ ID NO: 78498 - DNA, 20 bp, Artificial Sequence
  Description of Artificial Sequence: Synthetic oligonucleotide
  Target: ATXN1; (-) strand; PAM type: NRG; PAM sequence: AAG
ttatttcattttattttatc

SEQ ID NO: 78499 - DNA, 20 bp, Artificial Sequence
  Description of Artificial Sequence: Synthetic oligonucleotide
  Target: ATXN1; (-) strand; PAM type: NRG; PAM sequence: TAG
ttaaagcattttaatgtttc

SEQ ID NO: 78500 - DNA, 20 bp, Artificial Sequence
  Description of Artificial Sequence: Synthetic oligonucleotide
  Target: ATXN1; (-) strand; PAM type: NRG; PAM sequence: AAG
tacttcttaaattaatatta

SEQ ID NO: 78501 - DNA, 20 bp, Artificial Sequence
  Description of Artificial Sequence: Synthetic oligonucleotide
  Target: ATXN1; (-) strand; PAM type: NRG; PAM sequence: AGG
ctataataatttttttgatc

SEQ ID NO: 78502 - DNA, 20 bp, Artificial Sequence
  Description of Artificial Sequence: Synthetic oligonucleotide
  Target: ATXN1; (-) strand; PAM type: NRG; PAM sequence: CAG
tctataataatttttttgat

SEQ ID NO: 78503 - DNA, 20 bp, Artificial Sequence
  Description of Artificial Sequence: Synthetic oligonucleotide
  Target: ATXN1; (-) strand; PAM type: NRG; PAM sequence: AAG
gaaagcctccccacccctaa

SEQ ID NO: 78504 - DNA, 20 bp, Artificial Sequence
  Description of Artificial Sequence: Synthetic oligonucleotide
  Target: ATXN1; (-) strand; PAM type: NRG; PAM sequence: AAG
ttttggttgttatattatga

SEQ ID NO: 78505 - DNA, 20 bp, Artificial Sequence
  Description of Artificial Sequence: Synthetic oligonucleotide
  Target: ATXN1; (-) strand; PAM type: NRG; PAM sequence: TGG
attagaattatgtcattttt

SEQ ID NO: 78506 - DNA, 20 bp, Artificial Sequence
  Description of Artificial Sequence: Synthetic oligonucleotide
  Target: ATXN1; (-) strand; PAM type: NRG; PAM sequence: TAG
ttacctgtccccaaagttat

SEQ ID NO: 78507 - DNA, 20 bp, Artificial Sequence
  Description of Artificial Sequence: Synthetic oligonucleotide
  Target: ATXN1; (-) strand; PAM type: NRG; PAM sequence: AAG
tttgaaattacctgtcccca

SEQ ID NO: 78508 - DNA, 20 bp, Artificial Sequence
  Description of Artificial Sequence: Synthetic oligonucleotide
  Target: ATXN1; (-) strand; PAM type: NRG; PAM sequence: AAG
aggcacatgtagcatcctgg

SEQ ID NO: 78509 - DNA, 20 bp, Artificial Sequence
  Description of Artificial Sequence: Synthetic oligonucleotide
  Target: ATXN1; (-) strand; PAM type: NRG; PAM sequence: TGG
ttaaggcacatgtagcatcc

SEQ ID NO: 78510 - DNA, 20 bp, Artificial Sequence
  Description of Artificial Sequence: Synthetic oligonucleotide
  Target: ATXN1; (-) strand; PAM type: NRG; PAM sequence: TAG
tgcccccattaaggcacatg

SEQ ID NO: 78511 - DNA, 20 bp, Artificial Sequence
  Description of Artificial Sequence: Synthetic oligonucleotide
  Target: ATXN1; (-) strand; PAM type: NRG; PAM sequence: AGG
gggtacctttgcccccatta

SEQ ID NO: 78512 - DNA, 20 bp, Artificial Sequence
  Description of Artificial Sequence: Synthetic oligonucleotide
  Target: ATXN1; (-) strand; PAM type: NRG; PAM sequence: AAG
agggtacctttgcccccatt

SEQ ID NO: 78513 - DNA, 20 bp, Artificial Sequence
  Description of Artificial Sequence: Synthetic oligonucleotide
  Target: ATXN1; (-) strand; PAM type: NRG; PAM sequence: GGG
agaaaagtgagagaaaggaa

SEQ ID NO: 78514 - DNA, 20 bp, Artificial Sequence
  Description of Artificial Sequence: Synthetic oligonucleotide
  Target: ATXN1; (-) strand; PAM type: NRG; PAM sequence: AGG
aagaaaagtgagagaaagga

SEQ ID NO: 78515 - DNA, 20 bp, Artificial Sequence
  Description of Artificial Sequence: Synthetic oligonucleotide
  Target: ATXN1; (-) strand; PAM type: NRG; PAM sequence: AAG
gaagaaaagtgagagaaagg

SEQ ID NO: 78516 - DNA, 20 bp, Artificial Sequence
  Description of Artificial Sequence: Synthetic oligonucleotide
  Target: ATXN1; (-) strand; PAM type: NRG; PAM sequence: AGG
ggagaagaaaagtgagagaa

SEQ ID NO: 78517 - DNA, 20 bp, Artificial Sequence
  Description of Artificial Sequence: Synthetic oligonucleotide
  Target: ATXN1; (-) strand; PAM type: NRG; PAM sequence: AAG
aggagaagaaaagtgagaga

SEQ ID NO: 78518 - DNA, 20 bp, Artificial Sequence
  Description of Artificial Sequence: Synthetic oligonucleotide
  Target: ATXN1; (-) strand; PAM type: NRG; PAM sequence: GAG
ctcaaggagaagaaaagtga

SEQ ID NO: 78519 - DNA, 20 bp, Artificial Sequence
  Description of Artificial Sequence: Synthetic oligonucleotide
  Target: ATXN1; (-) strand; PAM type: NRG; PAM sequence: GAG
gcctcaaggagaagaaaagt

SEQ ID NO: 78520 - DNA, 20 bp, Artificial Sequence
  Description of Artificial Sequence: Synthetic oligonucleotide
  Target: ATXN1; (-) strand; PAM type: NRG; PAM sequence: AAG
agttgcctcaaggagaagaa

SEQ ID NO: 78521 - DNA, 20 bp, Artificial Sequence
  Description of Artificial Sequence: Synthetic oligonucleotide
  Target: ATXN1; (-) strand; PAM type: NRG; PAM sequence: AAG
ctctgagttgcctcaaggag

SEQ ID NO: 78522 - DNA, 20 bp, Artificial Sequence
  Description of Artificial Sequence: Synthetic oligonucleotide
  Target: ATXN1; (-) strand; PAM type: NRG; PAM sequence: GAG
ctcctctgagttgcctcaag

SEQ ID NO: 78523 - DNA, 20 bp, Artificial Sequence
  Description of Artificial Sequence: Synthetic oligonucleotide
  Target: ATXN1; (-) strand; PAM type: NRG; PAM sequence: AGG
cgctcctctgagttgcctca

SEQ ID NO: 78524 - DNA, 20 bp, Artificial Sequence
  Description of Artificial Sequence: Synthetic oligonucleotide
  Target: ATXN1; (-) strand; PAM type: NRG; PAM sequence: AAG
tcgctcctctgagttgcctc

SEQ ID NO: 78525 - DNA, 20 bp, Artificial Sequence
  Description of Artificial Sequence: Synthetic oligonucleotide
  Target: ATXN1; (-) strand; PAM type: NRG; PAM sequence: GAG
atttccacaatcgctcctct

SEQ ID NO: 78526 - DNA, 20 bp, Artificial Sequence
  Description of Artificial Sequence: Synthetic oligonucleotide
  Target: ATXN1; (-) strand; PAM type: NRG; PAM sequence: CGG
aagctgacatatagcagctt

SEQ ID NO: 78527 - DNA, 20 bp, Artificial Sequence
  Description of Artificial Sequence: Synthetic oligonucleotide
  Target: ATXN1; (-) strand; PAM type: NRG; PAM sequence: CAG
atgggcaagctgacatatag

SEQ ID NO: 78528 - DNA, 20 bp, Artificial Sequence
  Description of Artificial Sequence: Synthetic oligonucleotide
  Target: ATXN1; (-) strand; PAM type: NRG; PAM sequence: TAG
caaatgggcaagctgacata

SEQ ID NO: 78529 - DNA, 20 bp, Artificial Sequence
  Description of Artificial Sequence: Synthetic oligonucleotide
  Target: ATXN1; (-) strand; PAM type: NRG; PAM sequence: AAG
gaaattccatacaaatgggc

SEQ ID NO: 78530 - DNA, 20 bp, Artificial Sequence
  Description of Artificial Sequence: Synthetic oligonucleotide
  Target: ATXN1; (-) strand; PAM type: NRG; PAM sequence: GGG
ccatgaaattccatacaaat

SEQ ID NO: 78531 - DNA, 20 bp, Artificial Sequence
  Description of Artificial Sequence: Synthetic oligonucleotide
  Target: ATXN1; (-) strand; PAM type: NRG; PAM sequence: TGG
accatgaaattccatacaaa

SEQ ID NO: 78532 - DNA, 20 bp, Artificial Sequence
  Description of Artificial Sequence: Synthetic oligonucleotide
  Target: ATXN1; (-) strand; PAM type: NRG; PAM sequence: AAG
caagatgcgatgatgacaaa

SEQ ID NO: 78533 - DNA, 20 bp, Artificial Sequence
  Description of Artificial Sequence: Synthetic oligonucleotide
  Target: ATXN1; (-) strand; PAM type: NRG; PAM sequence: AAG
ttcctttcctctctactttc

SEQ ID NO: 78534 - DNA, 20 bp, Artificial Sequence
  Description of Artificial Sequence: Synthetic oligonucleotide
  Target: ATXN1; (-) strand; PAM type: NRG; PAM sequence: CAG
ccagaagcctctgatagtaa

SEQ ID NO: 78535 - DNA, 20 bp, Artificial Sequence
  Description of Artificial Sequence: Synthetic oligonucleotide
  Target: ATXN1; (-) strand; PAM type: NRG; PAM sequence: TAG
ggatttccagaagcctctga

SEQ ID NO: 78536 - DNA, 20 bp, Artificial Sequence
  Description of Artificial Sequence: Synthetic oligonucleotide
  Target: ATXN1; (-) strand; PAM type: NRG; PAM sequence: AAG
catcaagcggggatttccag

SEQ ID NO: 78537 - DNA, 20 bp, Artificial Sequence
  Description of Artificial Sequence: Synthetic oligonucleotide
  Target: ATXN1; (-) strand; PAM type: NRG; PAM sequence: CAG
taccatcaagcggggatttc

SEQ ID NO: 78538 - DNA, 20 bp, Artificial Sequence
  Description of Artificial Sequence: Synthetic oligonucleotide
  Target: ATXN1; (-) strand; PAM type: NRG; PAM sequence: GGG
gagtcatgtaccatcaagcg

SEQ ID NO: 78539 - DNA, 20 bp, Artificial Sequence
  Description of Artificial Sequence: Synthetic oligonucleotide
  Target: ATXN1; (-) strand; PAM type: NRG; PAM sequence: GGG
agagtcatgtaccatcaagc

SEQ ID NO: 78540 - DNA, 20 bp, Artificial Sequence
  Description of Artificial Sequence: Synthetic oligonucleotide
  Target: ATXN1; (-) strand; PAM type: NRG; PAM sequence: CGG
aagagtcatgtaccatcaag

SEQ ID NO: 78541 - DNA, 20 bp, Artificial Sequence
  Description of Artificial Sequence: Synthetic oligonucleotide
  Target: ATXN1; (-) strand; PAM type: NRG; PAM sequence: AAG
agaaagagtcatgtaccatc

SEQ ID NO: 78542 - DNA, 20 bp, Artificial Sequence
  Description of Artificial Sequence: Synthetic oligonucleotide
  Target: ATXN1; (-) strand; PAM type: NRG; PAM sequence: GAG
agagaaccattcttaagaaa

SEQ ID NO: 78543 - DNA, 20 bp, Artificial Sequence
  Description of Artificial Sequence: Synthetic oligonucleotide
  Target: ATXN1; (-) strand; PAM type: NRG; PAM sequence: AAG
aaagagaaccattcttaaga

SEQ ID NO: 78544 - DNA, 20 bp, Artificial Sequence
  Description of Artificial Sequence: Synthetic oligonucleotide
  Target: ATXN1; (-) strand; PAM type: NRG; PAM sequence: AAG
cgtaaaagagaaccattctt

SEQ ID NO: 78545 - DNA, 20 bp, Artificial Sequence
  Description of Artificial Sequence: Synthetic oligonucleotide
  Target: ATXN1; (-) strand; PAM type: NRG; PAM sequence: GAG
caaaatggcaacccgtaaaa

SEQ ID NO: 78546 - DNA, 20 bp, Artificial Sequence
  Description of Artificial Sequence: Synthetic oligonucleotide
  Target: ATXN1; (-) strand; PAM type: NRG; PAM sequence: AAG
accaaaatggcaacccgtaa

SEQ ID NO: 78547 - DNA, 20 bp, Artificial Sequence
  Description of Artificial Sequence: Synthetic oligonucleotide
  Target: ATXN1; (-) strand; PAM type: NRG; PAM sequence: TGG
tgcaccaattgtcaccaaaa

SEQ ID NO: 78548 - DNA, 20 bp, Artificial Sequence
  Description of Artificial Sequence: Synthetic oligonucleotide
  Target: ATXN1; (-) strand; PAM type: NRG; PAM sequence: GAG
gcccaccaagaggtagagct

SEQ ID NO: 78549 - DNA, 20 bp, Artificial Sequence
  Description of Artificial Sequence: Synthetic oligonucleotide
  Target: ATXN1; (-) strand; PAM type: NRG; PAM sequence: GAG
ctggggcccaccaagaggta

SEQ ID NO: 78550 - DNA, 20 bp, Artificial Sequence
  Description of Artificial Sequence: Synthetic oligonucleotide
  Target: ATXN1; (-) strand; PAM type: NRG; PAM sequence: TAG
tactggggcccaccaagagg

SEQ ID NO: 78551 - DNA, 20 bp, Artificial Sequence
  Description of Artificial Sequence: Synthetic oligonucleotide
  Target: ATXN1; (-) strand; PAM type: NRG; PAM sequence: AGG
gtatactggggcccaccaag

SEQ ID NO: 78552 - DNA, 20 bp, Artificial Sequence
  Description of Artificial Sequence: Synthetic oligonucleotide
  Target: ATXN1; (-) strand; PAM type: NRG; PAM sequence: GAG
agtatactggggcccaccaa

SEQ ID NO: 78553 - DNA, 20 bp, Artificial Sequence
  Description of Artificial Sequence: Synthetic oligonucleotide
  Target: ATXN1; (-) strand; PAM type: NRG; PAM sequence: AAG
gaagtatactggggcccacc

SEQ ID NO: 78554 - DNA, 20 bp, Artificial Sequence
  Description of Artificial Sequence: Synthetic oligonucleotide
  Target: ATXN1; (-) strand; PAM type: NRG; PAM sequence: GGG
gatcatgctgaagtatactg

SEQ ID NO: 78555 - DNA, 20 bp, Artificial Sequence
  Description of Artificial Sequence: Synthetic oligonucleotide
  Target: ATXN1; (-) strand; PAM type: NRG; PAM sequence: GGG
agatcatgctgaagtatact

SEQ ID NO: 78556 - DNA, 20 bp, Artificial Sequence
  Description of Artificial Sequence: Synthetic oligonucleotide
  Target: ATXN1; (-) strand; PAM type: NRG; PAM sequence: TGG
gagatcatgctgaagtatac

SEQ ID NO: 78557 - DNA, 20 bp, Artificial Sequence
  Description of Artificial Sequence: Synthetic oligonucleotide
  Target: ATXN1; (-) strand; PAM type: NRG; PAM sequence: AAG
aaagaactgagatcatgctg

SEQ ID NO: 78558 - DNA, 20 bp, Artificial Sequence
  Description of Artificial Sequence: Synthetic oligonucleotide
  Target: ATXN1; (-) strand; PAM type: NRG; PAM sequence: GAG
tggtagagaaagaaagaact

SEQ ID NO: 78559 - DNA, 20 bp, Artificial Sequence
  Description of Artificial Sequence: Synthetic oligonucleotide
  Target: ATXN1; (-) strand; PAM type: NRG; PAM sequence: AAG
tggaaactggtagagaaaga

SEQ ID NO: 78560 - DNA, 20 bp, Artificial Sequence
  Description of Artificial Sequence: Synthetic oligonucleotide
  Target: ATXN1; (-) strand; PAM type: NRG; PAM sequence: AAG
atcatggaaactggtagaga

SEQ ID NO: 78561 - DNA, 20 bp, Artificial Sequence
  Description of Artificial Sequence: Synthetic oligonucleotide
  Target: ATXN1; (-) strand; PAM type: NRG; PAM sequence: GAG
atgtatcatggaaactggta

SEQ ID NO: 78562 - DNA, 20 bp, Artificial Sequence
  Description of Artificial Sequence: Synthetic oligonucleotide
  Target: ATXN1; (-) strand; PAM type: NRG; PAM sequence: TAG
gtatgtatcatggaaactgg

SEQ ID NO: 78563 - DNA, 20 bp, Artificial Sequence
  Description of Artificial Sequence: Synthetic oligonucleotide
  Target: ATXN1; (-) strand; PAM type: NRG; PAM sequence: TGG
gatgtatgtatcatggaaac

SEQ ID NO: 78564 - DNA, 20 bp, Artificial Sequence
  Description of Artificial Sequence: Synthetic oligonucleotide
  Target: ATXN1; (-) strand; PAM type: NRG; PAM sequence: TGG
ttttcaggatgtatgtatca

SEQ ID NO: 78565 - DNA, 20 bp, Artificial Sequence
  Description of Artificial Sequence: Synthetic oligonucleotide
  Target: ATXN1; (-) strand; PAM type: NRG; PAM sequence: AGG
atggtgatgctgtgattttc

SEQ ID NO: 78566 - DNA, 20 bp, Artificial Sequence
  Description of Artificial Sequence: Synthetic oligonucleotide
  Target: ATXN1; (-) strand; PAM type: NRG; PAM sequence: CAG
aatggtgatgctgtgatttt

SEQ ID NO: 78567 - DNA, 20 bp, Artificial Sequence
  Description of Artificial Sequence: Synthetic oligonucleotide
  Target: ATXN1; (-) strand; PAM type: NRG; PAM sequence: TGG
gataatttttgtctattgaa

SEQ ID NO: 78568 - DNA, 20 bp, Artificial Sequence
  Description of Artificial Sequence: Synthetic oligonucleotide
  Target: ATXN1; (-) strand; PAM type: NRG; PAM sequence: TGG
tatttaagagaaaacctttt

SEQ ID NO: 78569 - DNA, 20 bp, Artificial Sequence
  Description of Artificial Sequence: Synthetic oligonucleotide
  Target: ATXN1; (-) strand; PAM type: NRG; PAM sequence: GAG
ctttcccacagaatatttaa

SEQ ID NO: 78570 - DNA, 20 bp, Artificial Sequence
  Description of Artificial Sequence: Synthetic oligonucleotide
  Target: ATXN1; (-) strand; PAM type: NRG; PAM sequence: AAG
ctctttcccacagaatattt

SEQ ID NO: 78571 - DNA, 20 bp, Artificial Sequence
  Description of Artificial Sequence: Synthetic oligonucleotide
  Target: ATXN1; (-) strand; PAM type: NRG; PAM sequence: CAG
attttcaaccctctttccca

SEQ ID NO: 78572 - DNA, 20 bp, Artificial Sequence
  Description of Artificial Sequence: Synthetic oligonucleotide
  Target: ATXN1; (-) strand; PAM type: NRG; PAM sequence: TAG
cttttactgtggcaaataca

SEQ ID NO: 78573 - DNA, 20 bp, Artificial Sequence
  Description of Artificial Sequence: Synthetic oligonucleotide
  Target: ATXN1; (-) strand; PAM type: NRG; PAM sequence: TGG
gtggtaggtatcttttactg

SEQ ID NO: 78574 - DNA, 20 bp, Artificial Sequence
  Description of Artificial Sequence: Synthetic oligonucleotide
  Target: ATXN1; (-) strand; PAM type: NRG; PAM sequence: AGG
attggctactggtttgtggt

SEQ ID NO: 78575 - DNA, 20 bp, Artificial Sequence
  Description of Artificial Sequence: Synthetic oligonucleotide
  Target: ATXN1; (-) strand; PAM type: NRG; PAM sequence: TAG
tattggctactggtttgtgg

SEQ ID NO: 78576 - DNA, 20 bp, Artificial Sequence
  Description of Artificial Sequence: Synthetic oligonucleotide
  Target: ATXN1; (-) strand; PAM type: NRG; PAM sequence: TGG
taatattggctactggtttg

SEQ ID NO: 78577 - DNA, 20 bp, Artificial Sequence
  Description of Artificial Sequence: Synthetic oligonucleotide
  Target: ATXN1; (-) strand; PAM type: NRG; PAM sequence: TGG
tttaatataatattggctac

SEQ ID NO: 78578 - DNA, 20 bp, Artificial Sequence
  Description of Artificial Sequence: Synthetic oligonucleotide
  Target: ATXN1; (-) strand; PAM type: NRG; PAM sequence: TGG
tttaacttttaatataatat

SEQ ID NO: 78579 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccaccgcatg

SEQ ID NO: 78580 - DNA, 20 bp, Artificial Sequence
  Description of Artificial Sequence: Synthetic oligonucleotide
  Target: ATXN1; (-) strand; PAM type: NRG; PAM sequence: GAG
agtgctggggttacaggcat

SEQ ID NO: 78581 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctggggttac

SEQ ID NO: 78582 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctggggtta

SEQ ID NO: 78583 - DNA, 20 bp, Artificial Sequence
  Description of Artificial Sequence: Synthetic oligonucleotide
  Target: ATXN1; (-) strand; PAM type: NRG; PAM sequence: GGG
ctcagcctcccaaagtgctg

SEQ ID NO: 78584 - DNA, 20 bp, Artificial Sequence
  Description of Artificial Sequence: Synthetic oligonucleotide
  Target: ATXN1; (-) strand; PAM type: NRG; PAM sequence: GGG
gctcagcctcccaaagtgct

SEQ ID NO: 78585 - DNA, 20 bp, Artificial Sequence
  Description of Artificial Sequence: Synthetic oligonucleotide
  Target: ATXN1; (-) strand; PAM type: NRG; PAM sequence: TGG
cgctcagcctcccaaagtgc

SEQ ID NO: 78586 - DNA, 20 bp, Artificial Sequence
  Description of Artificial Sequence: Synthetic oligonucleotide
  Target: ATXN1; (-) strand; PAM type: NRG; PAM sequence: AAG
tccacccgctcagcctccca

SEQ ID NO: 78587 - DNA, 20 bp, Artificial Sequence
  Description of Artificial Sequence: Synthetic oligonucleotide
  Target: ATXN1; (-) strand; PAM type: NRG; PAM sequence: CAG
cctcaagtgatccacccgct

SEQ ID NO: 78588 - DNA, 20 bp, Artificial Sequence
  Description of Artificial Sequence: Synthetic oligonucleotide
  Target: ATXN1; (-) strand; PAM type: NRG; PAM sequence: AAG
ggtctcaaactcctgacctc

SEQ ID NO: 78589 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttcaccaggc

SEQ ID NO: 78590 - DNA, 20 bp, Artificial Sequence
  Description of Artificial Sequence: Synthetic oligonucleotide
  Target: ATXN1; (-) strand; PAM type: NRG; PAM sequence: AGG
ggagtttcaccatgttcacc

SEQ ID NO: 78591 - DNA, 20 bp, Artificial Sequence
  Description of Artificial Sequence: Synthetic oligonucleotide
  Target: ATXN1; (-) strand; PAM type: NRG; PAM sequence: CAG
cggagtttcaccatgttcac

SEQ ID NO: 78592 - DNA, 20 bp, Artificial Sequence
  Description of Artificial Sequence: Synthetic oligonucleotide
  Target: ATXN1; (-) strand; PAM type: NRG; PAM sequence: GAG
ttgtatttttagtagagacg

SEQ ID NO: 78593 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 78594 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 78595 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 78596 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtatttt

SEQ ID NO: 78597 - DNA, 20 bp, Artificial Sequence
  Description of Artificial Sequence: Synthetic oligonucleotide
  Target: ATXN1; (-) strand; PAM type: NRG; PAM sequence: TGG
caggcatgcaacaccatgcc

SEQ ID NO: 78598 - DNA, 20 bp, Artificial Sequence
  Description of Artificial Sequence: Synthetic oligonucleotide
  Target: ATXN1; (-) strand; PAM type: NRG; PAM sequence: AGG
tcccaaatatctgggattac

SEQ ID NO: 78599 - DNA, 20 bp, Artificial Sequence
  Description of Artificial Sequence: Synthetic oligonucleotide
  Target: ATXN1; (-) strand; PAM type: NRG; PAM sequence: CAG
ctcccaaatatctgggatta

SEQ ID NO: 78600 - DNA, 20 bp, Artificial Sequence
  Description of Artificial Sequence: Synthetic oligonucleotide
  Target: ATXN1; (-) strand; PAM type: NRG; PAM sequence: GGG
ccacagactcccaaatatct

SEQ ID NO: 78601 - DNA, 20 bp, Artificial Sequence
  Description of Artificial Sequence: Synthetic oligonucleotide
  Target: ATXN1; (-) strand; PAM type: NRG; PAM sequence: TGG
gccacagactcccaaatatc

SEQ ID NO: 78602 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgattctccggcca

SEQ ID NO: 78603 - DNA, 20 bp, Artificial Sequence
  Description of Artificial Sequence: Synthetic oligonucleotide
  Target: ATXN1; (-) strand; PAM type: NRG; PAM sequence: CGG
cccaggctcaagtgattctc

SEQ ID NO: 78604 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccaggctc

SEQ ID NO: 78605 - DNA, 20 bp, Artificial Sequence
  Description of Artificial Sequence: Synthetic oligonucleotide
  Target: ATXN1; (-) strand; PAM type: NRG; PAM sequence: AGG
cattgcaacctctgcctccc

SEQ ID NO: 78606 - DNA, 20 bp, Artificial Sequence
  Description of Artificial Sequence: Synthetic oligonucleotide
  Target: ATXN1; (-) strand; PAM type: NRG; PAM sequence: CAG
tcattgcaacctctgcctcc

SEQ ID NO: 78607 - DNA, 20 bp, Artificial Sequence
  Description of Artificial Sequence: Synthetic oligonucleotide
  Target: ATXN1; (-) strand; PAM type: NRG; PAM sequence: TGG
agtgcagtggcgcacgatct

SEQ ID NO: 78608 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 78609 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 78610 - DNA, 20 bp, Artificial Sequence
  Description of Artificial Sequence: Synthetic oligonucleotide
  Target: ATXN1; (-) strand; PAM type: NRG; PAM sequence: GAG
ttgctctgtcacccaggctg

SEQ ID NO: 78611 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgtcacccaggc

SEQ ID NO: 78612 - DNA, 20 bp, Artificial Sequence
  Description of Artificial Sequence: Synthetic oligonucleotide
  Target: ATXN1; (-) strand; PAM type: NRG; PAM sequence: AGG
agagtcttgctctgtcaccc

SEQ ID NO: 78613 - DNA, 20 bp, Artificial Sequence
  Description of Artificial Sequence: Synthetic oligonucleotide
  Target: ATXN1; (-) strand; PAM type: NRG; PAM sequence: CAG
cagagtcttgctctgtcacc

SEQ ID NO: 78614 - DNA, 20 bp, Artificial Sequence
  Description of Artificial Sequence: Synthetic oligonucleotide
  Target: ATXN1; (-) strand; PAM type: NRG; PAM sequence: GAG
tttttttttttcttgagaca

SEQ ID NO: 78615 - DNA, 20 bp, Artificial Sequence
  Description of Artificial Sequence: Synthetic oligonucleotide
  Target: ATXN1; (-) strand; PAM type: NRG; PAM sequence: CAG
aatttttttttttcttgaga

SEQ ID NO: 78616 - DNA, 20 bp, Artificial Sequence
  Description of Artificial Sequence: Synthetic oligonucleotide
  Target: ATXN1; (-) strand; PAM type: NRG; PAM sequence: GAG
atttaatttttttttttctt

SEQ ID NO: 78617 - DNA, 20 bp, Artificial Sequence
  Description of Artificial Sequence: Synthetic oligonucleotide
  Target: ATXN1; (-) strand; PAM type: NRG; PAM sequence: CAG
gccaaataataatggaagag

SEQ ID NO: 78618 - DNA, 20 bp, Artificial Sequence
  Description of Artificial Sequence: Synthetic oligonucleotide
  Target: ATXN1; (-) strand; PAM type: NRG; PAM sequence: GAG
tatgccaaataataatggaa

SEQ ID NO: 78619 - DNA, 20 bp, Artificial Sequence
  Description of Artificial Sequence: Synthetic oligonucleotide
  Target: ATXN1; (-) strand; PAM type: NRG; PAM sequence: AAG
ggtatgccaaataataatgg

SEQ ID NO: 78620 - DNA, 20 bp, Artificial Sequence
  Description of Artificial Sequence: Synthetic oligonucleotide
  Target: ATXN1; (-) strand; PAM type: NRG; PAM sequence: TGG
gatggtatgccaaataataa

SEQ ID NO: 78621 - DNA, 20 bp, Artificial Sequence
  Description of Artificial Sequence: Synthetic oligonucleotide
  Target: ATXN1; (-) strand; PAM type: NRG; PAM sequence: TGG
tttcttctacagcatcctga

SEQ ID NO: 78622 - DNA, 20 bp, Artificial Sequence
  Description of Artificial Sequence: Synthetic oligonucleotide
  Target: ATXN1; (-) strand; PAM type: NRG; PAM sequence: CAG
tttaacttttatttcttcta

SEQ ID NO: 78623 - DNA, 20 bp, Artificial Sequence
  Description of Artificial Sequence: Synthetic oligonucleotide
  Target: ATXN1; (-) strand; PAM type: NRG; PAM sequence: TAG
attcccttagatattctaag

SEQ ID NO: 78624 - DNA, 20 bp, Artificial Sequence
  Description of Artificial Sequence: Synthetic oligonucleotide
  Target: ATXN1; (-) strand; PAM type: NRG; PAM sequence: AAG
ctaattcccttagatattct

SEQ ID NO: 78625 - DNA, 20 bp, Artificial Sequence
  Description of Artificial Sequence: Synthetic oligonucleotide
  Target: ATXN1; (-) strand; PAM type: NRG; PAM sequence: TAG
agtctttcagctaattccct

SEQ ID NO: 78626 - DNA, 20 bp, Artificial Sequence
  Description of Artificial Sequence: Synthetic oligonucleotide
  Target: ATXN1; (-) strand; PAM type: NRG; PAM sequence: CAG
atctcagttctagagtcttt

SEQ ID NO: 78627 - DNA, 20 bp, Artificial Sequence
  Description of Artificial Sequence: Synthetic oligonucleotide
  Target: ATXN1; (-) strand; PAM type: NRG; PAM sequence: GAG
taatattgatctcagttcta

SEQ ID NO: 78628 - DNA, 20 bp, Artificial Sequence
  Description of Artificial Sequence: Synthetic oligonucleotide
  Target: ATXN1; (-) strand; PAM type: NRG; PAM sequence: TAG
cataatattgatctcagttc

SEQ ID NO: 78629 - DNA, 20 bp, Artificial Sequence
  Description of Artificial Sequence: Synthetic oligonucleotide
  Target: ATXN1; (-) strand; PAM type: NRG; PAM sequence: CAG
actgaccataatattgatct

SEQ ID NO: 78630 - DNA, 20 bp, Artificial Sequence
  Description of Artificial Sequence: Synthetic oligonucleotide
  Target: ATXN1; (-) strand; PAM type: NRG; PAM sequence: TGG
cagatatgagccactgtgcc

SEQ ID NO: 78631 - DNA, 20 bp, Artificial Sequence
  Description of Artificial Sequence: Synthetic oligonucleotide
  Target: ATXN1; (-) strand; PAM type: NRG; PAM sequence: GAG
aatgctgggattacagatat

SEQ ID NO: 78632 - DNA, 20 bp, Artificial Sequence
  Description of Artificial Sequence: Synthetic oligonucleotide
  Target: ATXN1; (-) strand; PAM type: NRG; PAM sequence: CAG
ctcccaaaatgctgggatta

SEQ ID NO: 78633 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaaatgct

SEQ ID NO: 78634 - DNA, 20 bp, Artificial Sequence
  Description of Artificial Sequence: Synthetic oligonucleotide
  Target: ATXN1; (-) strand; PAM type: NRG; PAM sequence: TGG
accttggcctcccaaaatgc

SEQ ID NO: 78635 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgagccacccacct

SEQ ID NO: 78636 - DNA, 20 bp, Artificial Sequence
  Description of Artificial Sequence: Synthetic oligonucleotide
  Target: ATXN1; (-) strand; PAM type: NRG; PAM sequence: GAG
tcaaacccctgacctcaggt

SEQ ID NO: 78637 - DNA, 20 bp, Artificial Sequence
  Description of Artificial Sequence: Synthetic oligonucleotide
  Target: ATXN1; (-) strand; PAM type: NRG; PAM sequence: AGG
ggtctcaaacccctgacctc

SEQ ID NO: 78638 - DNA, 20 bp, Artificial Sequence
  Description of Artificial Sequence: Synthetic oligonucleotide
  Target: ATXN1; (-) strand; PAM type: NRG; PAM sequence: CAG
tggtctcaaacccctgacct

SEQ ID NO: 78639 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttagccaggc

SEQ ID NO: 78640 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccatgttagcc

SEQ ID NO: 78641 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccatgttagc

SEQ ID NO: 78642 - DNA, 20 bp, Artificial Sequence
  Description of Artificial Sequence: Synthetic oligonucleotide
  Target: ATXN1; (-) strand; PAM type: NRG; PAM sequence: TAG
gagacagggtttcaccatgt

SEQ ID NO: 78643 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagaca

SEQ ID NO: 78644 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 78645 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 78646 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 78647 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 78648 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtatttt

SEQ ID NO: 78649 - DNA, 20 bp, Artificial Sequence
  Description of Artificial Sequence: Synthetic oligonucleotide
  Target: ATXN1; (-) strand; PAM type: NRG; PAM sequence: TGG
caggtgtgtaccaccacacc

SEQ ID NO: 78650 - DNA, 20 bp, Artificial Sequence
  Description of Artificial Sequence: Synthetic oligonucleotide
  Target: ATXN1; (-) strand; PAM type: NRG; PAM sequence: AGG
tcccaagtatctgggattac

SEQ ID NO: 78651 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtatctgggatta

SEQ ID NO: 78652 - DNA, 20 bp, Artificial Sequence
  Description of Artificial Sequence: Synthetic oligonucleotide
  Target: ATXN1; (-) strand; PAM type: NRG; PAM sequence: GGG
tctcagcctcccaagtatct

SEQ ID NO: 78653 - DNA, 20 bp, Artificial Sequence
  Description of Artificial Sequence: Synthetic oligonucleotide
  Target: ATXN1; (-) strand; PAM type: NRG; PAM sequence: TGG
gtctcagcctcccaagtatc

SEQ ID NO: 78654 - DNA, 20 bp, Artificial Sequence
  Description of Artificial Sequence: Synthetic oligonucleotide
  Target: ATXN1; (-) strand; PAM type: NRG; PAM sequence: AAG
ttcttctgtctcagcctccc

SEQ ID NO: 78655 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattcttctgtct

SEQ ID NO: 78656 - DNA, 20 bp, Artificial Sequence
  Description of Artificial Sequence: Synthetic oligonucleotide
  Target: ATXN1; (-) strand; PAM type: NRG; PAM sequence: AAG
agcctctgcctcccaggttc

SEQ ID NO: 78657 - DNA, 20 bp, Artificial Sequence
  Description of Artificial Sequence: Synthetic oligonucleotide
  Target: ATXN1; (-) strand; PAM type: NRG; PAM sequence: AGG
ccctgcagcctctgcctccc

SEQ ID NO: 78658 - DNA, 20 bp, Artificial Sequence
  Description of Artificial Sequence: Synthetic oligonucleotide
  Target: ATXN1; (-) strand; PAM type: NRG; PAM sequence: CAG
tccctgcagcctctgcctcc

SEQ ID NO: 78659 - DNA, 20 bp, Artificial Sequence
  Description of Artificial Sequence: Synthetic oligonucleotide
  Target: ATXN1; (-) strand; PAM type: NRG; PAM sequence: CAG
ggcatgatctcagctccctg

SEQ ID NO: 78660 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcatgatct

SEQ ID NO: 78661 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 78662 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 78663 - DNA, 20 bp, Artificial Sequence
  Description of Artificial Sequence: Synthetic oligonucleotide
  Target: ATXN1; (-) strand; PAM type: NRG; PAM sequence: GAG
tccttctgtcacccaggctg

SEQ ID NO: 78664 - DNA, 20 bp, Artificial Sequence
  Description of Artificial Sequence: Synthetic oligonucleotide
  Target: ATXN1; (-) strand; PAM type: NRG; PAM sequence: TGG
tctccttctgtcacccaggc

SEQ ID NO: 78665 - DNA, 20 bp, Artificial Sequence
  Description of Artificial Sequence: Synthetic oligonucleotide
  Target: ATXN1; (-) strand; PAM type: NRG; PAM sequence: AGG
acagtctccttctgtcaccc

SEQ ID NO: 78666 - DNA, 20 bp, Artificial Sequence
  Description of Artificial Sequence: Synthetic oligonucleotide
  Target: ATXN1; (-) strand; PAM type: NRG; PAM sequence: CAG
cacagtctccttctgtcacc

SEQ ID NO: 78667 - DNA, 20 bp, Artificial Sequence
  Description of Artificial Sequence: Synthetic oligonucleotide
  Target: ATXN1; (-) strand; PAM type: NRG; PAM sequence: CAG
tatatatattttttgagaca

SEQ ID NO: 78668 - DNA, 20 bp, Artificial Sequence
  Description of Artificial Sequence: Synthetic oligonucleotide
  Target: ATXN1; (-) strand; PAM type: NRG; PAM sequence: GAG
atatattatatatatttttt

SEQ ID NO: 78669 - DNA, 20 bp, Artificial Sequence
  Description of Artificial Sequence: Synthetic oligonucleotide
  Target: ATXN1; (-) strand; PAM type: NRG; PAM sequence: TAG
tatataaaatattttatata

SEQ ID NO: 78670 - DNA, 20 bp, Artificial Sequence
  Description of Artificial Sequence: Synthetic oligonucleotide
  Target: ATXN1; (-) strand; PAM type: NRG; PAM sequence: TAG
aggggtatatgtatatcttc

SEQ ID NO: 78671 - DNA, 20 bp, Artificial Sequence
  Description of Artificial Sequence: Synthetic oligonucleotide
  Target: ATXN1; (-) strand; PAM type: NRG; PAM sequence: GGG
ctatgtaagtgtgtgtggag

SEQ ID NO: 78672 - DNA, 20 bp, Artificial Sequence
  Description of Artificial Sequence: Synthetic oligonucleotide
  Target: ATXN1; (-) strand; PAM type: NRG; PAM sequence: GGG
tctatgtaagtgtgtgtgga

SEQ ID NO: 78673 - DNA, 20 bp, Artificial Sequence
  Description of Artificial Sequence: Synthetic oligonucleotide
  Target: ATXN1; (-) strand; PAM type: NRG; PAM sequence: AGG
gtctatgtaagtgtgtgtgg

SEQ ID NO: 78674 - DNA, 20 bp, Artificial Sequence
  Description of Artificial Sequence: Synthetic oligonucleotide
  Target: ATXN1; (-) strand; PAM type: NRG; PAM sequence: GAG
tgtctatgtaagtgtgtgtg

SEQ ID NO: 78675 - DNA, 20 bp, Artificial Sequence
  Description of Artificial Sequence: Synthetic oligonucleotide
  Target: ATXN1; (-) strand; PAM type: NRG; PAM sequence: TGG
tatgtctatgtaagtgtgtg

SEQ ID NO: 78676 - DNA, 20 bp, Artificial Sequence
  Description of Artificial Sequence: Synthetic oligonucleotide
  Target: ATXN1; (-) strand; PAM type: NRG; PAM sequence: AAG
aactattagtatgtctatgt

SEQ ID NO: 78677 - DNA, 20 bp, Artificial Sequence
  Description of Artificial Sequence: Synthetic oligonucleotide
  Target: ATXN1; (-) strand; PAM type: NRG; PAM sequence: TAG
ttgcgttttaggaaaactat

SEQ ID NO: 78678 - DNA, 20 bp, Artificial Sequence
  Description of Artificial Sequence: Synthetic oligonucleotide
  Target: ATXN1; (-) strand; PAM type: NRG; PAM sequence: AGG
cctgattatcattgcgtttt

SEQ ID NO: 78679 - DNA, 20 bp, Artificial Sequence
  Description of Artificial Sequence: Synthetic oligonucleotide
  Target: ATXN1; (-) strand; PAM type: NRG; PAM sequence: TAG
acctgattatcattgcgttt

SEQ ID NO: 78680 - DNA, 20 bp, Artificial Sequence
  Description of Artificial Sequence: Synthetic oligonucleotide
  Target: ATXN1; (-) strand; PAM type: NRG; PAM sequence: GGG
atggggagactactgtataa

SEQ ID NO: 78681 - DNA, 20 bp, Artificial Sequence
  Description of Artificial Sequence: Synthetic oligonucleotide
  Target: ATXN1; (-) strand; PAM type: NRG; PAM sequence: AGG
tatggggagactactgtata

SEQ ID NO: 78682 - DNA, 20 bp, Artificial Sequence
  Description of Artificial Sequence: Synthetic oligonucleotide
  Target: ATXN1; (-) strand; PAM type: NRG; PAM sequence: AAG
ctatggggagactactgtat

SEQ ID NO: 78683 - DNA, 20 bp, Artificial Sequence
  Description of Artificial Sequence: Synthetic oligonucleotide
  Target: ATXN1; (-) strand; PAM type: NRG; PAM sequence: GAG
agcaaaaccgtggctatggg

SEQ ID NO: 78684 - DNA, 20 bp, Artificial Sequence
  Description of Artificial Sequence: Synthetic oligonucleotide
  Target: ATXN1; (-) strand; PAM type: NRG; PAM sequence: GGG
aaagcaaaaccgtggctatg

SEQ ID NO: 78685 - DNA, 20 bp, Artificial Sequence
  Description of Artificial Sequence: Synthetic oligonucleotide
  Target: ATXN1; (-) strand; PAM type: NRG; PAM sequence: GGG
gaaagcaaaaccgtggctat

SEQ ID NO: 78686 - DNA, 20 bp, Artificial Sequence
  Description of Artificial Sequence: Synthetic oligonucleotide
  Target: ATXN1; (-) strand; PAM type: NRG; PAM sequence: TGG
ggaaagcaaaaccgtggcta

SEQ ID NO: 78687 - DNA, 20 bp, Artificial Sequence
  Description of Artificial Sequence: Synthetic oligonucleotide
  Target: ATXN1; (-) strand; PAM type: NRG; PAM sequence: TGG
aaccatggaaagcaaaaccg

SEQ ID NO: 78688 - DNA, 20 bp, Artificial Sequence
  Description of Artificial Sequence: Synthetic oligonucleotide
  Target: ATXN1; (-) strand; PAM type: NRG; PAM sequence: AAG
ccaataaataaaaccatgga

SEQ ID NO: 78689 - DNA, 20 bp, Artificial Sequence
  Description of Artificial Sequence: Synthetic oligonucleotide
  Target: ATXN1; (-) strand; PAM type: NRG; PAM sequence: TGG
ttgaccaataaataaaacca

SEQ ID NO: 78690 - DNA, 20 bp, Artificial Sequence
  Description of Artificial Sequence: Synthetic oligonucleotide
  Target: ATXN1; (-) strand; PAM type: NRG; PAM sequence: CAG
tgtactcgcctattttcaga

SEQ ID NO: 78691 - DNA, 20 bp, Artificial Sequence
  Description of Artificial Sequence: Synthetic oligonucleotide
  Target: ATXN1; (-) strand; PAM type: NRG; PAM sequence: CAG
gtactgtactcgcctatttt

SEQ ID NO: 78692 - DNA, 20 bp, Artificial Sequence
  Description of Artificial Sequence: Synthetic oligonucleotide
  Target: ATXN1; (-) strand; PAM type: NRG; PAM sequence: CAG
tatgtggatgtgatctctct

SEQ ID NO: 78693 - DNA, 20 bp, Artificial Sequence
  Description of Artificial Sequence: Synthetic oligonucleotide
  Target: ATXN1; (-) strand; PAM type: NRG; PAM sequence: TGG
atactataataaaagttatg

SEQ ID NO: 78694 - DNA, 20 bp, Artificial Sequence
  Description of Artificial Sequence: Synthetic oligonucleotide
  Target: ATXN1; (-) strand; PAM type: NRG; PAM sequence: AAG
ataaaaatatactataataa

SEQ ID NO: 78695 - DNA, 20 bp, Artificial Sequence
  Description of Artificial Sequence: Synthetic oligonucleotide
  Target: ATXN1; (-) strand; PAM type: NRG; PAM sequence: GAG
aaaattcaatgtataaatta

SEQ ID NO: 78696 - DNA, 20 bp, Artificial Sequence
  Description of Artificial Sequence: Synthetic oligonucleotide
  Target: ATXN1; (-) strand; PAM type: NRG; PAM sequence: TAG
ataaaattcaatgtataaat

SEQ ID NO: 78697 - DNA, 20 bp, Artificial Sequence
  Description of Artificial Sequence: Synthetic oligonucleotide
  Target: ATXN1; (-) strand; PAM type: NRG; PAM sequence: TAG
agttagtaccaaaccctata

SEQ ID NO: 78698 - DNA, 20 bp, Artificial Sequence
  Description of Artificial Sequence: Synthetic oligonucleotide
  Target: ATXN1; (-) strand; PAM type: NRG; PAM sequence: TAG
ggattcctgaaactgccagt

SEQ ID NO: 78699 - DNA, 20 bp, Artificial Sequence
  Description of Artificial Sequence: Synthetic oligonucleotide
  Target: ATXN1; (-) strand; PAM type: NRG; PAM sequence: CAG
tggtggattcctgaaactgc

SEQ ID NO: 78700 - DNA, 20 bp, Artificial Sequence
  Description of Artificial Sequence: Synthetic oligonucleotide
  Target: ATXN1; (-) strand; PAM type: NRG; PAM sequence: TGG
ggcatgttccatacccctgg

SEQ ID NO: 78701 - DNA, 20 bp, Artificial Sequence
  Description of Artificial Sequence: Synthetic oligonucleotide
  Target: ATXN1; (-) strand; PAM type: NRG; PAM sequence: TGG
gggggcatgttccatacccc

SEQ ID NO: 78702 - DNA, 20 bp, Artificial Sequence
  Description of Artificial Sequence: Synthetic oligonucleotide
  Target: ATXN1; (-) strand; PAM type: NRG; PAM sequence: GGG
tagtccccccgatcaactgg

SEQ ID NO: 78703 - DNA, 20 bp, Artificial Sequence
  Description of Artificial Sequence: Synthetic oligonucleotide
  Target: ATXN1; (-) strand; PAM type: NRG; PAM sequence: GGG
gtagtccccccgatcaactg

SEQ ID NO: 78704 - DNA, 20 bp, Artificial Sequence
  Description of Artificial Sequence: Synthetic oligonucleotide
  Target: ATXN1; (-) strand; PAM type: NRG; PAM sequence: GGG
agtagtccccccgatcaact

SEQ ID NO: 78705 - DNA, 20 bp, Artificial Sequence
  Description of Artificial Sequence: Synthetic oligonucleotide
  Target: ATXN1; (-) strand; PAM type: NRG; PAM sequence: TGG
cagtagtccccccgatcaac

SEQ ID NO: 78706 - DNA, 20 bp, Artificial Sequence
  Description of Artificial Sequence: Synthetic oligonucleotide
  Target: ATXN1; (-) strand; PAM type: NRG; PAM sequence: TAG
tctttattttccttatacag

SEQ ID NO: 78707 - DNA, 20 bp, Artificial Sequence
  Description of Artificial Sequence: Synthetic oligonucleotide
  Target: ATXN1; (-) strand; PAM type: NRG; PAM sequence: CAG
taatctttattttccttata

SEQ ID NO: 78708 - DNA, 20 bp, Artificial Sequence
  Description of Artificial Sequence: Synthetic oligonucleotide
  Target: ATXN1; (-) strand; PAM type: NRG; PAM sequence: TGG
ctttagagattttacagtgt

SEQ ID NO: 78709 - DNA, 20 bp, Artificial Sequence
  Description of Artificial Sequence: Synthetic oligonucleotide
  Target: ATXN1; (-) strand; PAM type: NRG; PAM sequence: CAG
tgttttctttagagatttta

SEQ ID NO: 78710 - DNA, 20 bp, Artificial Sequence
  Description of Artificial Sequence: Synthetic oligonucleotide
  Target: ATXN1; (-) strand; PAM type: NRG; PAM sequence: GAG
agcagttcttgttttcttta

SEQ ID NO: 78711 - DNA, 20 bp, Artificial Sequence
  Description of Artificial Sequence: Synthetic oligonucleotide
  Target: ATXN1; (-) strand; PAM type: NRG; PAM sequence: TAG
tgagcagttcttgttttctt

SEQ ID NO: 78712 - DNA, 20 bp, Artificial Sequence
  Description of Artificial Sequence: Synthetic oligonucleotide
  Target: ATXN1; (-) strand; PAM type: NRG; PAM sequence: CAG
ctgtttttatagaatctgag

SEQ ID NO: 78713 - DNA, 20 bp, Artificial Sequence
  Description of Artificial Sequence: Synthetic oligonucleotide
  Target: ATXN1; (-) strand; PAM type: NRG; PAM sequence: GAG
tttctgtttttatagaatct

SEQ ID NO: 78714 - DNA, 20 bp, Artificial Sequence
  Description of Artificial Sequence: Synthetic oligonucleotide
  Target: ATXN1; (-) strand; PAM type: NRG; PAM sequence: TAG
taatgcattttctgttttta

SEQ ID NO: 78715 - DNA, 20 bp, Artificial Sequence
  Description of Artificial Sequence: Synthetic oligonucleotide
  Target: ATXN1; (-) strand; PAM type: NRG; PAM sequence: TAG
atgtttttcctttagttttt

SEQ ID NO: 78716 - DNA, 20 bp, Artificial Sequence
  Description of Artificial Sequence: Synthetic oligonucleotide
  Target: ATXN1; (-) strand; PAM type: NRG; PAM sequence: TAG
catgcacaatgtttttcctt

SEQ ID NO: 78717 - DNA, 20 bp, Artificial Sequence
  Description of Artificial Sequence: Synthetic oligonucleotide
  Target: ATXN1; (-) strand; PAM type: NRG; PAM sequence: AAG
tatcaattcagagagaatgg

SEQ ID NO: 78718 - DNA, 20 bp, Artificial Sequence
  Description of Artificial Sequence: Synthetic oligonucleotide
  Target: ATXN1; (-) strand; PAM type: NRG; PAM sequence: TGG
agatatcaattcagagagaa

SEQ ID NO: 78719 - DNA, 20 bp, Artificial Sequence
  Description of Artificial Sequence: Synthetic oligonucleotide
  Target: ATXN1; (-) strand; PAM type: NRG; PAM sequence: GAG
agattagatatcaattcaga

SEQ ID NO: 78720 - DNA, 20 bp, Artificial Sequence
  Description of Artificial Sequence: Synthetic oligonucleotide
  Target: ATXN1; (-) strand; PAM type: NRG; PAM sequence: GAG
atagattagatatcaattca

SEQ ID NO: 78721 - DNA, 20 bp, Artificial Sequence
  Description of Artificial Sequence: Synthetic oligonucleotide
  Target: ATXN1; (-) strand; PAM type: NRG; PAM sequence: CAG
taatagattagatatcaatt

SEQ ID NO: 78722 - DNA, 20 bp, Artificial Sequence
  Description of Artificial Sequence: Synthetic oligonucleotide
  Target: ATXN1; (-) strand; PAM type: NRG; PAM sequence: TAG
taaaatttaatttaatagat

SEQ ID NO: 78723 - DNA, 20 bp, Artificial Sequence
  Description of Artificial Sequence: Synthetic oligonucleotide
  Target: ATXN1; (-) strand; PAM type: NRG; PAM sequence: TAG
caaaataaaatttaatttaa

SEQ ID NO: 78724 - DNA, 20 bp, Artificial Sequence
  Description of Artificial Sequence: Synthetic oligonucleotide
  Target: ATXN1; (-) strand; PAM type: NRG; PAM sequence: CAG
tgtacatagactaatttagt

SEQ ID NO: 78725 - DNA, 20 bp, Artificial Sequence
  Description of Artificial Sequence: Synthetic oligonucleotide
  Target: ATXN1; (-) strand; PAM type: NRG; PAM sequence: TAG
catgtgtacatagactaatt

SEQ ID NO: 78726 - DNA, 20 bp, Artificial Sequence
  Description of Artificial Sequence: Synthetic oligonucleotide
  Target: ATXN1; (-) strand; PAM type: NRG; PAM sequence: TAG
tttattctttcatgtgtaca

SEQ ID NO: 78727 - DNA, 20 bp, Artificial Sequence
  Description of Artificial Sequence: Synthetic oligonucleotide
  Target: ATXN1; (-) strand; PAM type: NRG; PAM sequence: TAG
cagcatttattagctatttt

SEQ ID NO: 78728 - DNA, 20 bp, Artificial Sequence
  Description of Artificial Sequence: Synthetic oligonucleotide
  Target: ATXN1; (-) strand; PAM type: NRG; PAM sequence: TAG
tattttttttcagcatttat

SEQ ID NO: 78729 - DNA, 20 bp, Artificial Sequence
  Description of Artificial Sequence: Synthetic oligonucleotide
  Target: ATXN1; (-) strand; PAM type: NRG; PAM sequence: CAG
ttctttcatatatttttttt

SEQ ID NO: 78730 - DNA, 20 bp, Artificial Sequence
  Description of Artificial Sequence: Synthetic oligonucleotide
  Target: ATXN1; (-) strand; PAM type: NRG; PAM sequence: TAG
ttagaagattttaatataat

SEQ ID NO: 78731 - DNA, 20 bp, Artificial Sequence
  Description of Artificial Sequence: Synthetic oligonucleotide
  Target: ATXN1; (-) strand; PAM type: NRG; PAM sequence: AAG
ttttgattctatgagtttag

SEQ ID NO: 78732 - DNA, 20 bp, Artificial Sequence
  Description of Artificial Sequence: Synthetic oligonucleotide
  Target: ATXN1; (-) strand; PAM type: NRG; PAM sequence: TAG
tgcttttgattctatgagtt

SEQ ID NO: 78733 - DNA, 20 bp, Artificial Sequence
  Description of Artificial Sequence: Synthetic oligonucleotide
  Target: ATXN1; (-) strand; PAM type: NRG; PAM sequence: GAG
tattttgcttttgattctat

SEQ ID NO: 78734 - DNA, 20 bp, Artificial Sequence
  Description of Artificial Sequence: Synthetic oligonucleotide
  Target: ATXN1; (-) strand; PAM type: NRG; PAM sequence: AAG
acctcgtgatccgcatttct

SEQ ID NO: 78735 - DNA, 20 bp, Artificial Sequence
  Description of Artificial Sequence: Synthetic oligonucleotide
  Target: ATXN1; (-) strand; PAM type: NRG; PAM sequence: TGG
tttcactgtgttagccagga

SEQ ID NO: 78736 - DNA, 20 bp, Artificial Sequence
  Description of Artificial Sequence: Synthetic oligonucleotide
  Target: ATXN1; (-) strand; PAM type: NRG; PAM sequence: AGG
ggggtttcactgtgttagcc

SEQ ID NO: 78737 - DNA, 20 bp, Artificial Sequence
  Description of Artificial Sequence: Synthetic oligonucleotide
  Target: ATXN1; (-) strand; PAM type: NRG; PAM sequence: CAG
cggggtttcactgtgttagc

SEQ ID NO: 78738 - DNA, 20 bp, Artificial Sequence
  Description of Artificial Sequence: Synthetic oligonucleotide
  Target: ATXN1; (-) strand; PAM type: NRG; PAM sequence: TAG
gagacggggtttcactgtgt

SEQ ID NO: 78739 - DNA, 20 bp, Artificial Sequence
  Description of Artificial Sequence: Synthetic oligonucleotide
  Target: ATXN1; (-) strand; PAM type: NRG; PAM sequence: GGG
gtgtgtttttagtagagacg

SEQ ID NO: 78740 - DNA, 20 bp, Artificial Sequence
  Description of Artificial Sequence: Synthetic oligonucleotide
  Target: ATXN1; (-) strand; PAM type: NRG; PAM sequence: GGG
tgtgtgtttttagtagagac

SEQ ID NO: 78741 - DNA, 20 bp, Artificial Sequence
  Description of Artificial Sequence: Synthetic oligonucleotide
  Target: ATXN1; (-) strand; PAM type: NRG; PAM sequence: CGG
gtgtgtgtttttagtagaga

SEQ ID NO: 78742 - DNA, 20 bp, Artificial Sequence
  Description of Artificial Sequence: Synthetic oligonucleotide
  Target: ATXN1; (-) strand; PAM type: NRG; PAM sequence: GAG
ttttgtgtgtgtttttagta

SEQ ID NO: 78743 - DNA, 20 bp, Artificial Sequence
  Description of Artificial Sequence: Synthetic oligonucleotide
  Target: ATXN1; (-) strand; PAM type: NRG; PAM sequence: TAG
atttttgtgtgtgtttttag

SEQ ID NO: 78744 - DNA, 20 bp, Artificial Sequence
  Description of Artificial Sequence: Synthetic oligonucleotide
  Target: ATXN1; (-) strand; PAM type: NRG; PAM sequence: TAG
ctaatttttgtgtgtgtttt

SEQ ID NO: 78745 - DNA, 20 bp, Artificial Sequence
  Description of Artificial Sequence: Synthetic oligonucleotide
  Target: ATXN1; (-) strand; PAM type: NRG; PAM sequence: CGG
caggcgcccgccaccacgcc

SEQ ID NO: 78746 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggactgc

SEQ ID NO: 78747 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggactg

SEQ ID NO: 78748 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtagct

SEQ ID NO: 78749 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 78750 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 78751 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 78752 - DNA, 20 bp, Artificial Sequence
  Description of Artificial Sequence: Synthetic oligonucleotide
  Target: ATXN1; (-) strand; PAM type: NRG; PAM sequence: CAG
ttcaggccattctcctgcct

SEQ ID NO: 78753 - DNA, 20 bp, Artificial Sequence
  Description of Artificial Sequence: Synthetic oligonucleotide
  Target: ATXN1; (-) strand; PAM type: NRG; PAM sequence: AGG
aagctccgcctcacgggttc

SEQ ID NO: 78754 - DNA, 20 bp, Artificial Sequence
  Description of Artificial Sequence: Synthetic oligonucleotide
  Target: ATXN1; (-) strand; PAM type: NRG; PAM sequence: CAG
caagctccgcctcacgggtt

SEQ ID NO: 78755 - DNA, 20 bp, Artificial Sequence
  Description of Artificial Sequence: Synthetic oligonucleotide
  Target: ATXN1; (-) strand; PAM type: NRG; PAM sequence: GGG
cactgcaagctccgcctcac

SEQ ID NO: 78756 - DNA, 20 bp, Artificial Sequence
  Description of Artificial Sequence: Synthetic oligonucleotide
  Target: ATXN1; (-) strand; PAM type: NRG; PAM sequence: CGG
tcactgcaagctccgcctca

SEQ ID NO: 78757 - DNA, 20 bp, Artificial Sequence
  Description of Artificial Sequence: Synthetic oligonucleotide
  Target: ATXN1; (-) strand; PAM type: NRG; PAM sequence: AAG
gcgtgatctcggctcactgc

SEQ ID NO: 78758 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagcggcgtgatct

SEQ ID NO: 78759 - DNA, 20 bp, Artificial Sequence
  Description of Artificial Sequence: Synthetic oligonucleotide
  Target: ATXN1; (-) strand; PAM type: NRG; PAM sequence: CGG
ttgcccaggcaggagtgcag

SEQ ID NO: 78760 - DNA, 20 bp, Artificial Sequence
  Description of Artificial Sequence: Synthetic oligonucleotide
  Target: ATXN1; (-) strand; PAM type: NRG; PAM sequence: CAG
ctattgcccaggcaggagtg

SEQ ID NO: 78761 - DNA, 20 bp, Artificial Sequence
  Description of Artificial Sequence: Synthetic oligonucleotide
  Target: ATXN1; (-) strand; PAM type: NRG; PAM sequence: GAG
tctctctattgcccaggcag

SEQ ID NO: 78762 - DNA, 20 bp, Artificial Sequence
  Description of Artificial Sequence: Synthetic oligonucleotide
  Target: ATXN1; (-) strand; PAM type: NRG; PAM sequence: AGG
tttctctctattgcccaggc

SEQ ID NO: 78763 - DNA, 20 bp, Artificial Sequence
  Description of Artificial Sequence: Synthetic oligonucleotide
  Target: ATXN1; (-) strand; PAM type: NRG; PAM sequence: CAG
gtttctctctattgcccagg

SEQ ID NO: 78764 - DNA, 20 bp, Artificial Sequence
  Description of Artificial Sequence: Synthetic oligonucleotide
  Target: ATXN1; (-) strand; PAM type: NRG; PAM sequence: AGG
agagtttctctctattgccc

SEQ ID NO: 78765 - DNA, 20 bp, Artificial Sequence
  Description of Artificial Sequence: Synthetic oligonucleotide
  Target: ATXN1; (-) strand; PAM type: NRG; PAM sequence: CAG
cagagtttctctctattgcc

SEQ ID NO: 78766 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 78767 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaga

SEQ ID NO: 78768 - DNA, 20 bp, Artificial Sequence
  Description of Artificial Sequence: Synthetic oligonucleotide
  Target: ATXN1; (-) strand; PAM type: NRG; PAM sequence: GAG
tttctttttttttttttttt

SEQ ID NO: 78769 - DNA, 20 bp, Artificial Sequence
  Description of Artificial Sequence: Synthetic oligonucleotide
  Target: ATXN1; (-) strand; PAM type: NRG; PAM sequence: GAG
ctaaatgtttttagaaacat

SEQ ID NO: 78770 - DNA, 20 bp, Artificial Sequence
  Description of Artificial Sequence: Synthetic oligonucleotide
  Target: ATXN1; (-) strand; PAM type: NRG; PAM sequence: TAG
taataaaaactaaatgtttt

SEQ ID NO: 78771 - DNA, 20 bp, Artificial Sequence
  Description of Artificial Sequence: Synthetic oligonucleotide
  Target: ATXN1; (-) strand; PAM type: NRG; PAM sequence: AAG
gaggagacatcatctttatt

SEQ ID NO: 78772 - DNA, 20 bp, Artificial Sequence
  Description of Artificial Sequence: Synthetic oligonucleotide
  Target: ATXN1; (-) strand; PAM type: NRG; PAM sequence: GAG
gtcttttgccccactgagag

SEQ ID NO: 78773 - DNA, 20 bp, Artificial Sequence
  Description of Artificial Sequence: Synthetic oligonucleotide
  Target: ATXN1; (-) strand; PAM type: NRG; PAM sequence: AGG
tagtcttttgccccactgag

SEQ ID NO: 78774 - DNA, 20 bp, Artificial Sequence
  Description of Artificial Sequence: Synthetic oligonucleotide
  Target: ATXN1; (-) strand; PAM type: NRG; PAM sequence: GAG
ttagtcttttgccccactga

SEQ ID NO: 78775 - DNA, 20 bp, Artificial Sequence
  Description of Artificial Sequence: Synthetic oligonucleotide
  Target: ATXN1; (-) strand; PAM type: NRG; PAM sequence: GAG
tattagtcttttgccccact

SEQ ID NO: 78776 - DNA, 20 bp, Artificial Sequence
  Description of Artificial Sequence: Synthetic oligonucleotide
  Target: ATXN1; (-) strand; PAM type: NRG; PAM sequence: TAG
ttctcacattatgtatttat

SEQ ID NO: 78777 - DNA, 20 bp, Artificial Sequence
  Description of Artificial Sequence: Synthetic oligonucleotide
  Target: ATXN1; (-) strand; PAM type: NRG; PAM sequence: CAG
acttttgtcaaatattagat

SEQ ID NO: 78778 - DNA, 20 bp, Artificial Sequence
  Description of Artificial Sequence: Synthetic oligonucleotide
  Target: ATXN1; (-) strand; PAM type: NRG; PAM sequence: TAG
aatgaacttttgtcaaatat

SEQ ID NO: 78779 - DNA, 20 bp, Artificial Sequence
  Description of Artificial Sequence: Synthetic oligonucleotide
  Target: ATXN1; (-) strand; PAM type: NRG; PAM sequence: AGG
gatgtgcgatcttagacatg

SEQ ID NO: 78780 - DNA, 20 bp, Artificial Sequence
  Description of Artificial Sequence: Synthetic oligonucleotide
  Target: ATXN1; (-) strand; PAM type: NRG; PAM sequence: GAG
tgatgtgcgatcttagacat

SEQ ID NO: 78781 - DNA, 20 bp, Artificial Sequence
  Description of Artificial Sequence: Synthetic oligonucleotide
  Target: ATXN1; (-) strand; PAM type: NRG; PAM sequence: TAG
tttattttgatgtgcgatct

SEQ ID NO: 78782 - DNA, 20 bp, Artificial Sequence
  Description of Artificial Sequence: Synthetic oligonucleotide
  Target: ATXN1; (-) strand; PAM type: NRG; PAM sequence: TAG
tgtagttctttattatctca

SEQ ID NO: 78783 - DNA, 20 bp, Artificial Sequence
  Description of Artificial Sequence: Synthetic oligonucleotide
  Target: ATXN1; (-) strand; PAM type: NRG; PAM sequence: TAG
tatttacccacaatttattg

SEQ ID NO: 78784 - DNA, 20 bp, Artificial Sequence
  Description of Artificial Sequence: Synthetic oligonucleotide
  Target: ATXN1; (-) strand; PAM type: NRG; PAM sequence: CAG
agccttccattcactagggt

SEQ ID NO: 78785 - DNA, 20 bp, Artificial Sequence
  Description of Artificial Sequence: Synthetic oligonucleotide
  Target: ATXN1; (-) strand; PAM type: NRG; PAM sequence: GGG
gaaaagccttccattcacta

SEQ ID NO: 78786 - DNA, 20 bp, Artificial Sequence
  Description of Artificial Sequence: Synthetic oligonucleotide
  Target: ATXN1; (-) strand; PAM type: NRG; PAM sequence: AGG
agaaaagccttccattcact

SEQ ID NO: 78787 - DNA, 20 bp, Artificial Sequence
  Description of Artificial Sequence: Synthetic oligonucleotide
  Target: ATXN1; (-) strand; PAM type: NRG; PAM sequence: TAG
tagaaaagccttccattcac

SEQ ID NO: 78788 - DNA, 20 bp, Artificial Sequence
  Description of Artificial Sequence: Synthetic oligonucleotide
  Target: ATXN1; (-) strand; PAM type: NRG; PAM sequence: AAG
ttttgcttttatacctagaa

SEQ ID NO: 78789 - DNA, 20 bp, Artificial Sequence
  Description of Artificial Sequence: Synthetic oligonucleotide
  Target: ATXN1; (-) strand; PAM type: NRG; PAM sequence: TAG
tttttttttgcttttatacc

SEQ ID NO: 78790 - DNA, 20 bp, Artificial Sequence
  Description of Artificial Sequence: Synthetic oligonucleotide
  Target: ATXN1; (-) strand; PAM type: NRG; PAM sequence: TGG
catgatctcattctttttta

SEQ ID NO: 78791 - DNA, 20 bp, Artificial Sequence
  Description of Artificial Sequence: Synthetic oligonucleotide
  Target: ATXN1; (-) strand; PAM type: NRG; PAM sequence: AGG
cttcatccatgtccctgtaa

SEQ ID NO: 78792 - DNA, 20 bp, Artificial Sequence
  Description of Artificial Sequence: Synthetic oligonucleotide
  Target: ATXN1; (-) strand; PAM type: NRG; PAM sequence: AAG
gcttcatccatgtccctgta

SEQ ID NO: 78793 - DNA, 20 bp, Artificial Sequence
  Description of Artificial Sequence: Synthetic oligonucleotide
  Target: ATXN1; (-) strand; PAM type: NRG; PAM sequence: CAG
ttgctgagaatgatggtttc

SEQ ID NO: 78794 - DNA, 20 bp, Artificial Sequence
  Description of Artificial Sequence: Synthetic oligonucleotide
  Target: ATXN1; (-) strand; PAM type: NRG; PAM sequence: TGG
ggttagtttgctgagaatga

SEQ ID NO: 78795 - DNA, 20 bp, Artificial Sequence
  Description of Artificial Sequence: Synthetic oligonucleotide
  Target: ATXN1; (-) strand; PAM type: NRG; PAM sequence: GAG
tgttcctgggttagtttgct

SEQ ID NO: 78796 - DNA, 20 bp, Artificial Sequence
  Description of Artificial Sequence: Synthetic oligonucleotide
  Target: ATXN1; (-) strand; PAM type: NRG; PAM sequence: TAG
ttggttttctgttcctgggt

SEQ ID NO: 78797 - DNA, 20 bp, Artificial Sequence
  Description of Artificial Sequence: Synthetic oligonucleotide
  Target: ATXN1; (-) strand; PAM type: NRG; PAM sequence: GGG
gtgtttggttttctgttcct

SEQ ID NO: 78798 - DNA, 20 bp, Artificial Sequence
  Description of Artificial Sequence: Synthetic oligonucleotide
  Target: ATXN1; (-) strand; PAM type: NRG; PAM sequence: TGG
ggtgtttggttttctgttcc

SEQ ID NO: 78799 - DNA, 20 bp, Artificial Sequence
  Description of Artificial Sequence: Synthetic oligonucleotide
  Target: ATXN1; (-) strand; PAM type: NRG; PAM sequence: TGG
gagtgagaacatgcggtgtt

SEQ ID NO: 78800 - DNA, 20 bp, Artificial Sequence
  Description of Artificial Sequence: Synthetic oligonucleotide
  Target: ATXN1; (-) strand; PAM type: NRG; PAM sequence: CGG
cacttatgagtgagaacatg

SEQ ID NO: 78801 - DNA, 20 bp, Artificial Sequence
  Description of Artificial Sequence: Synthetic oligonucleotide
  Target: ATXN1; (-) strand; PAM type: NRG; PAM sequence: GAG
ttaaactcccacttatgagt

SEQ ID NO: 78802 - DNA, 20 bp, Artificial Sequence
  Description of Artificial Sequence: Synthetic oligonucleotide
  Target: ATXN1; (-) strand; PAM type: NRG; PAM sequence: GAG
aatgttaaactcccacttat

SEQ ID NO: 78803 - DNA, 20 bp, Artificial Sequence
  Description of Artificial Sequence: Synthetic oligonucleotide
  Target: ATXN1; (-) strand; PAM type: NRG; PAM sequence: CGG
tccctccctccgacaggccc

SEQ ID NO: 78804 - DNA, 20 bp, Artificial Sequence
  Description of Artificial Sequence: Synthetic oligonucleotide
  Target: ATXN1; (-) strand; PAM type: NRG; PAM sequence: AGG
cccttgtccctccctccgac

SEQ ID NO: 78805 - DNA, 20 bp, Artificial Sequence
  Description of Artificial Sequence: Synthetic oligonucleotide
  Target: ATXN1; (-) strand; PAM type: NRG; PAM sequence: CAG
ccccttgtccctccctccga

SEQ ID NO: 78806 - DNA, 20 bp, Artificial Sequence
  Description of Artificial Sequence: Synthetic oligonucleotide
  Target: ATXN1; (-) strand; PAM type: NRG; PAM sequence: CGG
ttttaagccctgcatgcatt

SEQ ID NO: 78807 - DNA, 20 bp, Artificial Sequence
  Description of Artificial Sequence: Synthetic oligonucleotide
  Target: ATXN1; (-) strand; PAM type: NRG; PAM sequence: AAG
caacctgtcatctaggtttt

SEQ ID NO: 78808 - DNA, 20 bp, Artificial Sequence
  Description of Artificial Sequence: Synthetic oligonucleotide
  Target: ATXN1; (-) strand; PAM type: NRG; PAM sequence: AGG
tacctatcaacctgtcatct

SEQ ID NO: 78809 - DNA, 20 bp, Artificial Sequence
  Description of Artificial Sequence: Synthetic oligonucleotide
  Target: ATXN1; (-) strand; PAM type: NRG; PAM sequence: TAG
gtacctatcaacctgtcatc

SEQ ID NO: 78810 - DNA, 20 bp, Artificial Sequence
  Description of Artificial Sequence: Synthetic oligonucleotide
  Target: ATXN1; (-) strand; PAM type: NRG; PAM sequence: TGG
taggtatacatgtgccatag

SEQ ID NO: 78811 - DNA, 20 bp, Artificial Sequence
  Description of Artificial Sequence: Synthetic oligonucleotide
  Target: ATXN1; (-) strand; PAM type: NRG; PAM sequence: TAG
acataggtatacatgtgcca

SEQ ID NO: 78812 - DNA, 20 bp, Artificial Sequence
  Description of Artificial Sequence: Synthetic oligonucleotide
  Target: ATXN1; (-) strand; PAM type: NRG; PAM sequence: AGG
aacttgcaggtttgttacat

SEQ ID NO: 78813 - DNA, 20 bp, Artificial Sequence
  Description of Artificial Sequence: Synthetic oligonucleotide
  Target: ATXN1; (-) strand; PAM type: NRG; PAM sequence: TAG
gaacttgcaggtttgttaca

SEQ ID NO: 78814 - DNA, 20 bp, Artificial Sequence
  Description of Artificial Sequence: Synthetic oligonucleotide
  Target: ATXN1; (-) strand; PAM type: NRG; PAM sequence: AGG
gatacacgtgcagaacttgc

SEQ ID NO: 78815 - DNA, 20 bp, Artificial Sequence
  Description of Artificial Sequence: Synthetic oligonucleotide
  Target: ATXN1; (-) strand; PAM type: NRG; PAM sequence: CAG
ggatacacgtgcagaacttg

SEQ ID NO: 78816 - DNA, 20 bp, Artificial Sequence
  Description of Artificial Sequence: Synthetic oligonucleotide
  Target: ATXN1; (-) strand; PAM type: NRG; PAM sequence: CAG
taagttctgggatacacgtg

SEQ ID NO: 78817 - DNA, 20 bp, Artificial Sequence
  Description of Artificial Sequence: Synthetic oligonucleotide
  Target: ATXN1; (-) strand; PAM type: NRG; PAM sequence: GGG
tttgttttactttaagttct

SEQ ID NO: 78818 - DNA, 20 bp, Artificial Sequence
  Description of Artificial Sequence: Synthetic oligonucleotide
  Target: ATXN1; (-) strand; PAM type: NRG; PAM sequence: TGG
gtttgttttactttaagttc

SEQ ID NO: 78819 - DNA, 20 bp, Artificial Sequence
  Description of Artificial Sequence: Synthetic oligonucleotide
  Target: ATXN1; (-) strand; PAM type: NRG; PAM sequence: AAG
tgttttgtttgttttacttt

SEQ ID NO: 78820 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 78821 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 78822 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 78823 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 78824 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 78825 - DNA, 20 bp, Artificial Sequence
  Description of Artificial Sequence: Synthetic oligonucleotide
  Target: ATXN1; (-) strand; PAM type: NRG; PAM sequence: AAG
ccatctgcctcggcctccca

SEQ ID NO: 78826 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatccatctgcct

SEQ ID NO: 78827 - DNA, 20 bp, Artificial Sequence
  Description of Artificial Sequence: Synthetic oligonucleotide
  Target: ATXN1; (-) strand; PAM type: NRG; PAM sequence: AGG
ggtcacgaactcgtgacctc

SEQ ID NO: 78828 - DNA, 20 bp, Artificial Sequence
  Description of Artificial Sequence: Synthetic oligonucleotide
  Target: ATXN1; (-) strand; PAM type: NRG; PAM sequence: CAG
tggtcacgaactcgtgacct

SEQ ID NO: 78829 - DNA, 20 bp, Artificial Sequence
  Description of Artificial Sequence: Synthetic oligonucleotide
  Target: ATXN1; (-) strand; PAM type: NRG; PAM sequence: TGG
tttcgccatgttggccaggc

SEQ ID NO: 78830 - DNA, 20 bp, Artificial Sequence
  Description of Artificial Sequence: Synthetic oligonucleotide
  Target: ATXN1; (-) strand; PAM type: NRG; PAM sequence: AGG
ggggtttcgccatgttggcc

SEQ ID NO: 78831 - DNA, 20 bp, Artificial Sequence
  Description of Artificial Sequence: Synthetic oligonucleotide
  Target: ATXN1; (-) strand; PAM type: NRG; PAM sequence: CAG
tggggtttcgccatgttggc

SEQ ID NO: 78832 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcgccatgt

SEQ ID NO: 78833 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 78834 - DNA, 20 bp, Artificial Sequence
  Description of Artificial Sequence: Synthetic oligonucleotide
  Target: ATXN1; (-) strand; PAM type: NRG; PAM sequence: GGG
cttgtatttttagtagagat

SEQ ID NO: 78835 - DNA, 20 bp, Artificial Sequence
  Description of Artificial Sequence: Synthetic oligonucleotide
  Target: ATXN1; (-) strand; PAM type: NRG; PAM sequence: TGG
tcttgtatttttagtagaga

SEQ ID NO: 78836 - DNA, 20 bp, Artificial Sequence
  Description of Artificial Sequence: Synthetic oligonucleotide
  Target: ATXN1; (-) strand; PAM type: NRG; PAM sequence: GAG
aatttcttgtatttttagta

SEQ ID NO: 78837 - DNA, 20 bp, Artificial Sequence
  Description of Artificial Sequence: Synthetic oligonucleotide
  Target: ATXN1; (-) strand; PAM type: NRG; PAM sequence: TAG
ctaatttcttgtatttttag

SEQ ID NO: 78838 - DNA, 20 bp, Artificial Sequence
  Description of Artificial Sequence: Synthetic oligonucleotide
  Target: ATXN1; (-) strand; PAM type: NRG; PAM sequence: TAG
cagctaatttcttgtatttt

SEQ ID NO: 78839 - DNA, 20 bp, Artificial Sequence
  Description of Artificial Sequence: Synthetic oligonucleotide
  Target: ATXN1; (-) strand; PAM type: NRG; PAM sequence: CAG
caggtgtgtaccaccacgtc

SEQ ID NO: 78840 - DNA, 20 bp, Artificial Sequence
  Description of Artificial Sequence: Synthetic oligonucleotide
  Target: ATXN1; (-) strand; PAM type: NRG; PAM sequence: AGG
tgcttcagcctccagactac

SEQ ID NO: 78841 - DNA, 20 bp, Artificial Sequence
  Description of Artificial Sequence: Synthetic oligonucleotide
  Target: ATXN1; (-) strand; PAM type: NRG; PAM sequence: CAG
ctgcttcagcctccagacta

SEQ ID NO: 78842 - DNA, 20 bp, Artificial Sequence
  Description of Artificial Sequence: Synthetic oligonucleotide
  Target: ATXN1; (-) strand; PAM type: NRG; PAM sequence: CAG
gattctcctgcttcagcctc

SEQ ID NO: 78843 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgctt

SEQ ID NO: 78844 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccgggttc

SEQ ID NO: 78845 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccgcctccc

SEQ ID NO: 78846 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctccgcctcc

SEQ ID NO: 78847 - DNA, 20 bp, Artificial Sequence
  Description of Artificial Sequence: Synthetic oligonucleotide
  Target: ATXN1; (-) strand; PAM type: NRG; PAM sequence: TGG
gcagtgcagtggcacgatct

SEQ ID NO: 78848 - DNA, 20 bp, Artificial Sequence
  Description of Artificial Sequence: Synthetic oligonucleotide
  Target: ATXN1; (-) strand; PAM type: NRG; PAM sequence: TGG
ccacccaggctgcagtgcag

SEQ ID NO: 78849 - DNA, 20 bp, Artificial Sequence
  Description of Artificial Sequence: Synthetic oligonucleotide
  Target: ATXN1; (-) strand; PAM type: NRG; PAM sequence: CAG
ctgccacccaggctgcagtg

SEQ ID NO: 78850 - DNA, 20 bp, Artificial Sequence
  Description of Artificial Sequence: Synthetic oligonucleotide
  Target: ATXN1; (-) strand; PAM type: NRG; PAM sequence: CAG
tcgctctgccacccaggctg

SEQ ID NO: 78851 - DNA, 20 bp, Artificial Sequence
  Description of Artificial Sequence: Synthetic oligonucleotide
  Target: ATXN1; (-) strand; PAM type: NRG; PAM sequence: AGG
ggagtctcgctctgccaccc

SEQ ID NO: 78852 - DNA, 20 bp, Artificial Sequence
  Description of Artificial Sequence: Synthetic oligonucleotide
  Target: ATXN1; (-) strand; PAM type: NRG; PAM sequence: CAG
cggagtctcgctctgccacc

SEQ ID NO: 78853 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagacg

SEQ ID NO: 78854 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttttgaga

SEQ ID NO: 78855 - DNA, 20 bp, Artificial Sequence
  Description of Artificial Sequence: Synthetic oligonucleotide
  Target: ATXN1; (-) strand; PAM type: NRG; PAM sequence: GAG
tccttttttttttttttttt

SEQ ID NO: 78856 - DNA, 20 bp, Artificial Sequence
  Description of Artificial Sequence: Synthetic oligonucleotide
  Target: ATXN1; (-) strand; PAM type: NRG; PAM sequence: CAG
tttgctttttttttttccca

SEQ ID NO: 78857 - DNA, 20 bp, Artificial Sequence
  Description of Artificial Sequence: Synthetic oligonucleotide
  Target: ATXN1; (-) strand; PAM type: NRG; PAM sequence: AAG
gcatattaataattttcaaa

SEQ ID NO: 78858 - DNA, 20 bp, Artificial Sequence
  Description of Artificial Sequence: Synthetic oligonucleotide
  Target: ATXN1; (-) strand; PAM type: NRG; PAM sequence: AAG
atcaaaatatctgtgtagtc

SEQ ID NO: 78859 - DNA, 20 bp, Artificial Sequence
  Description of Artificial Sequence: Synthetic oligonucleotide
  Target: ATXN1; (-) strand; PAM type: NRG; PAM sequence: TAG
acaaaatcaaaatatctgtg

SEQ ID NO: 78860 - DNA, 20 bp, Artificial Sequence
  Description of Artificial Sequence: Synthetic oligonucleotide
  Target: ATXN1; (-) strand; PAM type: NRG; PAM sequence: TGG
aactctttgtttaatggtat

SEQ ID NO: 78861 - DNA, 20 bp, Artificial Sequence
  Description of Artificial Sequence: Synthetic oligonucleotide
  Target: ATXN1; (-) strand; PAM type: NRG; PAM sequence: TGG
gatattaactctttgtttaa

SEQ ID NO: 78862 - DNA, 20 bp, Artificial Sequence
  Description of Artificial Sequence: Synthetic oligonucleotide
  Target: ATXN1; (-) strand; PAM type: NRG; PAM sequence: AGG
catgtatttattttgtatta

SEQ ID NO: 78863 - DNA, 20 bp, Artificial Sequence
  Description of Artificial Sequence: Synthetic oligonucleotide
  Target: ATXN1; (-) strand; PAM type: NRG; PAM sequence: AAG
acatgtatttattttgtatt

SEQ ID NO: 78864 - DNA, 20 bp, Artificial Sequence
  Description of Artificial Sequence: Synthetic oligonucleotide
  Target: ATXN1; (-) strand; PAM type: NRG; PAM sequence: AAG
ttgcttatttttgtcttaga

SEQ ID NO: 78865 - DNA, 20 bp, Artificial Sequence
  Description of Artificial Sequence: Synthetic oligonucleotide
  Target: ATXN1; (-) strand; PAM type: NRG; PAM sequence: TAG
ttcattgcttatttttgtct

SEQ ID NO: 78866 - DNA, 20 bp, Artificial Sequence
  Description of Artificial Sequence: Synthetic oligonucleotide
  Target: ATXN1; (-) strand; PAM type: NRG; PAM sequence: TGG
tttacatttcttttttaaat

SEQ ID NO: 78867 - DNA, 20 bp, Artificial Sequence
  Description of Artificial Sequence: Synthetic oligonucleotide
  Target: ATXN1; (-) strand; PAM type: NRG; PAM sequence: TGG
agtgtagtttcaagtgaggg

SEQ ID NO: 78868 - DNA, 20 bp, Artificial Sequence
  Description of Artificial Sequence: Synthetic oligonucleotide
  Target: ATXN1; (-) strand; PAM type: NRG; PAM sequence: GGG
tttagtgtagtttcaagtga

SEQ ID NO: 78869 - DNA, 20 bp, Artificial Sequence
  Description of Artificial Sequence: Synthetic oligonucleotide
  Target: ATXN1; (-) strand; PAM type: NRG; PAM sequence: AGG
ttttagtgtagtttcaagtg

SEQ ID NO: 78870 - DNA, 20 bp, Artificial Sequence
  Description of Artificial Sequence: Synthetic oligonucleotide
  Target: ATXN1; (-) strand; PAM type: NRG; PAM sequence: GAG
tttttagtgtagtttcaagt

SEQ ID NO: 78871 - DNA, 20 bp, Artificial Sequence
  Description of Artificial Sequence: Synthetic oligonucleotide
  Target: ATXN1; (-) strand; PAM type: NRG; PAM sequence: AAG
gctttttttagtgtagtttc

SEQ ID NO: 78872 - DNA, 20 bp, Artificial Sequence
  Description of Artificial Sequence: Synthetic oligonucleotide
  Target: ATXN1; (-) strand; PAM type: NRG; PAM sequence: TAG
ttaatttgctttttttagtg

SEQ ID NO: 78873 - DNA, 20 bp, Artificial Sequence
  Description of Artificial Sequence: Synthetic oligonucleotide
  Target: ATXN1; (-) strand; PAM type: NRG; PAM sequence: TAG
ttgttttaatttgctttttt

SEQ ID NO: 78874 - DNA, 20 bp, Artificial Sequence
  Description of Artificial Sequence: Synthetic oligonucleotide
  Target: ATXN1; (-) strand; PAM type: NRG; PAM sequence: AAG
aaaaactctgccaatttgat

SEQ ID NO: 78875 - DNA, 20 bp, Artificial Sequence
  Description of Artificial Sequence: Synthetic oligonucleotide
  Target: ATXN1; (-) strand; PAM type: NRG; PAM sequence: AAG
agtactgtaattaaaaaaaa

SEQ ID NO: 78876 - DNA, 20 bp, Artificial Sequence
  Description of Artificial Sequence: Synthetic oligonucleotide
  Target: ATXN1; (-) strand; PAM type: NRG; PAM sequence: AAG
tctgcactctggacaacact

SEQ ID NO: 78877 - DNA, 20 bp, Artificial Sequence
  Description of Artificial Sequence: Synthetic oligonucleotide
  Target: ATXN1; (-) strand; PAM type: NRG; PAM sequence: TGG
acgttcatgtgtctgcactc

SEQ ID NO: 78878 - DNA, 20 bp, Artificial Sequence
  Description of Artificial Sequence: Synthetic oligonucleotide
  Target: ATXN1; (-) strand; PAM type: NRG; PAM sequence: AAG
agcacttgccaaccatgaca

SEQ ID NO: 78879 - DNA, 20 bp, Artificial Sequence
  Description of Artificial Sequence: Synthetic oligonucleotide
  Target: ATXN1; (-) strand; PAM type: NRG; PAM sequence: GAG
gttattaaattactcttctt

SEQ ID NO: 78880 - DNA, 20 bp, Artificial Sequence
  Description of Artificial Sequence: Synthetic oligonucleotide
  Target: ATXN1; (-) strand; PAM type: NRG; PAM sequence: AGG
aaatagtaaggccctttata

SEQ ID NO: 78881 - DNA, 20 bp, Artificial Sequence
  Description of Artificial Sequence: Synthetic oligonucleotide
  Target: ATXN1; (-) strand; PAM type: NRG; PAM sequence: AAG
caaatagtaaggccctttat

SEQ ID NO: 78882 - DNA, 20 bp, Artificial Sequence
  Description of Artificial Sequence: Synthetic oligonucleotide
  Target: ATXN1; (-) strand; PAM type: NRG; PAM sequence: AGG
agctggtggctcaaatagta

SEQ ID NO: 78883 - DNA, 20 bp, Artificial Sequence
  Description of Artificial Sequence: Synthetic oligonucleotide
  Target: ATXN1; (-) strand; PAM type: NRG; PAM sequence: AAG
gagctggtggctcaaatagt

SEQ ID NO: 78884 - DNA, 20 bp, Artificial Sequence
  Description of Artificial Sequence: Synthetic oligonucleotide
  Target: ATXN1; (-) strand; PAM type: NRG; PAM sequence: TAG
actagagctggtggctcaaa

SEQ ID NO: 78885 - DNA, 20 bp, Artificial Sequence
  Description of Artificial Sequence: Synthetic oligonucleotide
  Target: ATXN1; (-) strand; PAM type: NRG; PAM sequence: TGG
atttccagaactagagctgg

SEQ ID NO: 78886 - DNA, 20 bp, Artificial Sequence
  Description of Artificial Sequence: Synthetic oligonucleotide
  Target: ATXN1; (-) strand; PAM type: NRG; PAM sequence: TGG
taaatttccagaactagagc

SEQ ID NO: 78887 - DNA, 20 bp, Artificial Sequence
  Description of Artificial Sequence: Synthetic oligonucleotide
  Target: ATXN1; (-) strand; PAM type: NRG; PAM sequence: GAG
aggataaatttccagaacta

SEQ ID NO: 78888 - DNA, 20 bp, Artificial Sequence
  Description of Artificial Sequence: Synthetic oligonucleotide
  Target: ATXN1; (-) strand; PAM type: NRG; PAM sequence: TAG
ttaggataaatttccagaac

SEQ ID NO: 78889 - DNA, 20 bp, Artificial Sequence
  Description of Artificial Sequence: Synthetic oligonucleotide
  Target: ATXN1; (-) strand; PAM type: NRG; PAM sequence: CAG
gtttccttaggataaatttc

SEQ ID NO: 78890 - DNA, 20 bp, Artificial Sequence
  Description of Artificial Sequence: Synthetic oligonucleotide
  Target: ATXN1; (-) strand; PAM type: NRG; PAM sequence: AGG
acatctctggttgtttcctt

SEQ ID NO: 78891 - DNA, 20 bp, Artificial Sequence
  Description of Artificial Sequence: Synthetic oligonucleotide
  Target: ATXN1; (-) strand; PAM type: NRG; PAM sequence: TAG
aacatctctggttgtttcct

SEQ ID NO: 78892 - DNA, 20 bp, Artificial Sequence
  Description of Artificial Sequence: Synthetic oligonucleotide
  Target: ATXN1; (-) strand; PAM type: NRG; PAM sequence: TGG
atatcttttttcaacatctc

SEQ ID NO: 78893 - DNA, 20 bp, Artificial Sequence
  Description of Artificial Sequence: Synthetic oligonucleotide
  Target: ATXN1; (-) strand; PAM type: NRG; PAM sequence: TGG
atcgtttagtgatgctgtgc

SEQ ID NO: 78894 - DNA, 20 bp, Artificial Sequence
  Description of Artificial Sequence: Synthetic oligonucleotide
  Target: ATXN1; (-) strand; PAM type: NRG; PAM sequence: TAG
ccagatattgtgctatcgtt

SEQ ID NO: 78895 - DNA, 20 bp, Artificial Sequence
  Description of Artificial Sequence: Synthetic oligonucleotide
  Target: ATXN1; (-) strand; PAM type: NRG; PAM sequence: CAG
ttatctagcatttaattttc

SEQ ID NO: 78896 - DNA, 20 bp, Artificial Sequence
  Description of Artificial Sequence: Synthetic oligonucleotide
  Target: ATXN1; (-) strand; PAM type: NRG; PAM sequence: TAG
ccatccataatctatttatc

SEQ ID NO: 78897 - DNA, 20 bp, Artificial Sequence
  Description of Artificial Sequence: Synthetic oligonucleotide
  Target: ATXN1; (-) strand; PAM type: NRG; PAM sequence: TAG
cgtaagttttacatcactca

SEQ ID NO: 78898 - DNA, 20 bp, Artificial Sequence
  Description of Artificial Sequence: Synthetic oligonucleotide
  Target: ATXN1; (-) strand; PAM type: NRG; PAM sequence: AAG
gtgatcttagggcctatcgt

SEQ ID NO: 78899 - DNA, 20 bp, Artificial Sequence
  Description of Artificial Sequence: Synthetic oligonucleotide
  Target: ATXN1; (-) strand; PAM type: NRG; PAM sequence: GGG
gcccacacagtgtgatctta

SEQ ID NO: 78900 - DNA, 20 bp, Artificial Sequence
  Description of Artificial Sequence: Synthetic oligonucleotide
  Target: ATXN1; (-) strand; PAM type: NRG; PAM sequence: AGG
agcccacacagtgtgatctt

SEQ ID NO: 78901 - DNA, 20 bp, Artificial Sequence
  Description of Artificial Sequence: Synthetic oligonucleotide
  Target: ATXN1; (-) strand; PAM type: NRG; PAM sequence: TAG
aagcccacacagtgtgatct

SEQ ID NO: 78902 - DNA, 20 bp, Artificial Sequence
  Description of Artificial Sequence: Synthetic oligonucleotide
  Target: ATXN1; (-) strand; PAM type: NRG; PAM sequence: CAG
gtgtgattttcaagcccaca

SEQ ID NO: 78903 - DNA, 20 bp, Artificial Sequence
  Description of Artificial Sequence: Synthetic oligonucleotide
  Target: ATXN1; (-) strand; PAM type: NRG; PAM sequence: AAG
catgctgctgtgtgattttc

SEQ ID NO: 78904 - DNA, 20 bp, Artificial Sequence
  Description of Artificial Sequence: Synthetic oligonucleotide
  Target: ATXN1; (-) strand; PAM type: NRG; PAM sequence: GGG
agctgcctgatatttaccag

SEQ ID NO: 78905 - DNA, 20 bp, Artificial Sequence
  Description of Artificial Sequence: Synthetic oligonucleotide
  Target: ATXN1; (-) strand; PAM type: NRG; PAM sequence: GGG
tagctgcctgatatttacca

SEQ ID NO: 78906 - DNA, 20 bp, Artificial Sequence
  Description of Artificial Sequence: Synthetic oligonucleotide
  Target: ATXN1; (-) strand; PAM type: NRG; PAM sequence: AGG
ctagctgcctgatatttacc

SEQ ID NO: 78907 - DNA, 20 bp, Artificial Sequence
  Description of Artificial Sequence: Synthetic oligonucleotide
  Target: ATXN1; (-) strand; PAM type: NRG; PAM sequence: CAG
gctagctgcctgatatttac

SEQ ID NO: 78908 - DNA, 20 bp, Artificial Sequence
  Description of Artificial Sequence: Synthetic oligonucleotide
  Target: ATXN1; (-) strand; PAM type: NRG; PAM sequence: TAG
ctgatttactgtttgtgagc

SEQ ID NO: 78909 - DNA, 20 bp, Artificial Sequence
  Description of Artificial Sequence: Synthetic oligonucleotide
  Target: ATXN1; (-) strand; PAM type: NRG; PAM sequence: GAG
catgctgatttactgtttgt

SEQ ID NO: 78910 - DNA, 20 bp, Artificial Sequence
  Description of Artificial Sequence: Synthetic oligonucleotide
  Target: ATXN1; (-) strand; PAM type: NRG; PAM sequence: GGG
gtcatatagattttttaact

SEQ ID NO: 78911 - DNA, 20 bp, Artificial Sequence
  Description of Artificial Sequence: Synthetic oligonucleotide
  Target: ATXN1; (-) strand; PAM type: NRG; PAM sequence: TGG
agtcatatagattttttaac

SEQ ID NO: 78912 - DNA, 20 bp, Artificial Sequence
  Description of Artificial Sequence: Synthetic oligonucleotide
  Target: ATXN1; (-) strand; PAM type: NRG; PAM sequence: TAG
ttttagtgtctctagtcata

SEQ ID NO: 78913 - DNA, 20 bp, Artificial Sequence
  Description of Artificial Sequence: Synthetic oligonucleotide
  Target: ATXN1; (-) strand; PAM type: NRG; PAM sequence: TAG
atgaacatttttagtgtctc

SEQ ID NO: 78914 - DNA, 20 bp, Artificial Sequence
  Description of Artificial Sequence: Synthetic oligonucleotide
  Target: ATXN1; (-) strand; PAM type: NRG; PAM sequence: TAG
acgataaatatgaacatttt

SEQ ID NO: 78915 - DNA, 20 bp, Artificial Sequence
  Description of Artificial Sequence: Synthetic oligonucleotide
  Target: ATXN1; (-) strand; PAM type: NRG; PAM sequence: CAG
atacagaaaagaatgcagag

SEQ ID NO: 78916 - DNA, 20 bp, Artificial Sequence
  Description of Artificial Sequence: Synthetic oligonucleotide
  Target: ATXN1; (-) strand; PAM type: NRG; PAM sequence: GAG
gaaatacagaaaagaatgca

SEQ ID NO: 78917 - DNA, 20 bp, Artificial Sequence
  Description of Artificial Sequence: Synthetic oligonucleotide
  Target: ATXN1; (-) strand; PAM type: NRG; PAM sequence: CAG
tggaaatacagaaaagaatg

SEQ ID NO: 78918 - DNA, 20 bp, Artificial Sequence
  Description of Artificial Sequence: Synthetic oligonucleotide
  Target: ATXN1; (-) strand; PAM type: NRG; PAM sequence: AAG
gaaaaactggaaatacagaa

SEQ ID NO: 78919 - DNA, 20 bp, Artificial Sequence
  Description of Artificial Sequence: Synthetic oligonucleotide
  Target: ATXN1; (-) strand; PAM type: NRG; PAM sequence: CAG
atttagaaaaactggaaata

SEQ ID NO: 78920 - DNA, 20 bp, Artificial Sequence
  Description of Artificial Sequence: Synthetic oligonucleotide
  Target: ATXN1; (-) strand; PAM type: NRG; PAM sequence: TGG
atatattcatttagaaaaac

SEQ ID NO: 78921 - DNA, 20 bp, Artificial Sequence
  Description of Artificial Sequence: Synthetic oligonucleotide
  Target: ATXN1; (-) strand; PAM type: NRG; PAM sequence: TAG
aagggatgtatatattcatt

SEQ ID NO: 78922 - DNA, 20 bp, Artificial Sequence
  Description of Artificial Sequence: Synthetic oligonucleotide
  Target: ATXN1; (-) strand; PAM type: NRG; PAM sequence: GGG
ttgtttccctgatcacagaa

SEQ ID NO: 78923 - DNA, 20 bp, Artificial Sequence
  Description of Artificial Sequence: Synthetic oligonucleotide
  Target: ATXN1; (-) strand; PAM type: NRG; PAM sequence: AGG
attgtttccctgatcacaga

SEQ ID NO: 78924 - DNA, 20 bp, Artificial Sequence
  Description of Artificial Sequence: Synthetic oligonucleotide
  Target: ATXN1; (-) strand; PAM type: NRG; PAM sequence: AAG
tattgtttccctgatcacag

SEQ ID NO: 78925 - DNA, 20 bp, Artificial Sequence
  Description of Artificial Sequence: Synthetic oligonucleotide
  Target: ATXN1; (-) strand; PAM type: NRG; PAM sequence: CAG
gtttattgtttccctgatca

SEQ ID NO: 78926 - DNA, 20 bp, Artificial Sequence
  Description of Artificial Sequence: Synthetic oligonucleotide
  Target: ATXN1; (-) strand; PAM type: NRG; PAM sequence: CAG
tctgactccagggcatgccc

SEQ ID NO: 78927 - DNA, 20 bp, Artificial Sequence
  Description of Artificial Sequence: Synthetic oligonucleotide
  Target: ATXN1; (-) strand; PAM type: NRG; PAM sequence: GGG
atccaagcagtctgactcca

SEQ ID NO: 78928 - DNA, 20 bp, Artificial Sequence
  Description of Artificial Sequence: Synthetic oligonucleotide
  Target: ATXN1; (-) strand; PAM type: NRG; PAM sequence: AGG
aatccaagcagtctgactcc

SEQ ID NO: 78929 - DNA, 20 bp, Artificial Sequence
  Description of Artificial Sequence: Synthetic oligonucleotide
  Target: ATXN1; (-) strand; PAM type: NRG; PAM sequence: CAG
gaatccaagcagtctgactc

SEQ ID NO: 78930 - DNA, 20 bp, Artificial Sequence
  Description of Artificial Sequence: Synthetic oligonucleotide
  Target: ATXN1; (-) strand; PAM type: NRG; PAM sequence: CAG
agctatgatttgaatccaag

SEQ ID NO: 78931 - DNA, 20 bp, Artificial Sequence
  Description of Artificial Sequence: Synthetic oligonucleotide
  Target: ATXN1; (-) strand; PAM type: NRG; PAM sequence: AAG
tagagctatgatttgaatcc

SEQ ID NO: 78932 - DNA, 20 bp, Artificial Sequence
  Description of Artificial Sequence: Synthetic oligonucleotide
  Target: ATXN1; (-) strand; PAM type: NRG; PAM sequence: GAG
tgttgccacgcatggctata

SEQ ID NO: 78933 - DNA, 20 bp, Artificial Sequence
  Description of Artificial Sequence: Synthetic oligonucleotide
  Target: ATXN1; (-) strand; PAM type: NRG; PAM sequence: TAG
catgttgccacgcatggcta

SEQ ID NO: 78934 - DNA, 20 bp, Artificial Sequence
  Description of Artificial Sequence: Synthetic oligonucleotide
  Target: ATXN1; (-) strand; PAM type: NRG; PAM sequence: TGG
atagtgcatgttgccacgca

SEQ ID NO: 78935 - DNA, 20 bp, Artificial Sequence
  Description of Artificial Sequence: Synthetic oligonucleotide
  Target: ATXN1; (-) strand; PAM type: NRG; PAM sequence: TAG
ctcctgtgtagctgggacta

SEQ ID NO: 78936 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgtgtagct

SEQ ID NO: 78937 - DNA, 20 bp, Artificial Sequence
  Description of Artificial Sequence: Synthetic oligonucleotide
  Target: ATXN1; (-) strand; PAM type: NRG; PAM sequence: TGG
ccctcagcctcctgtgtagc

SEQ ID NO: 78938 - DNA, 20 bp, Artificial Sequence
  Description of Artificial Sequence: Synthetic oligonucleotide
  Target: ATXN1; (-) strand; PAM type: NRG; PAM sequence: TAG
ttgcccctcagcctcctgtg

SEQ ID NO: 78939 - DNA, 20 bp, Artificial Sequence
  Description of Artificial Sequence: Synthetic oligonucleotide
  Target: ATXN1; (-) strand; PAM type: NRG; PAM sequence: CAG
ctcaagcgatccttgcccct

SEQ ID NO: 78940 - DNA, 20 bp, Artificial Sequence
  Description of Artificial Sequence: Synthetic oligonucleotide
  Target: ATXN1; (-) strand; PAM type: NRG; PAM sequence: AAG
ggcctccaactcctgggctc

SEQ ID NO: 78941 - DNA, 20 bp, Artificial Sequence
  Description of Artificial Sequence: Synthetic oligonucleotide
  Target: ATXN1; (-) strand; PAM type: NRG; PAM sequence: GGG
caggctggcctccaactcct

SEQ ID NO: 78942 - DNA, 20 bp, Artificial Sequence
  Description of Artificial Sequence: Synthetic oligonucleotide
  Target: ATXN1; (-) strand; PAM type: NRG; PAM sequence: TGG
tcaggctggcctccaactcc

SEQ ID NO: 78943 - DNA, 20 bp, Artificial Sequence
  Description of Artificial Sequence: Synthetic oligonucleotide
  Target: ATXN1; (-) strand; PAM type: NRG; PAM sequence: TGG
tctcattatgttgctcaggc

SEQ ID NO: 78944 - DNA, 20 bp, Artificial Sequence
  Description of Artificial Sequence: Synthetic oligonucleotide
  Target: ATXN1; (-) strand; PAM type: NRG; PAM sequence: AGG
ggagtctcattatgttgctc

SEQ ID NO: 78945 - DNA, 20 bp, Artificial Sequence
  Description of Artificial Sequence: Synthetic oligonucleotide
  Target: ATXN1; (-) strand; PAM type: NRG; PAM sequence: CAG
cggagtctcattatgttgct

SEQ ID NO: 78946 - DNA, 20 bp, Artificial Sequence
  Description of Artificial Sequence: Synthetic oligonucleotide
  Target: ATXN1; (-) strand; PAM type: NRG; PAM sequence: GAG
ttttttttcccttagagacg

SEQ ID NO: 78947 - DNA, 20 bp, Artificial Sequence
  Description of Artificial Sequence: Synthetic oligonucleotide
  Target: ATXN1; (-) strand; PAM type: NRG; PAM sequence: CGG
ttttttttttcccttagaga

SEQ ID NO: 78948 - DNA, 20 bp, Artificial Sequence
  Description of Artificial Sequence: Synthetic oligonucleotide
  Target: ATXN1; (-) strand; PAM type: NRG; PAM sequence: GAG
ttctttttttttttccctta

SEQ ID NO: 78949 - DNA, 20 bp, Artificial Sequence
  Description of Artificial Sequence: Synthetic oligonucleotide
  Target: ATXN1; (-) strand; PAM type: NRG; PAM sequence: TAG
ttttctttttttttttccct

SEQ ID NO: 78950 - DNA, 20 bp, Artificial Sequence
  Description of Artificial Sequence: Synthetic oligonucleotide
  Target: ATXN1; (-) strand; PAM type: NRG; PAM sequence: GAG
tggcagatcttaaagtgata

SEQ ID NO: 78951 - DNA, 20 bp, Artificial Sequence
  Description of Artificial Sequence: Synthetic oligonucleotide
  Target: ATXN1; (-) strand; PAM type: NRG; PAM sequence: TAG
ggtggcagatcttaaagtga

SEQ ID NO: 78952 - DNA, 20 bp, Artificial Sequence
  Description of Artificial Sequence: Synthetic oligonucleotide
  Target: ATXN1; (-) strand; PAM type: NRG; PAM sequence: AAG
gcccaaggtggcagatctta

SEQ ID NO: 78953 - DNA, 20 bp, Artificial Sequence
  Description of Artificial Sequence: Synthetic oligonucleotide
  Target: ATXN1; (-) strand; PAM type: NRG; PAM sequence: CAG
aagcaacttgcccaaggtgg

SEQ ID NO: 78954 - DNA, 20 bp, Artificial Sequence
  Description of Artificial Sequence: Synthetic oligonucleotide
  Target: ATXN1; (-) strand; PAM type: NRG; PAM sequence: TGG
gataagcaacttgcccaagg

SEQ ID NO: 78955 - DNA, 20 bp, Artificial Sequence
  Description of Artificial Sequence: Synthetic oligonucleotide
  Target: ATXN1; (-) strand; PAM type: NRG; PAM sequence: AGG
gaggataagcaacttgccca

SEQ ID NO: 78956 - DNA, 20 bp, Artificial Sequence
  Description of Artificial Sequence: Synthetic oligonucleotide
  Target: ATXN1; (-) strand; PAM type: NRG; PAM sequence: AAG
agaggataagcaacttgccc

SEQ ID NO: 78957 - DNA, 20 bp, Artificial Sequence
  Description of Artificial Sequence: Synthetic oligonucleotide
  Target: ATXN1; (-) strand; PAM type: NRG; PAM sequence: AAG
agttgaggctcagagaggat

SEQ ID NO: 78958 - DNA, 20 bp, Artificial Sequence
  Description of Artificial Sequence: Synthetic oligonucleotide
  Target: ATXN1; (-) strand; PAM type: NRG; PAM sequence: AGG
caggaagttgaggctcagag

SEQ ID NO: 78959 - DNA, 20 bp, Artificial Sequence
  Description of Artificial Sequence: Synthetic oligonucleotide
  Target: ATXN1; (-) strand; PAM type: NRG; PAM sequence: GAG
acaggaagttgaggctcaga

SEQ ID NO: 78960 - DNA, 20 bp, Artificial Sequence
  Description of Artificial Sequence: Synthetic oligonucleotide
  Target: ATXN1; (-) strand; PAM type: NRG; PAM sequence: GAG
gaacaggaagttgaggctca

SEQ ID NO: 78961 - DNA, 20 bp, Artificial Sequence
  Description of Artificial Sequence: Synthetic oligonucleotide
  Target: ATXN1; (-) strand; PAM type: NRG; PAM sequence: CAG
cagaacaggaagttgaggct

SEQ ID NO: 78962 - DNA, 20 bp, Artificial Sequence
  Description of Artificial Sequence: Synthetic oligonucleotide
  Target: ATXN1; (-) strand; PAM type: NRG; PAM sequence: AGG
tttgacagaacaggaagttg

SEQ ID NO: 78963 - DNA, 20 bp, Artificial Sequence
  Description of Artificial Sequence: Synthetic oligonucleotide
  Target: ATXN1; (-) strand; PAM type: NRG; PAM sequence: GAG
atttgacagaacaggaagtt

SEQ ID NO: 78964 - DNA, 20 bp, Artificial Sequence
  Description of Artificial Sequence: Synthetic oligonucleotide
  Target: ATXN1; (-) strand; PAM type: NRG; PAM sequence: AAG
gccccatttgacagaacagg

SEQ ID NO: 78965 - DNA, 20 bp, Artificial Sequence
  Description of Artificial Sequence: Synthetic oligonucleotide
  Target: ATXN1; (-) strand; PAM type: NRG; PAM sequence: AGG
ttagccccatttgacagaac

SEQ ID NO: 78966 - DNA, 20 bp, Artificial Sequence
  Description of Artificial Sequence: Synthetic oligonucleotide
  Target: ATXN1; (-) strand; PAM type: NRG; PAM sequence: CAG
attagccccatttgacagaa

SEQ ID NO: 78967 - DNA, 20 bp, Artificial Sequence
  Description of Artificial Sequence: Synthetic oligonucleotide
  Target: ATXN1; (-) strand; PAM type: NRG; PAM sequence: CAG
gtgttattagccccatttga

SEQ ID NO: 78968 - DNA, 20 bp, Artificial Sequence
  Description of Artificial Sequence: Synthetic oligonucleotide
  Target: ATXN1; (-) strand; PAM type: NRG; PAM sequence: TAG
gcccaacagcatagtgttat

SEQ ID NO: 78969 - DNA, 20 bp, Artificial Sequence
  Description of Artificial Sequence: Synthetic oligonucleotide
  Target: ATXN1; (-) strand; PAM type: NRG; PAM sequence: TAG
gccacagcagcccaacagca

SEQ ID NO: 78970 - DNA, 20 bp, Artificial Sequence
  Description of Artificial Sequence: Synthetic oligonucleotide
  Target: ATXN1; (-) strand; PAM type: NRG; PAM sequence: CAG
caattgccacagcagcccaa

SEQ ID NO: 78971 - DNA, 20 bp, Artificial Sequence
  Description of Artificial Sequence: Synthetic oligonucleotide
  Target: ATXN1; (-) strand; PAM type: NRG; PAM sequence: CAG
gtaaaattcaattgccacag

SEQ ID NO: 78972 - DNA, 20 bp, Artificial Sequence
  Description of Artificial Sequence: Synthetic oligonucleotide
  Target: ATXN1; (-) strand; PAM type: NRG; PAM sequence: CAG
catgtaaaattcaattgcca

SEQ ID NO: 78973 - DNA, 20 bp, Artificial Sequence
  Description of Artificial Sequence: Synthetic oligonucleotide
  Target: ATXN1; (-) strand; PAM type: NRG; PAM sequence: AAG
tatggtccagatgctgtact

SEQ ID NO: 78974 - DNA, 20 bp, Artificial Sequence
  Description of Artificial Sequence: Synthetic oligonucleotide
  Target: ATXN1; (-) strand; PAM type: NRG; PAM sequence: CAG
aatgagctcttattatggtc

SEQ ID NO: 78975 - DNA, 20 bp, Artificial Sequence
  Description of Artificial Sequence: Synthetic oligonucleotide
  Target: ATXN1; (-) strand; PAM type: NRG; PAM sequence: TGG
tatataatgagctcttatta

SEQ ID NO: 78976 - DNA, 20 bp, Artificial Sequence
  Description of Artificial Sequence: Synthetic oligonucleotide
  Target: ATXN1; (-) strand; PAM type: NRG; PAM sequence: GAG
aaataatactaatatataat

SEQ ID NO: 78977 - DNA, 20 bp, Artificial Sequence
  Description of Artificial Sequence: Synthetic oligonucleotide
  Target: ATXN1; (-) strand; PAM type: NRG; PAM sequence: GGG
tgtaaaagtttggttgaggg

SEQ ID NO: 78978 - DNA, 20 bp, Artificial Sequence
  Description of Artificial Sequence: Synthetic oligonucleotide
  Target: ATXN1; (-) strand; PAM type: NRG; PAM sequence: GGG
ctgtaaaagtttggttgagg

SEQ ID NO: 78979 - DNA, 20 bp, Artificial Sequence
  Description of Artificial Sequence: Synthetic oligonucleotide
  Target: ATXN1; (-) strand; PAM type: NRG; PAM sequence: GGG
actgtaaaagtttggttgag

SEQ ID NO: 78980 - DNA, 20 bp, Artificial Sequence
  Description of Artificial Sequence: Synthetic oligonucleotide
  Target: ATXN1; (-) strand; PAM type: NRG; PAM sequence: GGG
tactgtaaaagtttggttga

SEQ ID NO: 78981 - DNA, 20 bp, Artificial Sequence
  Description of Artificial Sequence: Synthetic oligonucleotide
  Target: ATXN1; (-) strand; PAM type: NRG; PAM sequence: AGG
ctactgtaaaagtttggttg

SEQ ID NO: 78982 - DNA, 20 bp, Artificial Sequence
  Description of Artificial Sequence: Synthetic oligonucleotide
  Target: ATXN1; (-) strand; PAM type: NRG; PAM sequence: GAG
cctactgtaaaagtttggtt

SEQ ID NO: 78983 - DNA, 20 bp, Artificial Sequence
  Description of Artificial Sequence: Synthetic oligonucleotide
  Target: ATXN1; (-) strand; PAM type: NRG; PAM sequence: TGG
tttctcctactgtaaaagtt

SEQ ID NO: 78984 - DNA, 20 bp, Artificial Sequence
  Description of Artificial Sequence: Synthetic oligonucleotide
  Target: ATXN1; (-) strand; PAM type: NRG; PAM sequence: AAG
caaggtttctcctactgtaa

SEQ ID NO: 78985 - DNA, 20 bp, Artificial Sequence
  Description of Artificial Sequence: Synthetic oligonucleotide
  Target: ATXN1; (-) strand; PAM type: NRG; PAM sequence: AGG
ctagcatagaaataagatca

SEQ ID NO: 78986 - DNA, 20 bp, Artificial Sequence
  Description of Artificial Sequence: Synthetic oligonucleotide
  Target: ATXN1; (-) strand; PAM type: NRG; PAM sequence: AAG
tctagcatagaaataagatc

SEQ ID NO: 78987 - DNA, 20 bp, Artificial Sequence
  Description of Artificial Sequence: Synthetic oligonucleotide
  Target: ATXN1; (-) strand; PAM type: NRG; PAM sequence: AAG
ttttcctctagcatagaaat

SEQ ID NO: 78988 - DNA, 20 bp, Artificial Sequence
  Description of Artificial Sequence: Synthetic oligonucleotide
  Target: ATXN1; (-) strand; PAM type: NRG; PAM sequence: TAG
ctactgcttttcctctagca

SEQ ID NO: 78989 - DNA, 20 bp, Artificial Sequence
  Description of Artificial Sequence: Synthetic oligonucleotide
  Target: ATXN1; (-) strand; PAM type: NRG; PAM sequence: TAG
gaagactactgcttttcctc

SEQ ID NO: 78990 - DNA, 20 bp, Artificial Sequence
  Description of Artificial Sequence: Synthetic oligonucleotide
  Target: ATXN1; (-) strand; PAM type: NRG; PAM sequence: AAG
ttttgtgtttacagcctttg

SEQ ID NO: 78991 - DNA, 20 bp, Artificial Sequence
  Description of Artificial Sequence: Synthetic oligonucleotide
  Target: ATXN1; (-) strand; PAM type: NRG; PAM sequence: CAG
tatttaacattttgtgttta

SEQ ID NO: 78992 - DNA, 20 bp, Artificial Sequence
  Description of Artificial Sequence: Synthetic oligonucleotide
  Target: ATXN1; (-) strand; PAM type: NRG; PAM sequence: GAG
gagagacagagagagagaga

SEQ ID NO: 78993 - DNA, 20 bp, Artificial Sequence
  Description of Artificial Sequence: Synthetic oligonucleotide
  Target: ATXN1; (-) strand; PAM type: NRG; PAM sequence: GAG
ttgagagacagagagagaga

SEQ ID NO: 78994 - DNA, 20 bp, Artificial Sequence
  Description of Artificial Sequence: Synthetic oligonucleotide
  Target: ATXN1; (-) strand; PAM type: NRG; PAM sequence: GAG
gtttgagagacagagagaga

SEQ ID NO: 78995 - DNA, 20 bp, Artificial Sequence
  Description of Artificial Sequence: Synthetic oligonucleotide
  Target: ATXN1; (-) strand; PAM type: NRG; PAM sequence: GAG
gtgtttgagagacagagaga

SEQ ID NO: 78996 - DNA, 20 bp, Artificial Sequence
  Description of Artificial Sequence: Synthetic oligonucleotide
  Target: ATXN1; (-) strand; PAM type: NRG; PAM sequence: GAG
gtgtgtttgagagacagaga

SEQ ID NO: 78997 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtttgagagacaga

SEQ ID NO: 78998 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtttgagagaca

SEQ ID NO: 78999 - DNA, 20 bp, Artificial Sequence
  Description of Artificial Sequence: Synthetic oligonucleotide
  Target: ATXN1; (-) strand; PAM type: NRG; PAM sequence: CAG
gtgtgtgtgtgtttgagaga

SEQ ID NO: 79000 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgtgtttga

SEQ ID NO: 79001 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtgtgtgtgttt

SEQ ID NO: 79002 - DNA, 20 bp, Artificial Sequence
  Description of Artificial Sequence: Synthetic oligonucleotide
  Target: ATXN1; (-) strand; PAM type: NRG; PAM sequence: TAG
tagattatggttggaaatta

SEQ ID NO: 79003 - DNA, 20 bp, Artificial Sequence
  Description of Artificial Sequence: Synthetic oligonucleotide
  Target: ATXN1; (-) strand; PAM type: NRG; PAM sequence: TGG
ctagataaatagattatggt

SEQ ID NO: 79004 - DNA, 20 bp, Artificial Sequence
  Description of Artificial Sequence: Synthetic oligonucleotide
  Target: ATXN1; (-) strand; PAM type: NRG; PAM sequence: TGG
aatgctagataaatagatta

SEQ ID NO: 79005 - DNA, 20 bp, Artificial Sequence
  Description of Artificial Sequence: Synthetic oligonucleotide
  Target: ATXN1; (-) strand; PAM type: NRG; PAM sequence: TAG
agaattgaatgctagataaa

SEQ ID NO: 79006 - DNA, 20 bp, Artificial Sequence
  Description of Artificial Sequence: Synthetic oligonucleotide
  Target: ATXN1; (-) strand; PAM type: NRG; PAM sequence: TAG
atatctggagaattgaatgc

SEQ ID NO: 79007 - DNA, 20 bp, Artificial Sequence
  Description of Artificial Sequence: Synthetic oligonucleotide
  Target: ATXN1; (-) strand; PAM type: NRG; PAM sequence: GAG
aaacgatagcacaatatctg

SEQ ID NO: 79008 - DNA, 20 bp, Artificial Sequence
  Description of Artificial Sequence: Synthetic oligonucleotide
  Target: ATXN1; (-) strand; PAM type: NRG; PAM sequence: TGG
ctaaacgatagcacaatatc

SEQ ID NO: 79009 - DNA, 20 bp, Artificial Sequence
  Description of Artificial Sequence: Synthetic oligonucleotide
  Target: ATXN1; (-) strand; PAM type: NRG; PAM sequence: TAG
agcacagcatcactaaacga

SEQ ID NO: 79010 - DNA, 20 bp, Artificial Sequence
  Description of Artificial Sequence: Synthetic oligonucleotide
  Target: ATXN1; (-) strand; PAM type: NRG; PAM sequence: CAG
tatgttcaagaagtccagca

SEQ ID NO: 79011 - DNA, 20 bp, Artificial Sequence
  Description of Artificial Sequence: Synthetic oligonucleotide
  Target: ATXN1; (-) strand; PAM type: NRG; PAM sequence: CAG
atatatatgttcaagaagtc

SEQ ID NO: 79012 - DNA, 20 bp, Artificial Sequence
  Description of Artificial Sequence: Synthetic oligonucleotide
  Target: ATXN1; (-) strand; PAM type: NRG; PAM sequence: AAG
aaaagatatatatgttcaag

SEQ ID NO: 79013 - DNA, 20 bp, Artificial Sequence
  Description of Artificial Sequence: Synthetic oligonucleotide
  Target: ATXN1; (-) strand; PAM type: NRG; PAM sequence: AAG
gaaaaaagatatatatgttc

SEQ ID NO: 79014 - DNA, 20 bp, Artificial Sequence
  Description of Artificial Sequence: Synthetic oligonucleotide
  Target: ATXN1; (-) strand; PAM type: NRG; PAM sequence: AAG
acaaccagagatgttgaaaa

SEQ ID NO: 79015 - DNA, 20 bp, Artificial Sequence
  Description of Artificial Sequence: Synthetic oligonucleotide
  Target: ATXN1; (-) strand; PAM type: NRG; PAM sequence: GAG
ttgtcctaaggaaacaacca

SEQ ID NO: 79016 - DNA, 20 bp, Artificial Sequence
  Description of Artificial Sequence: Synthetic oligonucleotide
  Target: ATXN1; (-) strand; PAM type: NRG; PAM sequence: CAG
atttgtcctaaggaaacaac

SEQ ID NO: 79017 - DNA, 20 bp, Artificial Sequence
  Description of Artificial Sequence: Synthetic oligonucleotide
  Target: ATXN1; (-) strand; PAM type: NRG; PAM sequence: AGG
agacagagaaatttgtccta

SEQ ID NO: 79018 - DNA, 20 bp, Artificial Sequence
  Description of Artificial Sequence: Synthetic oligonucleotide
  Target: ATXN1; (-) strand; PAM type: NRG; PAM sequence: AAG
gagacagagaaatttgtcct

SEQ ID NO: 79019 - DNA, 20 bp, Artificial Sequence
  Description of Artificial Sequence: Synthetic oligonucleotide
  Target: ATXN1; (-) strand; PAM type: NRG; PAM sequence: GAG
gtgtgagagagagagagaca

SEQ ID NO: 79020 - DNA, 20 bp, Artificial Sequence
  Description of Artificial Sequence: Synthetic oligonucleotide
  Target: ATXN1; (-) strand; PAM type: NRG; PAM sequence: CAG
gtgtgtgagagagagagaga

SEQ ID NO: 79021 - DNA, 20 bp, Artificial Sequence
  Description of Artificial Sequence: Synthetic oligonucleotide
  Target: ATXN1; (-) strand; PAM type: NRG; PAM sequence: GAG
atgtgtgtgtgagagagaga

SEQ ID NO: 79022 - DNA, 20 bp, Artificial Sequence
  Description of Artificial Sequence: Synthetic oligonucleotide
  Target: ATXN1; (-) strand; PAM type: NRG; PAM sequence: GAG
gtatgtgtgtgtgagagaga

SEQ ID NO: 79023 - DNA, 20 bp, Artificial Sequence
  Description of Artificial Sequence: Synthetic oligonucleotide
  Target: ATXN1; (-) strand; PAM type: NRG; PAM sequence: GAG
gtgtatgtgtgtgtgagaga

SEQ ID NO: 79024 - DNA, 20 bp, Artificial Sequence
  Description of Artificial Sequence: Synthetic oligonucleotide
  Target: ATXN1; (-) strand; PAM type: NRG; PAM sequence: GAG
gtgtgtatgtgtgtgtgaga

SEQ ID NO: 79025 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtatgtgtgtgtga

SEQ ID NO: 79026 - DNA, 20 bp, Artificial Sequence
  Description of Artificial Sequence: Synthetic oligonucleotide
  Target: ATXN1; (-) strand; PAM type: NRG; PAM sequence: GAG
ctgtgtgtgtatgtgtgtgt

SEQ ID NO: 79027 - DNA, 20 bp, Artificial Sequence
  Description of Artificial Sequence: Synthetic oligonucleotide
  Target: ATXN1; (-) strand; PAM type: NRG; PAM sequence: GAG
ttcttaggatcctaggatat

SEQ ID NO: 79028 - DNA, 20 bp, Artificial Sequence
  Description of Artificial Sequence: Synthetic oligonucleotide
  Target: ATXN1; (-) strand; PAM type: NRG; PAM sequence: AGG
ccccaatttcttaggatcct

SEQ ID NO: 79029 - DNA, 20 bp, Artificial Sequence
  Description of Artificial Sequence: Synthetic oligonucleotide
  Target: ATXN1; (-) strand; PAM type: NRG; PAM sequence: TAG
gccccaatttcttaggatcc

SEQ ID NO: 79030 - DNA, 20 bp, Artificial Sequence
  Description of Artificial Sequence: Synthetic oligonucleotide
  Target: ATXN1; (-) strand; PAM type: NRG; PAM sequence: AGG
aaagattgccccaatttctt

SEQ ID NO: 79031 - DNA, 20 bp, Artificial Sequence
  Description of Artificial Sequence: Synthetic oligonucleotide
  Target: ATXN1; (-) strand; PAM type: NRG; PAM sequence: TAG
taaagattgccccaatttct

SEQ ID NO: 79032 - DNA, 20 bp, Artificial Sequence
  Description of Artificial Sequence: Synthetic oligonucleotide
  Target: ATXN1; (-) strand; PAM type: NRG; PAM sequence: AAG
ctccttaaagatgcatatta

SEQ ID NO: 79033 - DNA, 20 bp, Artificial Sequence
  Description of Artificial Sequence: Synthetic oligonucleotide
  Target: ATXN1; (-) strand; PAM type: NRG; PAM sequence: AAG
aaactcagatgatctcctta

SEQ ID NO: 79034 - DNA, 20 bp, Artificial Sequence
  Description of Artificial Sequence: Synthetic oligonucleotide
  Target: ATXN1; (-) strand; PAM type: NRG; PAM sequence: CAG
cgacttgggttgaccaaact

SEQ ID NO: 79035 - DNA, 20 bp, Artificial Sequence
  Description of Artificial Sequence: Synthetic oligonucleotide
  Target: ATXN1; (-) strand; PAM type: NRG; PAM sequence: GGG
ataacgtacctcttcgactt

SEQ ID NO: 79036 - DNA, 20 bp, Artificial Sequence
  Description of Artificial Sequence: Synthetic oligonucleotide
  Target: ATXN1; (-) strand; PAM type: NRG; PAM sequence: TGG
tataacgtacctcttcgact

SEQ ID NO: 79037 - DNA, 20 bp, Artificial Sequence
  Description of Artificial Sequence: Synthetic oligonucleotide
  Target: ATXN1; (-) strand; PAM type: NRG; PAM sequence: TAG
ctctgttttcttagatcatc

SEQ ID NO: 79038 - DNA, 20 bp, Artificial Sequence
  Description of Artificial Sequence: Synthetic oligonucleotide
  Target: ATXN1; (-) strand; PAM type: NRG; PAM sequence: TAG
atcaacaacctctgttttct

SEQ ID NO: 79039 - DNA, 20 bp, Artificial Sequence
  Description of Artificial Sequence: Synthetic oligonucleotide
  Target: ATXN1; (-) strand; PAM type: NRG; PAM sequence: GGG
ccttttgggggggcatatat

SEQ ID NO: 79040 - DNA, 20 bp, Artificial Sequence
  Description of Artificial Sequence: Synthetic oligonucleotide
  Target: ATXN1; (-) strand; PAM type: NRG; PAM sequence: TGG
gccttttgggggggcatata

SEQ ID NO: 79041 - DNA, 20 bp, Artificial Sequence
  Description of Artificial Sequence: Synthetic oligonucleotide
  Target: ATXN1; (-) strand; PAM type: NRG; PAM sequence: GGG
agggctaaagccttttgggg

SEQ ID NO: 79042 - DNA, 20 bp, Artificial Sequence
  Description of Artificial Sequence: Synthetic oligonucleotide
  Target: ATXN1; (-) strand; PAM type: NRG; PAM sequence: GGG
gagggctaaagccttttggg

SEQ ID NO: 79043 - DNA, 20 bp, Artificial Sequence
  Description of Artificial Sequence: Synthetic oligonucleotide
  Target: ATXN1; (-) strand; PAM type: NRG; PAM sequence: GGG
ggagggctaaagccttttgg

SEQ ID NO: 79044 - DNA, 20 bp, Artificial Sequence
  Description of Artificial Sequence: Synthetic oligonucleotide
  Target: ATXN1; (-) strand; PAM type: NRG; PAM sequence: GGG
tggagggctaaagccttttg

SEQ ID NO: 79045 - DNA, 20 bp, Artificial Sequence
  Description of Artificial Sequence: Synthetic oligonucleotide
  Target: ATXN1; (-) strand; PAM type: NRG; PAM sequence: GGG
atggagggctaaagcctttt

SEQ ID NO: 79046 - DNA, 20 bp, Artificial Sequence
  Description of Artificial Sequence: Synthetic oligonucleotide
  Target: ATXN1; (-) strand; PAM type: NRG; PAM sequence: TGG
catggagggctaaagccttt

SEQ ID NO: 79047 - DNA, 20 bp, Artificial Sequence
  Description of Artificial Sequence: Synthetic oligonucleotide
  Target: ATXN1; (-) strand; PAM type: NRG; PAM sequence: AAG
acctgtgccatggagggcta

SEQ ID NO: 79048 - DNA, 20 bp, Artificial Sequence
  Description of Artificial Sequence: Synthetic oligonucleotide
  Target: ATXN1; (-) strand; PAM type: NRG; PAM sequence: GGG
aaatacacctgtgccatgga

SEQ ID NO: 79049 - DNA, 20 bp, Artificial Sequence
  Description of Artificial Sequence: Synthetic oligonucleotide
  Target: ATXN1; (-) strand; PAM type: NRG; PAM sequence: AGG
taaatacacctgtgccatgg

SEQ ID NO: 79050 - DNA, 20 bp, Artificial Sequence
  Description of Artificial Sequence: Synthetic oligonucleotide
  Target: ATXN1; (-) strand; PAM type: NRG; PAM sequence: GAG
gtaaatacacctgtgccatg

SEQ ID NO: 79051 - DNA, 20 bp, Artificial Sequence
  Description of Artificial Sequence: Synthetic oligonucleotide
  Target: ATXN1; (-) strand; PAM type: NRG; PAM sequence: TGG
ctgtaaatacacctgtgcca

SEQ ID NO: 79052 - DNA, 20 bp, Artificial Sequence
  Description of Artificial Sequence: Synthetic oligonucleotide
  Target: ATXN1; (-) strand; PAM type: NRG; PAM sequence: CAG
tccttggcactttgcacacc

SEQ ID NO: 79053 - DNA, 20 bp, Artificial Sequence
  Description of Artificial Sequence: Synthetic oligonucleotide
  Target: ATXN1; (-) strand; PAM type: NRG; PAM sequence: TGG
aaacccagtggcatcctcct

SEQ ID NO: 79054 - DNA, 20 bp, Artificial Sequence
  Description of Artificial Sequence: Synthetic oligonucleotide
  Target: ATXN1; (-) strand; PAM type: NRG; PAM sequence: TGG
gggctccttctgaaacccag

SEQ ID NO: 79055 - DNA, 20 bp, Artificial Sequence
  Description of Artificial Sequence: Synthetic oligonucleotide
  Target: ATXN1; (-) strand; PAM type: NRG; PAM sequence: CAG
ctggggctccttctgaaacc

SEQ ID NO: 79056 - DNA, 20 bp, Artificial Sequence
  Description of Artificial Sequence: Synthetic oligonucleotide
  Target: ATXN1; (-) strand; PAM type: NRG; PAM sequence: GGG
gcagcctgactccctttctg

SEQ ID NO: 79057 - DNA, 20 bp, Artificial Sequence
  Description of Artificial Sequence: Synthetic oligonucleotide
  Target: ATXN1; (-) strand; PAM type: NRG; PAM sequence: GGG
tgcagcctgactccctttct

SEQ ID NO: 79058 - DNA, 20 bp, Artificial Sequence
  Description of Artificial Sequence: Synthetic oligonucleotide
  Target: ATXN1; (-) strand; PAM type: NRG; PAM sequence: TGG
atgcagcctgactccctttc

SEQ ID NO: 79059 - DNA, 20 bp, Artificial Sequence
  Description of Artificial Sequence: Synthetic oligonucleotide
  Target: ATXN1; (-) strand; PAM type: NRG; PAM sequence: CAG
tgggggtcctagaacttatg

SEQ ID NO: 79060 - DNA, 20 bp, Artificial Sequence
  Description of Artificial Sequence: Synthetic oligonucleotide
  Target: ATXN1; (-) strand; PAM type: NRG; PAM sequence: TAG
agcggagtaggtgggggtcc

SEQ ID NO: 79061 - DNA, 20 bp, Artificial Sequence
  Description of Artificial Sequence: Synthetic oligonucleotide
  Target: ATXN1; (-) strand; PAM type: NRG; PAM sequence: GGG
ctggccagcggagtaggtgg

SEQ ID NO: 79062 - DNA, 20 bp, Artificial Sequence
  Description of Artificial Sequence: Synthetic oligonucleotide
  Target: ATXN1; (-) strand; PAM type: NRG; PAM sequence: GGG
gctggccagcggagtaggtg

SEQ ID NO: 79063 - DNA, 20 bp, Artificial Sequence
  Description of Artificial Sequence: Synthetic oligonucleotide
  Target: ATXN1; (-) strand; PAM type: NRG; PAM sequence: GGG
tgctggccagcggagtaggt

SEQ ID NO: 79064 - DNA, 20 bp, Artificial Sequence
  Description of Artificial Sequence: Synthetic oligonucleotide
  Target: ATXN1; (-) strand; PAM type: NRG; PAM sequence: TGG
gtgctggccagcggagtagg

SEQ ID NO: 79065 - DNA, 20 bp, Artificial Sequence
  Description of Artificial Sequence: Synthetic oligonucleotide
  Target: ATXN1; (-) strand; PAM type: NRG; PAM sequence: AGG
gtggtgctggccagcggagt

SEQ ID NO: 79066 - DNA, 20 bp, Artificial Sequence
  Description of Artificial Sequence: Synthetic oligonucleotide
  Target: ATXN1; (-) strand; PAM type: NRG; PAM sequence: TAG
tgtggtgctggccagcggag

SEQ ID NO: 79067 - DNA, 20 bp, Artificial Sequence
  Description of Artificial Sequence: Synthetic oligonucleotide
  Target: ATXN1; (-) strand; PAM type: NRG; PAM sequence: GAG
acatgtggtgctggccagcg

SEQ ID NO: 79068 - DNA, 20 bp, Artificial Sequence
  Description of Artificial Sequence: Synthetic oligonucleotide
  Target: ATXN1; (-) strand; PAM type: NRG; PAM sequence: CGG
ccacatgtggtgctggccag

SEQ ID NO: 79069 - DNA, 20 bp, Artificial Sequence
  Description of Artificial Sequence: Synthetic oligonucleotide
  Target: ATXN1; (-) strand; PAM type: NRG; PAM sequence: CAG
ggaccacatgtggtgctggc

SEQ ID NO: 79070 - DNA, 20 bp, Artificial Sequence
  Description of Artificial Sequence: Synthetic oligonucleotide
  Target: ATXN1; (-) strand; PAM type: NRG; PAM sequence: TGG
tgtgggaccacatgtggtgc

SEQ ID NO: 79071 - DNA, 20 bp, Artificial Sequence
  Description of Artificial Sequence: Synthetic oligonucleotide
  Target: ATXN1; (-) strand; PAM type: NRG; PAM sequence: TGG
tagtcctgtgggaccacatg

SEQ ID NO: 79072 - DNA, 20 bp, Artificial Sequence
  Description of Artificial Sequence: Synthetic oligonucleotide
  Target: ATXN1; (-) strand; PAM type: NRG; PAM sequence: GGG
agaggagagtgtagtcctgt

SEQ ID NO: 79073 - DNA, 20 bp, Artificial Sequence
  Description of Artificial Sequence: Synthetic oligonucleotide
  Target: ATXN1; (-) strand; PAM type: NRG; PAM sequence: TGG
tagaggagagtgtagtcctg

SEQ ID NO: 79074 - DNA, 20 bp, Artificial Sequence
  Description of Artificial Sequence: Synthetic oligonucleotide
  Target: ATXN1; (-) strand; PAM type: NRG; PAM sequence: TAG
tttgcttatagaggagagtg

SEQ ID NO: 79075 - DNA, 20 bp, Artificial Sequence
  Description of Artificial Sequence: Synthetic oligonucleotide
  Target: ATXN1; (-) strand; PAM type: NRG; PAM sequence: GAG
tctcctttgcttatagagga

SEQ ID NO: 79076 - DNA, 20 bp, Artificial Sequence
  Description of Artificial Sequence: Synthetic oligonucleotide
  Target: ATXN1; (-) strand; PAM type: NRG; PAM sequence: GAG
gttctcctttgcttatagag

SEQ ID NO: 79077 - DNA, 20 bp, Artificial Sequence
  Description of Artificial Sequence: Synthetic oligonucleotide
  Target: ATXN1; (-) strand; PAM type: NRG; PAM sequence: AGG
gagttctcctttgcttatag

SEQ ID NO: 79078 - DNA, 20 bp, Artificial Sequence
  Description of Artificial Sequence: Synthetic oligonucleotide
  Target: ATXN1; (-) strand; PAM type: NRG; PAM sequence: GAG
agagttctcctttgcttata

SEQ ID NO: 79079 - DNA, 20 bp, Artificial Sequence
  Description of Artificial Sequence: Synthetic oligonucleotide
  Target: ATXN1; (-) strand; PAM type: NRG; PAM sequence: TAG
agagagttctcctttgctta

SEQ ID NO: 79080 - DNA, 20 bp, Artificial Sequence
  Description of Artificial Sequence: Synthetic oligonucleotide
  Target: ATXN1; (-) strand; PAM type: NRG; PAM sequence: GAG
gatctagaaagggccccaga

SEQ ID NO: 79081 - DNA, 20 bp, Artificial Sequence
  Description of Artificial Sequence: Synthetic oligonucleotide
  Target: ATXN1; (-) strand; PAM type: NRG; PAM sequence: GAG
cagatctagaaagggcccca

SEQ ID NO: 79082 - DNA, 20 bp, Artificial Sequence
  Description of Artificial Sequence: Synthetic oligonucleotide
  Target: ATXN1; (-) strand; PAM type: NRG; PAM sequence: CAG
ctcagatctagaaagggccc

SEQ ID NO: 79083 - DNA, 20 bp, Artificial Sequence
  Description of Artificial Sequence: Synthetic oligonucleotide
  Target: ATXN1; (-) strand; PAM type: NRG; PAM sequence: GGG
taggacctcagatctagaaa

SEQ ID NO: 79084 - DNA, 20 bp, Artificial Sequence
  Description of Artificial Sequence: Synthetic oligonucleotide
  Target: ATXN1; (-) strand; PAM type: NRG; PAM sequence: AGG
gtaggacctcagatctagaa

SEQ ID NO: 79085 - DNA, 20 bp, Artificial Sequence
  Description of Artificial Sequence: Synthetic oligonucleotide
  Target: ATXN1; (-) strand; PAM type: NRG; PAM sequence: AAG
agtaggacctcagatctaga

SEQ ID NO: 79086 - DNA, 20 bp, Artificial Sequence
  Description of Artificial Sequence: Synthetic oligonucleotide
  Target: ATXN1; (-) strand; PAM type: NRG; PAM sequence: TAG
ttttagtaggacctcagatc

SEQ ID NO: 79087 - DNA, 20 bp, Artificial Sequence
  Description of Artificial Sequence: Synthetic oligonucleotide
  Target: ATXN1; (-) strand; PAM type: NRG; PAM sequence: CAG
caccctttttagtaggacct

SEQ ID NO: 79088 - DNA, 20 bp, Artificial Sequence
  Description of Artificial Sequence: Synthetic oligonucleotide
  Target: ATXN1; (-) strand; PAM type: NRG; PAM sequence: AGG
aggttgtcaccctttttagt

SEQ ID NO: 79089 - DNA, 20 bp, Artificial Sequence
  Description of Artificial Sequence: Synthetic oligonucleotide
  Target: ATXN1; (-) strand; PAM type: NRG; PAM sequence: TAG
gaggttgtcaccctttttag

SEQ ID NO: 79090 - DNA, 20 bp, Artificial Sequence
  Description of Artificial Sequence: Synthetic oligonucleotide
  Target: ATXN1; (-) strand; PAM type: NRG; PAM sequence: TAG
gctgaggttgtcaccctttt

SEQ ID NO: 79091 - DNA, 20 bp, Artificial Sequence
  Description of Artificial Sequence: Synthetic oligonucleotide
  Target: ATXN1; (-) strand; PAM type: NRG; PAM sequence: AGG
acaactaatgttcagagctg

SEQ ID NO: 79092 - DNA, 20 bp, Artificial Sequence
  Description of Artificial Sequence: Synthetic oligonucleotide
  Target: ATXN1; (-) strand; PAM type: NRG; PAM sequence: GAG
aacaactaatgttcagagct

SEQ ID NO: 79093 - DNA, 20 bp, Artificial Sequence
  Description of Artificial Sequence: Synthetic oligonucleotide
  Target: ATXN1; (-) strand; PAM type: NRG; PAM sequence: GAG
aataaaacaactaatgttca

SEQ ID NO: 79094 - DNA, 20 bp, Artificial Sequence
  Description of Artificial Sequence: Synthetic oligonucleotide
  Target: ATXN1; (-) strand; PAM type: NRG; PAM sequence: CAG
gaaataaaacaactaatgtt

SEQ ID NO: 79095 - DNA, 20 bp, Artificial Sequence
  Description of Artificial Sequence: Synthetic oligonucleotide
  Target: ATXN1; (-) strand; PAM type: NRG; PAM sequence: GAG
ggatgtagaagcccactttg

SEQ ID NO: 79096 - DNA, 20 bp, Artificial Sequence
  Description of Artificial Sequence: Synthetic oligonucleotide
  Target: ATXN1; (-) strand; PAM type: NRG; PAM sequence: TGG
cgggatgtagaagcccactt

SEQ ID NO: 79097 - DNA, 20 bp, Artificial Sequence
  Description of Artificial Sequence: Synthetic oligonucleotide
  Target: ATXN1; (-) strand; PAM type: NRG; PAM sequence: AAG
tcatttgtttcgggatgtag

SEQ ID NO: 79098 - DNA, 20 bp, Artificial Sequence
  Description of Artificial Sequence: Synthetic oligonucleotide
  Target: ATXN1; (-) strand; PAM type: NRG; PAM sequence: TAG
ctttcatttgtttcgggatg

SEQ ID NO: 79099 - DNA, 20 bp, Artificial Sequence
  Description of Artificial Sequence: Synthetic oligonucleotide
  Target: ATXN1; (-) strand; PAM type: NRG; PAM sequence: GGG
aattttctttcatttgtttc

SEQ ID NO: 79100 - DNA, 20 bp, Artificial Sequence
  Description of Artificial Sequence: Synthetic oligonucleotide
  Target: ATXN1; (-) strand; PAM type: NRG; PAM sequence: CGG
taattttctttcatttgttt

SEQ ID NO: 79101 - DNA, 20 bp, Artificial Sequence
  Description of Artificial Sequence: Synthetic oligonucleotide
  Target: ATXN1; (-) strand; PAM type: NRG; PAM sequence: AGG
caaatgctttcatggatgcc

SEQ ID NO: 79102 - DNA, 20 bp, Artificial Sequence
  Description of Artificial Sequence: Synthetic oligonucleotide
  Target: ATXN1; (-) strand; PAM type: NRG; PAM sequence: CAG
gcaaatgctttcatggatgc

SEQ ID NO: 79103 - DNA, 20 bp, Artificial Sequence
  Description of Artificial Sequence: Synthetic oligonucleotide
  Target: ATXN1; (-) strand; PAM type: NRG; PAM sequence: TGG
agggaaagcaaatgctttca

SEQ ID NO: 79104 - DNA, 20 bp, Artificial Sequence
  Description of Artificial Sequence: Synthetic oligonucleotide
  Target: ATXN1; (-) strand; PAM type: NRG; PAM sequence: AAG
tgaaataacatgaacaggga

SEQ ID NO: 79105 - DNA, 20 bp, Artificial Sequence
  Description of Artificial Sequence: Synthetic oligonucleotide
  Target: ATXN1; (-) strand; PAM type: NRG; PAM sequence: GGG
ttactgaaataacatgaaca

SEQ ID NO: 79106 - DNA, 20 bp, Artificial Sequence
  Description of Artificial Sequence: Synthetic oligonucleotide
  Target: ATXN1; (-) strand; PAM type: NRG; PAM sequence: AGG
tttactgaaataacatgaac

SEQ ID NO: 79107 - DNA, 20 bp, Artificial Sequence
  Description of Artificial Sequence: Synthetic oligonucleotide
  Target: ATXN1; (-) strand; PAM type: NRG; PAM sequence: CAG
atttactgaaataacatgaa

SEQ ID NO: 79108 - DNA, 20 bp, Artificial Sequence
  Description of Artificial Sequence: Synthetic oligonucleotide
  Target: ATXN1; (-) strand; PAM type: NRG; PAM sequence: TAG
tttgtctctttctacactgc

SEQ ID NO: 79109 - DNA, 20 bp, Artificial Sequence
  Description of Artificial Sequence: Synthetic oligonucleotide
  Target: ATXN1; (-) strand; PAM type: NRG; PAM sequence: AGG
aatgaccttgggctccgaac

SEQ ID NO: 79110 - DNA, 20 bp, Artificial Sequence
  Description of Artificial Sequence: Synthetic oligonucleotide
  Target: ATXN1; (-) strand; PAM type: NRG; PAM sequence: CAG
taatgaccttgggctccgaa

SEQ ID NO: 79111 - DNA, 20 bp, Artificial Sequence
  Description of Artificial Sequence: Synthetic oligonucleotide
  Target: ATXN1; (-) strand; PAM type: NRG; PAM sequence: GGG
taatggcatctaatgacctt

SEQ ID NO: 79112 - DNA, 20 bp, Artificial Sequence
  Description of Artificial Sequence: Synthetic oligonucleotide
  Target: ATXN1; (-) strand; PAM type: NRG; PAM sequence: TGG
ctaatggcatctaatgacct

SEQ ID NO: 79113 - DNA, 20 bp, Artificial Sequence
  Description of Artificial Sequence: Synthetic oligonucleotide
  Target: ATXN1; (-) strand; PAM type: NRG; PAM sequence: TGG
tgtctttatgccattgctaa

SEQ ID NO: 79114 - DNA, 20 bp, Artificial Sequence
  Description of Artificial Sequence: Synthetic oligonucleotide
  Target: ATXN1; (-) strand; PAM type: NRG; PAM sequence: GAG
gaaggatgcaataacccact

SEQ ID NO: 79115 - DNA, 20 bp, Artificial Sequence
  Description of Artificial Sequence: Synthetic oligonucleotide
  Target: ATXN1; (-) strand; PAM type: NRG; PAM sequence: AGG
cgacaaggtgtcaagaagga

SEQ ID NO: 79116 - DNA, 20 bp, Artificial Sequence
  Description of Artificial Sequence: Synthetic oligonucleotide
  Target: ATXN1; (-) strand; PAM type: NRG; PAM sequence: AAG
ccgacaaggtgtcaagaagg

SEQ ID NO: 79117 - DNA, 20 bp, Artificial Sequence
  Description of Artificial Sequence: Synthetic oligonucleotide
  Target: ATXN1; (-) strand; PAM type: NRG; PAM sequence: AGG
cagccgacaaggtgtcaaga

SEQ ID NO: 79118 - DNA, 20 bp, Artificial Sequence
  Description of Artificial Sequence: Synthetic oligonucleotide
  Target: ATXN1; (-) strand; PAM type: NRG; PAM sequence: AAG
gcagccgacaaggtgtcaag

SEQ ID NO: 79119 - DNA, 20 bp, Artificial Sequence
  Description of Artificial Sequence: Synthetic oligonucleotide
  Target: ATXN1; (-) strand; PAM type: NRG; PAM sequence: AAG
agagcagccgacaaggtgtc

SEQ ID NO: 79120 - DNA, 20 bp, Artificial Sequence
  Description of Artificial Sequence: Synthetic oligonucleotide
  Target: ATXN1; (-) strand; PAM type: NRG; PAM sequence: AGG
gtctgtgagagcagccgaca

SEQ ID NO: 79121 - DNA, 20 bp, Artificial Sequence
  Description of Artificial Sequence: Synthetic oligonucleotide
  Target: ATXN1; (-) strand; PAM type: NRG; PAM sequence: AAG
ggtctgtgagagcagccgac

SEQ ID NO: 79122 - DNA, 20 bp, Artificial Sequence
  Description of Artificial Sequence: Synthetic oligonucleotide
  Target: ATXN1; (-) strand; PAM type: NRG; PAM sequence: CAG
ctgaagcaggtctgtgagag

SEQ ID NO: 79123 - DNA, 20 bp, Artificial Sequence
  Description of Artificial Sequence: Synthetic oligonucleotide
  Target: ATXN1; (-) strand; PAM type: NRG; PAM sequence: GAG
agactgaagcaggtctgtga

SEQ ID NO: 79124 - DNA, 20 bp, Artificial Sequence
  Description of Artificial Sequence: Synthetic oligonucleotide
  Target: ATXN1; (-) strand; PAM type: NRG; PAM sequence: GAG
tgagactgaagcaggtctgt

SEQ ID NO: 79125 - DNA, 20 bp, Artificial Sequence
  Description of Artificial Sequence: Synthetic oligonucleotide
  Target: ATXN1; (-) strand; PAM type: NRG; PAM sequence: AGG
ctgggctctgagactgaagc

SEQ ID NO: 79126 - DNA, 20 bp, Artificial Sequence
  Description of Artificial Sequence: Synthetic oligonucleotide
  Target: ATXN1; (-) strand; PAM type: NRG; PAM sequence: CAG
tctgggctctgagactgaag

SEQ ID NO: 79127 - DNA, 20 bp, Artificial Sequence
  Description of Artificial Sequence: Synthetic oligonucleotide
  Target: ATXN1; (-) strand; PAM type: NRG; PAM sequence: AAG
ttgtctgggctctgagactg

SEQ ID NO: 79128 - DNA, 20 bp, Artificial Sequence
  Description of Artificial Sequence: Synthetic oligonucleotide
  Target: ATXN1; (-) strand; PAM type: NRG; PAM sequence: GAG
agtgctattgtctgggctct

SEQ ID NO: 79129 - DNA, 20 bp, Artificial Sequence
  Description of Artificial Sequence: Synthetic oligonucleotide
  Target: ATXN1; (-) strand; PAM type: NRG; PAM sequence: GGG
cgtgtttagtgctattgtct

SEQ ID NO: 79130 - DNA, 20 bp, Artificial Sequence
  Description of Artificial Sequence: Synthetic oligonucleotide
  Target: ATXN1; (-) strand; PAM type: NRG; PAM sequence: TGG
ccgtgtttagtgctattgtc

SEQ ID NO: 79131 - DNA, 20 bp, Artificial Sequence
  Description of Artificial Sequence: Synthetic oligonucleotide
  Target: ATXN1; (-) strand; PAM type: NRG; PAM sequence: TAG
gctaacgcccttgccgtgtt

SEQ ID NO: 79132 - DNA, 20 bp, Artificial Sequence
  Description of Artificial Sequence: Synthetic oligonucleotide
  Target: ATXN1; (-) strand; PAM type: NRG; PAM sequence: CAG
cagccaatttcagcctcttg

SEQ ID NO: 79133 - DNA, 20 bp, Artificial Sequence
  Description of Artificial Sequence: Synthetic oligonucleotide
  Target: ATXN1; (-) strand; PAM type: NRG; PAM sequence: CAG
atttcaggttcagccaattt

SEQ ID NO: 79134 - DNA, 20 bp, Artificial Sequence
  Description of Artificial Sequence: Synthetic oligonucleotide
  Target: ATXN1; (-) strand; PAM type: NRG; PAM sequence: CAG
ctttactcatatttcaggtt

SEQ ID NO: 79135 - DNA, 20 bp, Artificial Sequence
  Description of Artificial Sequence: Synthetic oligonucleotide
  Target: ATXN1; (-) strand; PAM type: NRG; PAM sequence: AGG
aaagactttactcatatttc

SEQ ID NO: 79136 - DNA, 20 bp, Artificial Sequence
  Description of Artificial Sequence: Synthetic oligonucleotide
  Target: ATXN1; (-) strand; PAM type: NRG; PAM sequence: CAG
caaagactttactcatattt

SEQ ID NO: 79137 - DNA, 20 bp, Artificial Sequence
  Description of Artificial Sequence: Synthetic oligonucleotide
  Target: ATXN1; (-) strand; PAM type: NRG; PAM sequence: AAG
atttctgttttgcatataca

SEQ ID NO: 79138 - DNA, 20 bp, Artificial Sequence
  Description of Artificial Sequence: Synthetic oligonucleotide
  Target: ATXN1; (-) strand; PAM type: NRG; PAM sequence: GGG
aatagttgtgtctcctttta

SEQ ID NO: 79139 - DNA, 20 bp, Artificial Sequence
  Description of Artificial Sequence: Synthetic oligonucleotide
  Target: ATXN1; (-) strand; PAM type: NRG; PAM sequence: AGG
aaatagttgtgtctcctttt

SEQ ID NO: 79140 - DNA, 20 bp, Artificial Sequence
  Description of Artificial Sequence: Synthetic oligonucleotide
  Target: ATXN1; (-) strand; PAM type: NRG; PAM sequence: TAG
taaatagttgtgtctccttt

SEQ ID NO: 79141 - DNA, 20 bp, Artificial Sequence
  Description of Artificial Sequence: Synthetic oligonucleotide
  Target: ATXN1; (-) strand; PAM type: NRG; PAM sequence: TAG
gtatgcacctttttgataaa

SEQ ID NO: 79142 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccgccgggcc

SEQ ID NO: 79143 - DNA, 20 bp, Artificial Sequence
  Description of Artificial Sequence: Synthetic oligonucleotide
  Target: ATXN1; (-) strand; PAM type: NRG; PAM sequence: GGG
gattacaggcatgagccgcc

SEQ ID NO: 79144 - DNA, 20 bp, Artificial Sequence
  Description of Artificial Sequence: Synthetic oligonucleotide
  Target: ATXN1; (-) strand; PAM type: NRG; PAM sequence: CGG
ggattacaggcatgagccgc

SEQ ID NO: 79145 - DNA, 20 bp, Artificial Sequence
  Description of Artificial Sequence: Synthetic oligonucleotide
  Target: ATXN1; (-) strand; PAM type: NRG; PAM sequence: GAG
agtgttgggattacaggcat

SEQ ID NO: 79146 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgttgggattac

SEQ ID NO: 79147 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgttgggatta

SEQ ID NO: 79148 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgtt

SEQ ID NO: 79149 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgt

SEQ ID NO: 79150 - DNA, 20 bp, Artificial Sequence
  Description of Artificial Sequence: Synthetic oligonucleotide
  Target: ATXN1; (-) strand; PAM type: NRG; PAM sequence: AAG
ccacctgccttggcctccca

SEQ ID NO: 79151 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgatccacctgcct

SEQ ID NO: 79152 - DNA, 20 bp, Artificial Sequence
  Description of Artificial Sequence: Synthetic oligonucleotide
  Target: ATXN1; (-) strand; PAM type: NRG; PAM sequence: AGG
ggtcttgaactcctgacctc

SEQ ID NO: 79153 - DNA, 20 bp, Artificial Sequence
  Description of Artificial Sequence: Synthetic oligonucleotide
  Target: ATXN1; (-) strand; PAM type: NRG; PAM sequence: CAG
tggtcttgaactcctgacct

SEQ ID NO: 79154 - DNA, 20 bp, Artificial Sequence
  Description of Artificial Sequence: Synthetic oligonucleotide
  Target: ATXN1; (-) strand; PAM type: NRG; PAM sequence: TGG
attctccatgttggccaggg

SEQ ID NO: 79155 - DNA, 20 bp, Artificial Sequence
  Description of Artificial Sequence: Synthetic oligonucleotide
  Target: ATXN1; (-) strand; PAM type: NRG; PAM sequence: GGG
ggcattctccatgttggcca

SEQ ID NO: 79156 - DNA, 20 bp, Artificial Sequence
  Description of Artificial Sequence: Synthetic oligonucleotide
  Target: ATXN1; (-) strand; PAM type: NRG; PAM sequence: AGG
cggcattctccatgttggcc

SEQ ID NO: 79157 - DNA, 20 bp, Artificial Sequence
  Description of Artificial Sequence: Synthetic oligonucleotide
  Target: ATXN1; (-) strand; PAM type: NRG; PAM sequence: CAG
acggcattctccatgttggc

SEQ ID NO: 79158 - DNA, 20 bp, Artificial Sequence
  Description of Artificial Sequence: Synthetic oligonucleotide
  Target: ATXN1; (-) strand; PAM type: NRG; PAM sequence: TGG
agagacggcattctccatgt

SEQ ID NO: 79159 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 79160 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 79161 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 79162 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 79163 - DNA, 20 bp, Artificial Sequence
  Description of Artificial Sequence: Synthetic oligonucleotide
  Target: ATXN1; (-) strand; PAM type: NRG; PAM sequence: CAG
caggtgtgcaccaccacacc

SEQ ID NO: 79164 - DNA, 20 bp, Artificial Sequence
  Description of Artificial Sequence: Synthetic oligonucleotide
  Target: ATXN1; (-) strand; PAM type: NRG; PAM sequence: AGG
tccctagtagctgggattac

SEQ ID NO: 79165 - DNA, 20 bp, Artificial Sequence
  Description of Artificial Sequence: Synthetic oligonucleotide
  Target: ATXN1; (-) strand; PAM type: NRG; PAM sequence: CAG
ctccctagtagctgggatta

SEQ ID NO: 79166 - DNA, 20 bp, Artificial Sequence
  Description of Artificial Sequence: Synthetic oligonucleotide
  Target: ATXN1; (-) strand; PAM type: NRG; PAM sequence: GGG
cctcagcctccctagtagct

SEQ ID NO: 79167 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctccctagtagc

SEQ ID NO: 79168 - DNA, 20 bp, Artificial Sequence
  Description of Artificial Sequence: Synthetic oligonucleotide
  Target: ATXN1; (-) strand; PAM type: NRG; PAM sequence: TAG
tcaagcctcagcctccctag

SEQ ID NO: 79169 - DNA, 20 bp, Artificial Sequence
  Description of Artificial Sequence: Synthetic oligonucleotide
  Target: ATXN1; (-) strand; PAM type: NRG; PAM sequence: TAG
ggttcaagcctcagcctccc

SEQ ID NO: 79170 - DNA, 20 bp, Artificial Sequence
  Description of Artificial Sequence: Synthetic oligonucleotide
  Target: ATXN1; (-) strand; PAM type: NRG; PAM sequence: CAG
tgcctcccgggttcaagcct

SEQ ID NO: 79171 - DNA, 20 bp, Artificial Sequence
  Description of Artificial Sequence: Synthetic oligonucleotide
  Target: ATXN1; (-) strand; PAM type: NRG; PAM sequence: AAG
ctccattgcctcccgggttc

SEQ ID NO: 79172 - DNA, 20 bp, Artificial Sequence
  Description of Artificial Sequence: Synthetic oligonucleotide
  Target: ATXN1; (-) strand; PAM type: NRG; PAM sequence: GGG
tgcaacctccattgcctccc

SEQ ID NO: 79173 - DNA, 20 bp, Artificial Sequence
  Description of Artificial Sequence: Synthetic oligonucleotide
  Target: ATXN1; (-) strand; PAM type: NRG; PAM sequence: CGG
ctgcaacctccattgcctcc

SEQ ID NO: 79174 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggcacgatct

SEQ ID NO: 79175 - DNA, 20 bp, Artificial Sequence
  Description of Artificial Sequence: Synthetic oligonucleotide
  Target: ATXN1; (-) strand; PAM type: NRG; PAM sequence: TGG
tctcccaggctggagtgcag

SEQ ID NO: 79176 - DNA, 20 bp, Artificial Sequence
  Description of Artificial Sequence: Synthetic oligonucleotide
  Target: ATXN1; (-) strand; PAM type: NRG; PAM sequence: CAG
ctgtctcccaggctggagtg

SEQ ID NO: 79177 - DNA, 20 bp, Artificial Sequence
  Description of Artificial Sequence: Synthetic oligonucleotide
  Target: ATXN1; (-) strand; PAM type: NRG; PAM sequence: GAG
tcgctctgtctcccaggctg

SEQ ID NO: 79178 - DNA, 20 bp, Artificial Sequence
  Description of Artificial Sequence: Synthetic oligonucleotide
  Target: ATXN1; (-) strand; PAM type: NRG; PAM sequence: TGG
tctcgctctgtctcccaggc

SEQ ID NO: 79179 - DNA, 20 bp, Artificial Sequence
  Description of Artificial Sequence: Synthetic oligonucleotide
  Target: ATXN1; (-) strand; PAM type: NRG; PAM sequence: AGG
ggaatctcgctctgtctccc

SEQ ID NO: 79180 - DNA, 20 bp, Artificial Sequence
  Description of Artificial Sequence: Synthetic oligonucleotide
  Target: ATXN1; (-) strand; PAM type: NRG; PAM sequence: CAG
tggaatctcgctctgtctcc

SEQ ID NO: 79181 - DNA, 20 bp, Artificial Sequence
  Description of Artificial Sequence: Synthetic oligonucleotide
  Target: ATXN1; (-) strand; PAM type: NRG; PAM sequence: TGG
tttgttttttgtttttgaga

SEQ ID NO: 79182 - DNA, 20 bp, Artificial Sequence
  Description of Artificial Sequence: Synthetic oligonucleotide
  Target: ATXN1; (-) strand; PAM type: NRG; PAM sequence: GAG
attctttgttttttgttttt

SEQ ID NO: 79183 - DNA, 20 bp, Artificial Sequence
  Description of Artificial Sequence: Synthetic oligonucleotide
  Target: ATXN1; (-) strand; PAM type: NRG; PAM sequence: GGG
gagcatcttttcttcttttc

SEQ ID NO: 79184 - DNA, 20 bp, Artificial Sequence
  Description of Artificial Sequence: Synthetic oligonucleotide
  Target: ATXN1; (-) strand; PAM type: NRG; PAM sequence: CGG
agagcatcttttcttctttt

SEQ ID NO: 79185 - DNA, 20 bp, Artificial Sequence
  Description of Artificial Sequence: Synthetic oligonucleotide
  Target: ATXN1; (-) strand; PAM type: NRG; PAM sequence: GAG
tatttatttatttttgcata

SEQ ID NO: 79186 - DNA, 20 bp, Artificial Sequence
  Description of Artificial Sequence: Synthetic oligonucleotide
  Target: ATXN1; (-) strand; PAM type: NRG; PAM sequence: TAG
tttatttatttatttttgca

SEQ ID NO: 79187 - DNA, 20 bp, Artificial Sequence
  Description of Artificial Sequence: Synthetic oligonucleotide
  Target: ATXN1; (-) strand; PAM type: NRG; PAM sequence: CAG
tatcatctgctgctagttct

SEQ ID NO: 79188 - DNA, 20 bp, Artificial Sequence
  Description of Artificial Sequence: Synthetic oligonucleotide
  Target: ATXN1; (-) strand; PAM type: NRG; PAM sequence: TAG
ttctgcctatcatctgctgc

SEQ ID NO: 79189 - DNA, 20 bp, Artificial Sequence
  Description of Artificial Sequence: Synthetic oligonucleotide
  Target: ATXN1; (-) strand; PAM type: NRG; PAM sequence: AAG
agccagtgtgcctgacacca

SEQ ID NO: 79190 - DNA, 20 bp, Artificial Sequence
  Description of Artificial Sequence: Synthetic oligonucleotide
  Target: ATXN1; (-) strand; PAM type: NRG; PAM sequence: CAG
tggaggctagaattcaaagc

SEQ ID NO: 79191 - DNA, 20 bp, Artificial Sequence
  Description of Artificial Sequence: Synthetic oligonucleotide
  Target: ATXN1; (-) strand; PAM type: NRG; PAM sequence: AAG
gtggtggaggctagaattca

SEQ ID NO: 79192 - DNA, 20 bp, Artificial Sequence
  Description of Artificial Sequence: Synthetic oligonucleotide
  Target: ATXN1; (-) strand; PAM type: NRG; PAM sequence: TAG
agcttgtgggtggtggaggc

SEQ ID NO: 79193 - DNA, 20 bp, Artificial Sequence
  Description of Artificial Sequence: Synthetic oligonucleotide
  Target: ATXN1; (-) strand; PAM type: NRG; PAM sequence: AGG
acccagcttgtgggtggtgg

SEQ ID NO: 79194 - DNA, 20 bp, Artificial Sequence
  Description of Artificial Sequence: Synthetic oligonucleotide
  Target: ATXN1; (-) strand; PAM type: NRG; PAM sequence: GAG
tacccagcttgtgggtggtg

SEQ ID NO: 79195 - DNA, 20 bp, Artificial Sequence
  Description of Artificial Sequence: Synthetic oligonucleotide
  Target: ATXN1; (-) strand; PAM type: NRG; PAM sequence: TGG
tttacccagcttgtgggtgg

SEQ ID NO: 79196 - DNA, 20 bp, Artificial Sequence
  Description of Artificial Sequence: Synthetic oligonucleotide
  Target: ATXN1; (-) strand; PAM type: NRG; PAM sequence: TGG
acatttacccagcttgtggg

SEQ ID NO: 79197 - DNA, 20 bp, Artificial Sequence
  Description of Artificial Sequence: Synthetic oligonucleotide
  Target: ATXN1; (-) strand; PAM type: NRG; PAM sequence: GGG
cccacatttacccagcttgt

SEQ ID NO: 79198 - DNA, 20 bp, Artificial Sequence
  Description of Artificial Sequence: Synthetic oligonucleotide
  Target: ATXN1; (-) strand; PAM type: NRG; PAM sequence: TGG
gcccacatttacccagcttg

SEQ ID NO: 79199 - DNA, 20 bp, Artificial Sequence
  Description of Artificial Sequence: Synthetic oligonucleotide
  Target: ATXN1; (-) strand; PAM type: NRG; PAM sequence: CAG
actactcgcccacatttacc

SEQ ID NO: 79200 - DNA, 20 bp, Artificial Sequence
  Description of Artificial Sequence: Synthetic oligonucleotide
  Target: ATXN1; (-) strand; PAM type: NRG; PAM sequence: TAG
taaaaatggtggcactcaga

SEQ ID NO: 79201 - DNA, 20 bp, Artificial Sequence
  Description of Artificial Sequence: Synthetic oligonucleotide
  Target: ATXN1; (-) strand; PAM type: NRG; PAM sequence: CAG
tttttaaaaatggtggcact

SEQ ID NO: 79202 - DNA, 20 bp, Artificial Sequence
  Description of Artificial Sequence: Synthetic oligonucleotide
  Target: ATXN1; (-) strand; PAM type: NRG; PAM sequence: TGG
ctacagatttttaaaaatgg

SEQ ID NO: 79203 - DNA, 20 bp, Artificial Sequence
  Description of Artificial Sequence: Synthetic oligonucleotide
  Target: ATXN1; (-) strand; PAM type: NRG; PAM sequence: TGG
attctacagatttttaaaaa

SEQ ID NO: 79204 - DNA, 20 bp, Artificial Sequence
  Description of Artificial Sequence: Synthetic oligonucleotide
  Target: ATXN1; (-) strand; PAM type: NRG; PAM sequence: CAG
ttattgctgttactattcta

SEQ ID NO: 79205 - DNA, 20 bp, Artificial Sequence
  Description of Artificial Sequence: Synthetic oligonucleotide
  Target: ATXN1; (-) strand; PAM type: NRG; PAM sequence: TAG
agcccaacaactctttgagg

SEQ ID NO: 79206 - DNA, 20 bp, Artificial Sequence
  Description of Artificial Sequence: Synthetic oligonucleotide
  Target: ATXN1; (-) strand; PAM type: NRG; PAM sequence: AGG
attagcccaacaactctttg

SEQ ID NO: 79207 - DNA, 20 bp, Artificial Sequence
  Description of Artificial Sequence: Synthetic oligonucleotide
  Target: ATXN1; (-) strand; PAM type: NRG; PAM sequence: GAG
aattagcccaacaactcttt

SEQ ID NO: 79208 - DNA, 20 bp, Artificial Sequence
  Description of Artificial Sequence: Synthetic oligonucleotide
  Target: ATXN1; (-) strand; PAM type: NRG; PAM sequence: TAG
aagtgaatgaatgcctgaat

SEQ ID NO: 79209 - DNA, 20 bp, Artificial Sequence
  Description of Artificial Sequence: Synthetic oligonucleotide
  Target: ATXN1; (-) strand; PAM type: NRG; PAM sequence: AAG
gatcataatcagtgatcatc

SEQ ID NO: 79210 - DNA, 20 bp, Artificial Sequence
  Description of Artificial Sequence: Synthetic oligonucleotide
  Target: ATXN1; (-) strand; PAM type: NRG; PAM sequence: CAG
agaagctcactgatcataat

SEQ ID NO: 79211 - DNA, 20 bp, Artificial Sequence
  Description of Artificial Sequence: Synthetic oligonucleotide
  Target: ATXN1; (-) strand; PAM type: NRG; PAM sequence: AAG
actgggcctgtcacacctag

SEQ ID NO: 79212 - DNA, 20 bp, Artificial Sequence
  Description of Artificial Sequence: Synthetic oligonucleotide
  Target: ATXN1; (-) strand; PAM type: NRG; PAM sequence: TAG
aaaactgggcctgtcacacc

SEQ ID NO: 79213 - DNA, 20 bp, Artificial Sequence
  Description of Artificial Sequence: Synthetic oligonucleotide
  Target: ATXN1; (-) strand; PAM type: NRG; PAM sequence: GGG
tatttccagtgtttaaaact

SEQ ID NO: 79214 - DNA, 20 bp, Artificial Sequence
  Description of Artificial Sequence: Synthetic oligonucleotide
  Target: ATXN1; (-) strand; PAM type: NRG; PAM sequence: TGG
gtatttccagtgtttaaaac

SEQ ID NO: 79215 - DNA, 20 bp, Artificial Sequence
  Description of Artificial Sequence: Synthetic oligonucleotide
  Target: ATXN1; (-) strand; PAM type: NRG; PAM sequence: CAG
atctgtcacttgtgtatttc

SEQ ID NO: 79216 - DNA, 20 bp, Artificial Sequence
  Description of Artificial Sequence: Synthetic oligonucleotide
  Target: ATXN1; (-) strand; PAM type: NRG; PAM sequence: GAG
atgttaagtctgtggaagca

SEQ ID NO: 79217 - DNA, 20 bp, Artificial Sequence
  Description of Artificial Sequence: Synthetic oligonucleotide
  Target: ATXN1; (-) strand; PAM type: NRG; PAM sequence: CAG
tgatgttaagtctgtggaag

SEQ ID NO: 79218 - DNA, 20 bp, Artificial Sequence
  Description of Artificial Sequence: Synthetic oligonucleotide
  Target: ATXN1; (-) strand; PAM type: NRG; PAM sequence: AAG
gagtgatgttaagtctgtgg

SEQ ID NO: 79219 - DNA, 20 bp, Artificial Sequence
  Description of Artificial Sequence: Synthetic oligonucleotide
  Target: ATXN1; (-) strand; PAM type: NRG; PAM sequence: TGG
tgagagtgatgttaagtctg

SEQ ID NO: 79220 - DNA, 20 bp, Artificial Sequence
  Description of Artificial Sequence: Synthetic oligonucleotide
  Target: ATXN1; (-) strand; PAM type: NRG; PAM sequence: AAG
taaaatttgagagtgatgtt

SEQ ID NO: 79221 - DNA, 20 bp, Artificial Sequence
  Description of Artificial Sequence: Synthetic oligonucleotide
  Target: ATXN1; (-) strand; PAM type: NRG; PAM sequence: GAG
ctcatttcactaaaatttga

SEQ ID NO: 79222 - DNA, 20 bp, Artificial Sequence
  Description of Artificial Sequence: Synthetic oligonucleotide
  Target: ATXN1; (-) strand; PAM type: NRG; PAM sequence: GAG
ttctcatttcactaaaattt

SEQ ID NO: 79223 - DNA, 20 bp, Artificial Sequence
  Description of Artificial Sequence: Synthetic oligonucleotide
  Target: ATXN1; (-) strand; PAM type: NRG; PAM sequence: CGG
tcagtttttatccccttcac

SEQ ID NO: 79224 - DNA, 20 bp, Artificial Sequence
  Description of Artificial Sequence: Synthetic oligonucleotide
  Target: ATXN1; (-) strand; PAM type: NRG; PAM sequence: CAG
ctctaaaataacaccctcat

SEQ ID NO: 79225 - DNA, 20 bp, Artificial Sequence
  Description of Artificial Sequence: Synthetic oligonucleotide
  Target: ATXN1; (-) strand; PAM type: NRG; PAM sequence: GGG
gcaaacatgttcctccctca

SEQ ID NO: 79226 - DNA, 20 bp, Artificial Sequence
  Description of Artificial Sequence: Synthetic oligonucleotide
  Target: ATXN1; (-) strand; PAM type: NRG; PAM sequence: AGG
tgcaaacatgttcctccctc

SEQ ID NO: 79227 - DNA, 20 bp, Artificial Sequence
  Description of Artificial Sequence: Synthetic oligonucleotide
  Target: ATXN1; (-) strand; PAM type: NRG; PAM sequence: CAG
atgcaaacatgttcctccct

SEQ ID NO: 79228 - DNA, 20 bp, Artificial Sequence
  Description of Artificial Sequence: Synthetic oligonucleotide
  Target: ATXN1; (-) strand; PAM type: NRG; PAM sequence: AAG
ggttttatgagccctgagct

SEQ ID NO: 79229 - DNA, 20 bp, Artificial Sequence
  Description of Artificial Sequence: Synthetic oligonucleotide
  Target: ATXN1; (-) strand; PAM type: NRG; PAM sequence: GAG
cacatggttttatgagccct

SEQ ID NO: 79230 - DNA, 20 bp, Artificial Sequence
  Description of Artificial Sequence: Synthetic oligonucleotide
  Target: ATXN1; (-) strand; PAM type: NRG; PAM sequence: GAG
cctagagcacatggttttat

SEQ ID NO: 79231 - DNA, 20 bp, Artificial Sequence
  Description of Artificial Sequence: Synthetic oligonucleotide
  Target: ATXN1; (-) strand; PAM type: NRG; PAM sequence: TGG
tcaccatctcctagagcaca

SEQ ID NO: 79232 - DNA, 20 bp, Artificial Sequence
  Description of Artificial Sequence: Synthetic oligonucleotide
  Target: ATXN1; (-) strand; PAM type: NRG; PAM sequence: GAG
atcatcatcaccatctccta

SEQ ID NO: 79233 - DNA, 20 bp, Artificial Sequence
  Description of Artificial Sequence: Synthetic oligonucleotide
  Target: ATXN1; (-) strand; PAM type: NRG; PAM sequence: TAG
tcatcatcatcaccatctcc

SEQ ID NO: 79234 - DNA, 20 bp, Artificial Sequence
  Description of Artificial Sequence: Synthetic oligonucleotide
  Target: ATXN1; (-) strand; PAM type: NRG; PAM sequence: TGG
aaccaccaccaccaccacca

SEQ ID NO: 79235 - DNA, 20 bp, Artificial Sequence
  Description of Artificial Sequence: Synthetic oligonucleotide
  Target: ATXN1; (-) strand; PAM type: NRG; PAM sequence: GAG
gcttgtttggttatcgttat

SEQ ID NO: 79236 - DNA, 20 bp, Artificial Sequence
  Description of Artificial Sequence: Synthetic oligonucleotide
  Target: ATXN1; (-) strand; PAM type: NRG; PAM sequence: TGG
ccttgtactctttgcttgtt

SEQ ID NO: 79237 - DNA, 20 bp, Artificial Sequence
  Description of Artificial Sequence: Synthetic oligonucleotide
  Target: ATXN1; (-) strand; PAM type: NRG; PAM sequence: GGG
ttcatttctttacttaatgt

SEQ ID NO: 79238 - DNA, 20 bp, Artificial Sequence
  Description of Artificial Sequence: Synthetic oligonucleotide
  Target: ATXN1; (-) strand; PAM type: NRG; PAM sequence: TGG
gttcatttctttacttaatg

SEQ ID NO: 79239 - DNA, 20 bp, Artificial Sequence
  Description of Artificial Sequence: Synthetic oligonucleotide
  Target: ATXN1; (-) strand; PAM type: NRG; PAM sequence: CAG
gtgttcgatactaattttgt

SEQ ID NO: 79240 - DNA, 20 bp, Artificial Sequence
  Description of Artificial Sequence: Synthetic oligonucleotide
  Target: ATXN1; (-) strand; PAM type: NRG; PAM sequence: TAG
aaattagtcaagattctaat

SEQ ID NO: 79241 - DNA, 20 bp, Artificial Sequence
  Description of Artificial Sequence: Synthetic oligonucleotide
  Target: ATXN1; (-) strand; PAM type: NRG; PAM sequence: AAG
ttaataaatgaaaattagtc

SEQ ID NO: 79242 - DNA, 20 bp, Artificial Sequence
  Description of Artificial Sequence: Synthetic oligonucleotide
  Target: ATXN1; (-) strand; PAM type: NRG; PAM sequence: TAG
agtctttaataaatgaaaat

SEQ ID NO: 79243 - DNA, 20 bp, Artificial Sequence
  Description of Artificial Sequence: Synthetic oligonucleotide
  Target: ATXN1; (-) strand; PAM type: NRG; PAM sequence: CAG
tataactaaaaatagaactg

SEQ ID NO: 79244 - DNA, 20 bp, Artificial Sequence
  Description of Artificial Sequence: Synthetic oligonucleotide
  Target: ATXN1; (-) strand; PAM type: NRG; PAM sequence: TAG
ttgaaggatataactaaaaa

SEQ ID NO: 79245 - DNA, 20 bp, Artificial Sequence
  Description of Artificial Sequence: Synthetic oligonucleotide
  Target: ATXN1; (-) strand; PAM type: NRG; PAM sequence: AGG
cttgaatgatgttagattga

SEQ ID NO: 79246 - DNA, 20 bp, Artificial Sequence
  Description of Artificial Sequence: Synthetic oligonucleotide
  Target: ATXN1; (-) strand; PAM type: NRG; PAM sequence: AAG
tcttgaatgatgttagattg

SEQ ID NO: 79247 - DNA, 20 bp, Artificial Sequence
  Description of Artificial Sequence: Synthetic oligonucleotide
  Target: ATXN1; (-) strand; PAM type: NRG; PAM sequence: TAG
aagcttttcttgaatgatgt

SEQ ID NO: 79248 - DNA, 20 bp, Artificial Sequence
  Description of Artificial Sequence: Synthetic oligonucleotide
  Target: ATXN1; (-) strand; PAM type: NRG; PAM sequence: AAG
gaaatagaatttttggagag

SEQ ID NO: 79249 - DNA, 20 bp, Artificial Sequence
  Description of Artificial Sequence: Synthetic oligonucleotide
  Target: ATXN1; (-) strand; PAM type: NRG; PAM sequence: GAG
cctgaaatagaatttttgga

SEQ ID NO: 79250 - DNA, 20 bp, Artificial Sequence
  Description of Artificial Sequence: Synthetic oligonucleotide
  Target: ATXN1; (-) strand; PAM type: NRG; PAM sequence: GAG
ttcctgaaatagaatttttg

SEQ ID NO: 79251 - DNA, 20 bp, Artificial Sequence
  Description of Artificial Sequence: Synthetic oligonucleotide
  Target: ATXN1; (-) strand; PAM type: NRG; PAM sequence: TGG
cattcctgaaatagaatttt

SEQ ID NO: 79252 - DNA, 20 bp, Artificial Sequence
  Description of Artificial Sequence: Synthetic oligonucleotide
  Target: ATXN1; (-) strand; PAM type: NRG; PAM sequence: TAG
aaaaatttacattcctgaaa

SEQ ID NO: 79253 - DNA, 20 bp, Artificial Sequence
  Description of Artificial Sequence: Synthetic oligonucleotide
  Target: ATXN1; (-) strand; PAM type: NRG; PAM sequence: CAG
gtaaaaagaaatcatgcatg

SEQ ID NO: 79254 - DNA, 20 bp, Artificial Sequence
  Description of Artificial Sequence: Synthetic oligonucleotide
  Target: ATXN1; (-) strand; PAM type: NRG; PAM sequence: AAG
cagaaagatggctgggtaaa

SEQ ID NO: 79255 - DNA, 20 bp, Artificial Sequence
  Description of Artificial Sequence: Synthetic oligonucleotide
  Target: ATXN1; (-) strand; PAM type: NRG; PAM sequence: GGG
aaaccaacagaaagatggct

SEQ ID NO: 79256 - DNA, 20 bp, Artificial Sequence
  Description of Artificial Sequence: Synthetic oligonucleotide
  Target: ATXN1; (-) strand; PAM type: NRG; PAM sequence: TGG
aaaaccaacagaaagatggc

SEQ ID NO: 79257 - DNA, 20 bp, Artificial Sequence
  Description of Artificial Sequence: Synthetic oligonucleotide
  Target: ATXN1; (-) strand; PAM type: NRG; PAM sequence: TGG
gctaaaaaccaacagaaaga

SEQ ID NO: 79258 - DNA, 20 bp, Artificial Sequence
  Description of Artificial Sequence: Synthetic oligonucleotide
  Target: ATXN1; (-) strand; PAM type: NRG; PAM sequence: AAG
gcaggctaaaaaccaacaga

SEQ ID NO: 79259 - DNA, 20 bp, Artificial Sequence
  Description of Artificial Sequence: Synthetic oligonucleotide
  Target: ATXN1; (-) strand; PAM type: NRG; PAM sequence: CAG
actggcaggctaaaaaccaa

SEQ ID NO: 79260 - DNA, 20 bp, Artificial Sequence
  Description of Artificial Sequence: Synthetic oligonucleotide
  Target: ATXN1; (-) strand; PAM type: NRG; PAM sequence: AGG
atcacatacacactactggc

SEQ ID NO: 79261 - DNA, 20 bp, Artificial Sequence
  Description of Artificial Sequence: Synthetic oligonucleotide
  Target: ATXN1; (-) strand; PAM type: NRG; PAM sequence: CAG
tatcacatacacactactgg

SEQ ID NO: 79262 - DNA, 20 bp, Artificial Sequence
  Description of Artificial Sequence: Synthetic oligonucleotide
  Target: ATXN1; (-) strand; PAM type: NRG; PAM sequence: TGG
aaatatcacatacacactac

SEQ ID NO: 79263 - DNA, 20 bp, Artificial Sequence
  Description of Artificial Sequence: Synthetic oligonucleotide
  Target: ATXN1; (-) strand; PAM type: NRG; PAM sequence: AAG
ttctaagtaccctgcatagt

SEQ ID NO: 79264 - DNA, 20 bp, Artificial Sequence
  Description of Artificial Sequence: Synthetic oligonucleotide
  Target: ATXN1; (-) strand; PAM type: NRG; PAM sequence: TAG
aaatttctaagtaccctgca

SEQ ID NO: 79265 - DNA, 20 bp, Artificial Sequence
  Description of Artificial Sequence: Synthetic oligonucleotide
  Target: ATXN1; (-) strand; PAM type: NRG; PAM sequence: AAG
aatgctcatatgaaatttct

SEQ ID NO: 79266 - DNA, 20 bp, Artificial Sequence
  Description of Artificial Sequence: Synthetic oligonucleotide
  Target: ATXN1; (-) strand; PAM type: NRG; PAM sequence: CAG
catgtggaaatgaaagctac

SEQ ID NO: 79267 - DNA, 20 bp, Artificial Sequence
  Description of Artificial Sequence: Synthetic oligonucleotide
  Target: ATXN1; (-) strand; PAM type: NRG; PAM sequence: AAG
gagagtacatgtggaaatga

SEQ ID NO: 79268 - DNA, 20 bp, Artificial Sequence
  Description of Artificial Sequence: Synthetic oligonucleotide
  Target: ATXN1; (-) strand; PAM type: NRG; PAM sequence: TGG
ctctgttctgagagtacatg

SEQ ID NO: 79269 - DNA, 20 bp, Artificial Sequence
  Description of Artificial Sequence: Synthetic oligonucleotide
  Target: ATXN1; (-) strand; PAM type: NRG; PAM sequence: GAG
ctcgtttttctctgttctga

SEQ ID NO: 79270 - DNA, 20 bp, Artificial Sequence
  Description of Artificial Sequence: Synthetic oligonucleotide
  Target: ATXN1; (-) strand; PAM type: NRG; PAM sequence: GAG
aactcgtttttctctgttct

SEQ ID NO: 79271 - DNA, 20 bp, Artificial Sequence
  Description of Artificial Sequence: Synthetic oligonucleotide
  Target: ATXN1; (-) strand; PAM type: NRG; PAM sequence: TAG
aagcttagaaagacatggat

SEQ ID NO: 79272 - DNA, 20 bp, Artificial Sequence
  Description of Artificial Sequence: Synthetic oligonucleotide
  Target: ATXN1; (-) strand; PAM type: NRG; PAM sequence: TGG
gctagaagcttagaaagaca

SEQ ID NO: 79273 - DNA, 20 bp, Artificial Sequence
  Description of Artificial Sequence: Synthetic oligonucleotide
  Target: ATXN1; (-) strand; PAM type: NRG; PAM sequence: AAG
aaaaaggctagaagcttaga

SEQ ID NO: 79274 - DNA, 20 bp, Artificial Sequence
  Description of Artificial Sequence: Synthetic oligonucleotide
  Target: ATXN1; (-) strand; PAM type: NRG; PAM sequence: TAG
aaaaaaaaaggctagaagct

SEQ ID NO: 79275 - DNA, 20 bp, Artificial Sequence
  Description of Artificial Sequence: Synthetic oligonucleotide
  Target: ATXN1; (-) strand; PAM type: NRG; PAM sequence: AAG
agttaaaaaaaaaaggctag

SEQ ID NO: 79276 - DNA, 20 bp, Artificial Sequence
  Description of Artificial Sequence: Synthetic oligonucleotide
  Target: ATXN1; (-) strand; PAM type: NRG; PAM sequence: TAG
gacagttaaaaaaaaaaggc

SEQ ID NO: 79277 - DNA, 20 bp, Artificial Sequence
  Description of Artificial Sequence: Synthetic oligonucleotide
  Target: ATXN1; (-) strand; PAM type: NRG; PAM sequence: AGG
ctgagacagttaaaaaaaaa

SEQ ID NO: 79278 - DNA, 20 bp, Artificial Sequence
  Description of Artificial Sequence: Synthetic oligonucleotide
  Target: ATXN1; (-) strand; PAM type: NRG; PAM sequence: AAG
cctgagacagttaaaaaaaa

SEQ ID NO: 79279 - DNA, 20 bp, Artificial Sequence
  Description of Artificial Sequence: Synthetic oligonucleotide
  Target: ATXN1; (-) strand; PAM type: NRG; PAM sequence: CAG
agtggaatttcaccctgaga

SEQ ID NO: 79280 - DNA, 20 bp, Artificial Sequence
  Description of Artificial Sequence: Synthetic oligonucleotide
  Target: ATXN1; (-) strand; PAM type: NRG; PAM sequence: GAG
gtaaagtggaatttcaccct

SEQ ID NO: 79281 - DNA, 20 bp, Artificial Sequence
  Description of Artificial Sequence: Synthetic oligonucleotide
  Target: ATXN1; (-) strand; PAM type: NRG; PAM sequence: TGG
gcatcattaaacaagtaaag

SEQ ID NO: 79282 - DNA, 20 bp, Artificial Sequence
  Description of Artificial Sequence: Synthetic oligonucleotide
  Target: ATXN1; (-) strand; PAM type: NRG; PAM sequence: AAG
tatgcatcattaaacaagta

SEQ ID NO: 79283 - DNA, 20 bp, Artificial Sequence
  Description of Artificial Sequence: Synthetic oligonucleotide
  Target: ATXN1; (-) strand; PAM type: NRG; PAM sequence: AAG
aaaagtatgcatcattaaac

SEQ ID NO: 79284 - DNA, 20 bp, Artificial Sequence
  Description of Artificial Sequence: Synthetic oligonucleotide
  Target: ATXN1; (-) strand; PAM type: NRG; PAM sequence: AAG
ttatttttgtaaaatttcaa

SEQ ID NO: 79285 - DNA, 20 bp, Artificial Sequence
  Description of Artificial Sequence: Synthetic oligonucleotide
  Target: ATXN1; (-) strand; PAM type: NRG; PAM sequence: CAG
aagccaaaaaagttacgttg

SEQ ID NO: 79286 - DNA, 20 bp, Artificial Sequence
  Description of Artificial Sequence: Synthetic oligonucleotide
  Target: ATXN1; (-) strand; PAM type: NRG; PAM sequence: AAG
aacctgatatgaagccaaaa

SEQ ID NO: 79287 - DNA, 20 bp, Artificial Sequence
  Description of Artificial Sequence: Synthetic oligonucleotide
  Target: ATXN1; (-) strand; PAM type: NRG; PAM sequence: AAG
catttcagtaacctgatatg

SEQ ID NO: 79288 - DNA, 20 bp, Artificial Sequence
  Description of Artificial Sequence: Synthetic oligonucleotide
  Target: ATXN1; (-) strand; PAM type: NRG; PAM sequence: CAG
ggagcaatatagatacattt

SEQ ID NO: 79289 - DNA, 20 bp, Artificial Sequence
  Description of Artificial Sequence: Synthetic oligonucleotide
  Target: ATXN1; (-) strand; PAM type: NRG; PAM sequence: TAG
aaaactatataggagcaata

SEQ ID NO: 79290 - DNA, 20 bp, Artificial Sequence
  Description of Artificial Sequence: Synthetic oligonucleotide
  Target: ATXN1; (-) strand; PAM type: NRG; PAM sequence: GAG
aatgatctaaaactatatag

SEQ ID NO: 79291 - DNA, 20 bp, Artificial Sequence
  Description of Artificial Sequence: Synthetic oligonucleotide
  Target: ATXN1; (-) strand; PAM type: NRG; PAM sequence: AGG
tgaatgatctaaaactatat

SEQ ID NO: 79292 - DNA, 20 bp, Artificial Sequence
  Description of Artificial Sequence: Synthetic oligonucleotide
  Target: ATXN1; (-) strand; PAM type: NRG; PAM sequence: TAG
gtgaatgatctaaaactata

SEQ ID NO: 79293 - DNA, 20 bp, Artificial Sequence
  Description of Artificial Sequence: Synthetic oligonucleotide
  Target: ATXN1; (-) strand; PAM type: NRG; PAM sequence: AAG
agaacacaatacaacaatga

SEQ ID NO: 79294 - DNA, 20 bp, Artificial Sequence
  Description of Artificial Sequence: Synthetic oligonucleotide
  Target: ATXN1; (-) strand; PAM type: NRG; PAM sequence: CAG
attatgatatgatcaaatga

SEQ ID NO: 79295 - DNA, 20 bp, Artificial Sequence
  Description of Artificial Sequence: Synthetic oligonucleotide
  Target: ATXN1; (-) strand; PAM type: NRG; PAM sequence: AAG
aactacttgaatgtttatta

SEQ ID NO: 79296 - DNA, 20 bp, Artificial Sequence
  Description of Artificial Sequence: Synthetic oligonucleotide
  Target: ATXN1; (-) strand; PAM type: NRG; PAM sequence: TGG
agctttatttgtgttaataa

SEQ ID NO: 79297 - DNA, 20 bp, Artificial Sequence
  Description of Artificial Sequence: Synthetic oligonucleotide
  Target: ATXN1; (-) strand; PAM type: NRG; PAM sequence: CAG
gacatggaggctctccagca

SEQ ID NO: 79298 - DNA, 20 bp, Artificial Sequence
  Description of Artificial Sequence: Synthetic oligonucleotide
  Target: ATXN1; (-) strand; PAM type: NRG; PAM sequence: CAG
cacgagacatggaggctctc

SEQ ID NO: 79299 - DNA, 20 bp, Artificial Sequence
  Description of Artificial Sequence: Synthetic oligonucleotide
  Target: ATXN1; (-) strand; PAM type: NRG; PAM sequence: AGG
ctgtataccacgagacatgg

SEQ ID NO: 79300 - DNA, 20 bp, Artificial Sequence
  Description of Artificial Sequence: Synthetic oligonucleotide
  Target: ATXN1; (-) strand; PAM type: NRG; PAM sequence: GAG
actgtataccacgagacatg

SEQ ID NO: 79301 - DNA, 20 bp, Artificial Sequence
  Description of Artificial Sequence: Synthetic oligonucleotide
  Target: ATXN1; (-) strand; PAM type: NRG; PAM sequence: TGG
gtactgtataccacgagaca

SEQ ID NO: 79302 - DNA, 20 bp, Artificial Sequence
  Description of Artificial Sequence: Synthetic oligonucleotide
  Target: ATXN1; (-) strand; PAM type: NRG; PAM sequence: GAG
acttctgtactgtataccac

SEQ ID NO: 79303 - DNA, 20 bp, Artificial Sequence
  Description of Artificial Sequence: Synthetic oligonucleotide
  Target: ATXN1; (-) strand; PAM type: NRG; PAM sequence: GAG
ttccttctaggtgtttccta

SEQ ID NO: 79304 - DNA, 20 bp, Artificial Sequence
  Description of Artificial Sequence: Synthetic oligonucleotide
  Target: ATXN1; (-) strand; PAM type: NRG; PAM sequence: TAG
ttttccttctaggtgtttcc

SEQ ID NO: 79305 - DNA, 20 bp, Artificial Sequence
  Description of Artificial Sequence: Synthetic oligonucleotide
  Target: ATXN1; (-) strand; PAM type: NRG; PAM sequence: AGG
gactcagcaattttccttct

SEQ ID NO: 79306 - DNA, 20 bp, Artificial Sequence
  Description of Artificial Sequence: Synthetic oligonucleotide
  Target: ATXN1; (-) strand; PAM type: NRG; PAM sequence: TAG
tgactcagcaattttccttc

SEQ ID NO: 79307 - DNA, 20 bp, Artificial Sequence
  Description of Artificial Sequence: Synthetic oligonucleotide
  Target: ATXN1; (-) strand; PAM type: NRG; PAM sequence: CAG
aatgtgtataccctgtgact

SEQ ID NO: 79308 - DNA, 20 bp, Artificial Sequence
  Description of Artificial Sequence: Synthetic oligonucleotide
  Target: ATXN1; (-) strand; PAM type: NRG; PAM sequence: CAG
aaagacagttaggtattatc

SEQ ID NO: 79309 - DNA, 20 bp, Artificial Sequence
  Description of Artificial Sequence: Synthetic oligonucleotide
  Target: ATXN1; (-) strand; PAM type: NRG; PAM sequence: AGG
aaccatttagaaagacagtt

SEQ ID NO: 79310 - DNA, 20 bp, Artificial Sequence
  Description of Artificial Sequence: Synthetic oligonucleotide
  Target: ATXN1; (-) strand; PAM type: NRG; PAM sequence: TAG
caaccatttagaaagacagt

SEQ ID NO: 79311 - DNA, 20 bp, Artificial Sequence
  Description of Artificial Sequence: Synthetic oligonucleotide
  Target: ATXN1; (-) strand; PAM type: NRG; PAM sequence: CAG
ggtacaaccatttagaaaga

SEQ ID NO: 79312 - DNA, 20 bp, Artificial Sequence
  Description of Artificial Sequence: Synthetic oligonucleotide
  Target: ATXN1; (-) strand; PAM type: NRG; PAM sequence: AAG
cattggtacaaccatttaga

SEQ ID NO: 79313 - DNA, 20 bp, Artificial Sequence
  Description of Artificial Sequence: Synthetic oligonucleotide
  Target: ATXN1; (-) strand; PAM type: NRG; PAM sequence: TAG
tattcattggtacaaccatt

SEQ ID NO: 79314 - DNA, 20 bp, Artificial Sequence
  Description of Artificial Sequence: Synthetic oligonucleotide
  Target: ATXN1; (-) strand; PAM type: NRG; PAM sequence: TGG
ctgctgataggaatattcat

SEQ ID NO: 79315 - DNA, 20 bp, Artificial Sequence
  Description of Artificial Sequence: Synthetic oligonucleotide
  Target: ATXN1; (-) strand; PAM type: NRG; PAM sequence: AGG
catgtttatgtactgctgat

SEQ ID NO: 79316 - DNA, 20 bp, Artificial Sequence
  Description of Artificial Sequence: Synthetic oligonucleotide
  Target: ATXN1; (-) strand; PAM type: NRG; PAM sequence: TAG
tcatgtttatgtactgctga

SEQ ID NO: 79317 - DNA, 20 bp, Artificial Sequence
  Description of Artificial Sequence: Synthetic oligonucleotide
  Target: ATXN1; (-) strand; PAM type: NRG; PAM sequence: TGG
tttggtccaagtttgaaaaa

SEQ ID NO: 79318 - DNA, 20 bp, Artificial Sequence
  Description of Artificial Sequence: Synthetic oligonucleotide
  Target: ATXN1; (-) strand; PAM type: NRG; PAM sequence: AAG
agtaatgaatattttggtcc

SEQ ID NO: 79319 - DNA, 20 bp, Artificial Sequence
  Description of Artificial Sequence: Synthetic oligonucleotide
  Target: ATXN1; (-) strand; PAM type: NRG; PAM sequence: TGG
gttcccagtaatgaatattt

SEQ ID NO: 79320 - DNA, 20 bp, Artificial Sequence
  Description of Artificial Sequence: Synthetic oligonucleotide
  Target: ATXN1; (-) strand; PAM type: NRG; PAM sequence: CAG
tatttgagatctggagttcc

SEQ ID NO: 79321 - DNA, 20 bp, Artificial Sequence
  Description of Artificial Sequence: Synthetic oligonucleotide
  Target: ATXN1; (-) strand; PAM type: NRG; PAM sequence: GAG
cttgacttatttgagatctg

SEQ ID NO: 79322 - DNA, 20 bp, Artificial Sequence
  Description of Artificial Sequence: Synthetic oligonucleotide
  Target: ATXN1; (-) strand; PAM type: NRG; PAM sequence: TGG
cacttgacttatttgagatc

SEQ ID NO: 79323 - DNA, 20 bp, Artificial Sequence
  Description of Artificial Sequence: Synthetic oligonucleotide
  Target: ATXN1; (-) strand; PAM type: NRG; PAM sequence: GAG
aactgacacttgacttattt

SEQ ID NO: 79324 - DNA, 20 bp, Artificial Sequence
  Description of Artificial Sequence: Synthetic oligonucleotide
  Target: ATXN1; (-) strand; PAM type: NRG; PAM sequence: TGG
aaattgaccaaagcgataga

SEQ ID NO: 79325 - DNA, 20 bp, Artificial Sequence
  Description of Artificial Sequence: Synthetic oligonucleotide
  Target: ATXN1; (-) strand; PAM type: NRG; PAM sequence: TAG
tttgaaattgaccaaagcga

SEQ ID NO: 79326 - DNA, 20 bp, Artificial Sequence
  Description of Artificial Sequence: Synthetic oligonucleotide
  Target: ATXN1; (-) strand; PAM type: NRG; PAM sequence: AAG
gaacagtttgaaattgacca

SEQ ID NO: 79327 - DNA, 20 bp, Artificial Sequence
  Description of Artificial Sequence: Synthetic oligonucleotide
  Target: ATXN1; (-) strand; PAM type: NRG; PAM sequence: CAG
gtctggatttgttcaaagaa

SEQ ID NO: 79328 - DNA, 20 bp, Artificial Sequence
  Description of Artificial Sequence: Synthetic oligonucleotide
  Target: ATXN1; (-) strand; PAM type: NRG; PAM sequence: AAG
ttcaagtctggatttgttca

SEQ ID NO: 79329 - DNA, 20 bp, Artificial Sequence
  Description of Artificial Sequence: Synthetic oligonucleotide
  Target: ATXN1; (-) strand; PAM type: NRG; PAM sequence: TGG
aatggaaatttcttcaagtc

SEQ ID NO: 79330 - DNA, 20 bp, Artificial Sequence
  Description of Artificial Sequence: Synthetic oligonucleotide
  Target: ATXN1; (-) strand; PAM type: NRG; PAM sequence: AAG
aacagaatggaaatttcttc

SEQ ID NO: 79331 - DNA, 20 bp, Artificial Sequence
  Description of Artificial Sequence: Synthetic oligonucleotide
  Target: ATXN1; (-) strand; PAM type: NRG; PAM sequence: TGG
tggctagaaatttaacagaa

SEQ ID NO: 79332 - DNA, 20 bp, Artificial Sequence
  Description of Artificial Sequence: Synthetic oligonucleotide
  Target: ATXN1; (-) strand; PAM type: NRG; PAM sequence: CAG
tgagttggctagaaatttaa

SEQ ID NO: 79333 - DNA, 20 bp, Artificial Sequence
  Description of Artificial Sequence: Synthetic oligonucleotide
  Target: ATXN1; (-) strand; PAM type: NRG; PAM sequence: TAG
gttgattgtgatgagttggc

SEQ ID NO: 79334 - DNA, 20 bp, Artificial Sequence
  Description of Artificial Sequence: Synthetic oligonucleotide
  Target: ATXN1; (-) strand; PAM type: NRG; PAM sequence: TGG
cgtagttgattgtgatgagt

SEQ ID NO: 79335 - DNA, 20 bp, Artificial Sequence
  Description of Artificial Sequence: Synthetic oligonucleotide
  Target: ATXN1; (-) strand; PAM type: NRG; PAM sequence: GAG
cttgcgtagttgattgtgat

SEQ ID NO: 79336 - DNA, 20 bp, Artificial Sequence
  Description of Artificial Sequence: Synthetic oligonucleotide
  Target: ATXN1; (-) strand; PAM type: NRG; PAM sequence: TAG
tggggtattgtttgcttgcg

SEQ ID NO: 79337 - DNA, 20 bp, Artificial Sequence
  Description of Artificial Sequence: Synthetic oligonucleotide
  Target: ATXN1; (-) strand; PAM type: NRG; PAM sequence: GGG
tacttattgttgttcttatg

SEQ ID NO: 79338 - DNA, 20 bp, Artificial Sequence
  Description of Artificial Sequence: Synthetic oligonucleotide
  Target: ATXN1; (-) strand; PAM type: NRG; PAM sequence: GGG
ttacttattgttgttcttat

SEQ ID NO: 79339 - DNA, 20 bp, Artificial Sequence
  Description of Artificial Sequence: Synthetic oligonucleotide
  Target: ATXN1; (-) strand; PAM type: NRG; PAM sequence: TGG
attacttattgttgttctta

SEQ ID NO: 79340 - DNA, 20 bp, Artificial Sequence
  Description of Artificial Sequence: Synthetic oligonucleotide
  Target: ATXN1; (-) strand; PAM type: NRG; PAM sequence: CAG
ttcattttgcttcctggagc

SEQ ID NO: 79341 - DNA, 20 bp, Artificial Sequence
  Description of Artificial Sequence: Synthetic oligonucleotide
  Target: ATXN1; (-) strand; PAM type: NRG; PAM sequence: GAG
tgtcttcattttgcttcctg

SEQ ID NO: 79342 - DNA, 20 bp, Artificial Sequence
  Description of Artificial Sequence: Synthetic oligonucleotide
  Target: ATXN1; (-) strand; PAM type: NRG; PAM sequence: TGG
aatgtcttcattttgcttcc

SEQ ID NO: 79343 - DNA, 20 bp, Artificial Sequence
  Description of Artificial Sequence: Synthetic oligonucleotide
  Target: ATXN1; (-) strand; PAM type: NRG; PAM sequence: AAG
gatagccagaatatttttgt

SEQ ID NO: 79344 - DNA, 20 bp, Artificial Sequence
  Description of Artificial Sequence: Synthetic oligonucleotide
  Target: ATXN1; (-) strand; PAM type: NRG; PAM sequence: CAG
ttcagattaattgagatagc

SEQ ID NO: 79345 - DNA, 20 bp, Artificial Sequence
  Description of Artificial Sequence: Synthetic oligonucleotide
  Target: ATXN1; (-) strand; PAM type: NRG; PAM sequence: TAG
ttggttcagattaattgaga

SEQ ID NO: 79346 - DNA, 20 bp, Artificial Sequence
  Description of Artificial Sequence: Synthetic oligonucleotide
  Target: ATXN1; (-) strand; PAM type: NRG; PAM sequence: GAG
tagtttggttcagattaatt

SEQ ID NO: 79347 - DNA, 20 bp, Artificial Sequence
  Description of Artificial Sequence: Synthetic oligonucleotide
  Target: ATXN1; (-) strand; PAM type: NRG; PAM sequence: CAG
agattattcttagtttggtt

SEQ ID NO: 79348 - DNA, 20 bp, Artificial Sequence
  Description of Artificial Sequence: Synthetic oligonucleotide
  Target: ATXN1; (-) strand; PAM type: NRG; PAM sequence: TGG
tatctagattattcttagtt

SEQ ID NO: 79349 - DNA, 20 bp, Artificial Sequence
  Description of Artificial Sequence: Synthetic oligonucleotide
  Target: ATXN1; (-) strand; PAM type: NRG; PAM sequence: TAG
ggaaatatctagattattct

SEQ ID NO: 79350 - DNA, 20 bp, Artificial Sequence
  Description of Artificial Sequence: Synthetic oligonucleotide
  Target: ATXN1; (-) strand; PAM type: NRG; PAM sequence: TAG
agaagattgggggaaatatc

SEQ ID NO: 79351 - DNA, 20 bp, Artificial Sequence
  Description of Artificial Sequence: Synthetic oligonucleotide
  Target: ATXN1; (-) strand; PAM type: NRG; PAM sequence: GGG
aaatgggaacagaagattgg

SEQ ID NO: 79352 - DNA, 20 bp, Artificial Sequence
  Description of Artificial Sequence: Synthetic oligonucleotide
  Target: ATXN1; (-) strand; PAM type: NRG; PAM sequence: GGG
taaatgggaacagaagattg

SEQ ID NO: 79353 - DNA, 20 bp, Artificial Sequence
  Description of Artificial Sequence: Synthetic oligonucleotide
  Target: ATXN1; (-) strand; PAM type: NRG; PAM sequence: GGG
ctaaatgggaacagaagatt

SEQ ID NO: 79354 - DNA, 20 bp, Artificial Sequence
  Description of Artificial Sequence: Synthetic oligonucleotide
  Target: ATXN1; (-) strand; PAM type: NRG; PAM sequence: TGG
actaaatgggaacagaagat

SEQ ID NO: 79355 - DNA, 20 bp, Artificial Sequence
  Description of Artificial Sequence: Synthetic oligonucleotide
  Target: ATXN1; (-) strand; PAM type: NRG; PAM sequence: AAG
catgaactaaatgggaacag

SEQ ID NO: 79356 - DNA, 20 bp, Artificial Sequence
  Description of Artificial Sequence: Synthetic oligonucleotide
  Target: ATXN1; (-) strand; PAM type: NRG; PAM sequence: CAG
tgccatgaactaaatgggaa

SEQ ID NO: 79357 - DNA, 20 bp, Artificial Sequence
  Description of Artificial Sequence: Synthetic oligonucleotide
  Target: ATXN1; (-) strand; PAM type: NRG; PAM sequence: GGG
aaaaatgccatgaactaaat

SEQ ID NO: 79358 - DNA, 20 bp, Artificial Sequence
  Description of Artificial Sequence: Synthetic oligonucleotide
  Target: ATXN1; (-) strand; PAM type: NRG; PAM sequence: TGG
taaaaatgccatgaactaaa

SEQ ID NO: 79359 - DNA, 20 bp, Artificial Sequence
  Description of Artificial Sequence: Synthetic oligonucleotide
  Target: ATXN1; (-) strand; PAM type: NRG; PAM sequence: AAG
acacatgcttcttatctggc

SEQ ID NO: 79360 - DNA, 20 bp, Artificial Sequence
  Description of Artificial Sequence: Synthetic oligonucleotide
  Target: ATXN1; (-) strand; PAM type: NRG; PAM sequence: TGG
acacacacatgcttcttatc

SEQ ID NO: 79361 - DNA, 20 bp, Artificial Sequence
  Description of Artificial Sequence: Synthetic oligonucleotide
  Target: ATXN1; (-) strand; PAM type: NRG; PAM sequence: CAG
atccttttttccttagttct

SEQ ID NO: 79362 - DNA, 20 bp, Artificial Sequence
  Description of Artificial Sequence: Synthetic oligonucleotide
  Target: ATXN1; (-) strand; PAM type: NRG; PAM sequence: TAG
aaaaccaatccttttttcct

SEQ ID NO: 79363 - DNA, 20 bp, Artificial Sequence
  Description of Artificial Sequence: Synthetic oligonucleotide
  Target: ATXN1; (-) strand; PAM type: NRG; PAM sequence: CAG
cggatatgtttttgaagaga

SEQ ID NO: 79364 - DNA, 20 bp, Artificial Sequence
  Description of Artificial Sequence: Synthetic oligonucleotide
  Target: ATXN1; (-) strand; PAM type: NRG; PAM sequence: GAG
acatcggatatgtttttgaa

SEQ ID NO: 79365 - DNA, 20 bp, Artificial Sequence
  Description of Artificial Sequence: Synthetic oligonucleotide
  Target: ATXN1; (-) strand; PAM type: NRG; PAM sequence: AAG
tcacatcggatatgtttttg

SEQ ID NO: 79366 - DNA, 20 bp, Artificial Sequence
  Description of Artificial Sequence: Synthetic oligonucleotide
  Target: ATXN1; (-) strand; PAM type: NRG; PAM sequence: CGG
ggtttttagtctattcacat

SEQ ID NO: 79367 - DNA, 20 bp, Artificial Sequence
  Description of Artificial Sequence: Synthetic oligonucleotide
  Target: ATXN1; (-) strand; PAM type: NRG; PAM sequence: TAG
ctgcagaattgaatggtttt

SEQ ID NO: 79368 - DNA, 20 bp, Artificial Sequence
  Description of Artificial Sequence: Synthetic oligonucleotide
  Target: ATXN1; (-) strand; PAM type: NRG; PAM sequence: TGG
tcacaaactgcagaattgaa

SEQ ID NO: 79369 - DNA, 20 bp, Artificial Sequence
  Description of Artificial Sequence: Synthetic oligonucleotide
  Target: ATXN1; (-) strand; PAM type: NRG; PAM sequence: CAG
gggatataattcacaaactg

SEQ ID NO: 79370 - DNA, 20 bp, Artificial Sequence
  Description of Artificial Sequence: Synthetic oligonucleotide
  Target: ATXN1; (-) strand; PAM type: NRG; PAM sequence: GGG
ttattaataccagctttctg

SEQ ID NO: 79371 - DNA, 20 bp, Artificial Sequence
  Description of Artificial Sequence: Synthetic oligonucleotide
  Target: ATXN1; (-) strand; PAM type: NRG; PAM sequence: GGG
attattaataccagctttct

SEQ ID NO: 79372 - DNA, 20 bp, Artificial Sequence
  Description of Artificial Sequence: Synthetic oligonucleotide
  Target: ATXN1; (-) strand; PAM type: NRG; PAM sequence: TGG
tattattaataccagctttc

SEQ ID NO: 79373 - DNA, 20 bp, Artificial Sequence
  Description of Artificial Sequence: Synthetic oligonucleotide
  Target: ATXN1; (-) strand; PAM type: NRG; PAM sequence: CAG
agctgctatattattaatac

SEQ ID NO: 79374 - DNA, 20 bp, Artificial Sequence
  Description of Artificial Sequence: Synthetic oligonucleotide
  Target: ATXN1; (-) strand; PAM type: NRG; PAM sequence: TAG
tatgactggcttatttcact

SEQ ID NO: 79375 - DNA, 20 bp, Artificial Sequence
  Description of Artificial Sequence: Synthetic oligonucleotide
  Target: ATXN1; (-) strand; PAM type: NRG; PAM sequence: TGG
agtatttgtccttttatgac

SEQ ID NO: 79376 - DNA, 20 bp, Artificial Sequence
  Description of Artificial Sequence: Synthetic oligonucleotide
  Target: ATXN1; (-) strand; PAM type: NRG; PAM sequence: CAG
ctcatagagggtgaatcata

SEQ ID NO: 79377 - DNA, 20 bp, Artificial Sequence
  Description of Artificial Sequence: Synthetic oligonucleotide
  Target: ATXN1; (-) strand; PAM type: NRG; PAM sequence: GGG
tactctagatacctcataga

SEQ ID NO: 79378 - DNA, 20 bp, Artificial Sequence
  Description of Artificial Sequence: Synthetic oligonucleotide
  Target: ATXN1; (-) strand; PAM type: NRG; PAM sequence: AGG
ctactctagatacctcatag

SEQ ID NO: 79379 - DNA, 20 bp, Artificial Sequence
  Description of Artificial Sequence: Synthetic oligonucleotide
  Target: ATXN1; (-) strand; PAM type: NRG; PAM sequence: GAG
tctactctagatacctcata

SEQ ID NO: 79380 - DNA, 20 bp, Artificial Sequence
  Description of Artificial Sequence: Synthetic oligonucleotide
  Target: ATXN1; (-) strand; PAM type: NRG; PAM sequence: TAG
tgtctactctagatacctca

SEQ ID NO: 79381 - DNA, 20 bp, Artificial Sequence
  Description of Artificial Sequence: Synthetic oligonucleotide
  Target: ATXN1; (-) strand; PAM type: NRG; PAM sequence: TAG
ttctatgacaatgtctactc

SEQ ID NO: 79382 - DNA, 20 bp, Artificial Sequence
  Description of Artificial Sequence: Synthetic oligonucleotide
  Target: ATXN1; (-) strand; PAM type: NRG; PAM sequence: TGG
tcccttctcccccaagccct

SEQ ID NO: 79383 - DNA, 20 bp, Artificial Sequence
  Description of Artificial Sequence: Synthetic oligonucleotide
  Target: ATXN1; (-) strand; PAM type: NRG; PAM sequence: AAG
cttcttttcccttctccccc

SEQ ID NO: 79384 - DNA, 20 bp, Artificial Sequence
  Description of Artificial Sequence: Synthetic oligonucleotide
  Target: ATXN1; (-) strand; PAM type: NRG; PAM sequence: TAG
ttgaaattctacccattaaa

SEQ ID NO: 79385 - DNA, 20 bp, Artificial Sequence
  Description of Artificial Sequence: Synthetic oligonucleotide
  Target: ATXN1; (-) strand; PAM type: NRG; PAM sequence: CAG
gcgagccaccacgcccaacc

SEQ ID NO: 79386 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggtgc

SEQ ID NO: 79387 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 79388 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 79389 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 79390 - DNA, 20 bp, Artificial Sequence
  Description of Artificial Sequence: Synthetic oligonucleotide
  Target: ATXN1; (-) strand; PAM type: NRG; PAM sequence: TGG
acctcggcctcccaaagtgc

SEQ ID NO: 79391 - DNA, 20 bp, Artificial Sequence
  Description of Artificial Sequence: Synthetic oligonucleotide
  Target: ATXN1; (-) strand; PAM type: NRG; PAM sequence: AAG
ctgcccacctcggcctccca

SEQ ID NO: 79392 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatctgcccacct

SEQ ID NO: 79393 - DNA, 20 bp, Artificial Sequence
  Description of Artificial Sequence: Synthetic oligonucleotide
  Target: ATXN1; (-) strand; PAM type: NRG; PAM sequence: AGG
ggtctcaaactcctgacctc

SEQ ID NO: 79394 - DNA, 20 bp, Artificial Sequence
  Description of Artificial Sequence: Synthetic oligonucleotide
  Target: ATXN1; (-) strand; PAM type: NRG; PAM sequence: CAG
tggtctcaaactcctgacct

SEQ ID NO: 79395 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggt

SEQ ID NO: 79396 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccatgttggcc

SEQ ID NO: 79397 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccatgttggc

SEQ ID NO: 79398 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcaccatgt

SEQ ID NO: 79399 - DNA, 20 bp, Artificial Sequence
  Description of Artificial Sequence: Synthetic oligonucleotide
  Target: ATXN1; (-) strand; PAM type: NRG; PAM sequence: GGG
ctgtatttttagtagagaca

SEQ ID NO: 79400 - DNA, 20 bp, Artificial Sequence
  Description of Artificial Sequence: Synthetic oligonucleotide
  Target: ATXN1; (-) strand; PAM type: NRG; PAM sequence: AGG
tctgtatttttagtagagac

SEQ ID NO: 79401 - DNA, 20 bp, Artificial Sequence
  Description of Artificial Sequence: Synthetic oligonucleotide
  Target: ATXN1; (-) strand; PAM type: NRG; PAM sequence: CAG
ttctgtatttttagtagaga

SEQ ID NO: 79402 - DNA, 20 bp, Artificial Sequence
  Description of Artificial Sequence: Synthetic oligonucleotide
  Target: ATXN1; (-) strand; PAM type: NRG; PAM sequence: GAG
taatttctgtatttttagta

SEQ ID NO: 79403 - DNA, 20 bp, Artificial Sequence
  Description of Artificial Sequence: Synthetic oligonucleotide
  Target: ATXN1; (-) strand; PAM type: NRG; PAM sequence: TAG
gctaatttctgtatttttag

SEQ ID NO: 79404 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttctgtatttt

SEQ ID NO: 79405 - DNA, 20 bp, Artificial Sequence
  Description of Artificial Sequence: Synthetic oligonucleotide
  Target: ATXN1; (-) strand; PAM type: NRG; PAM sequence: TGG
caggaacctgccacgacgcc

SEQ ID NO: 79406 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 79407 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 79408 - DNA, 20 bp, Artificial Sequence
  Description of Artificial Sequence: Synthetic oligonucleotide
  Target: ATXN1; (-) strand; PAM type: NRG; PAM sequence: GGG
ccccagcctcccaagtagct

SEQ ID NO: 79409 - DNA, 20 bp, Artificial Sequence
  Description of Artificial Sequence: Synthetic oligonucleotide
  Target: ATXN1; (-) strand; PAM type: NRG; PAM sequence: TGG
gccccagcctcccaagtagc

SEQ ID NO: 79410 - DNA, 20 bp, Artificial Sequence
  Description of Artificial Sequence: Synthetic oligonucleotide
  Target: ATXN1; (-) strand; PAM type: NRG; PAM sequence: TAG
tcctgccccagcctcccaag

SEQ ID NO: 79411 - DNA, 20 bp, Artificial Sequence
  Description of Artificial Sequence: Synthetic oligonucleotide
  Target: ATXN1; (-) strand; PAM type: NRG; PAM sequence: AAG
tcctcctgccccagcctccc

SEQ ID NO: 79412 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgatcctcctgccc

SEQ ID NO: 79413 - DNA, 20 bp, Artificial Sequence
  Description of Artificial Sequence: Synthetic oligonucleotide
  Target: ATXN1; (-) strand; PAM type: NRG; PAM sequence: AAG
aacctctgcttcctgggttc

SEQ ID NO: 79414 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctgcttcct

SEQ ID NO: 79415 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctctgcttcc

SEQ ID NO: 79416 - DNA, 20 bp, Artificial Sequence
  Description of Artificial Sequence: Synthetic oligonucleotide
  Target: ATXN1; (-) strand; PAM type: NRG; PAM sequence: CAG
ggagtgtgatggtgtgatct

SEQ ID NO: 79417 - DNA, 20 bp, Artificial Sequence
  Description of Artificial Sequence: Synthetic oligonucleotide
  Target: ATXN1; (-) strand; PAM type: NRG; PAM sequence: TGG
tcccccaggctggagtgtga

SEQ ID NO: 79418 - DNA, 20 bp, Artificial Sequence
  Description of Artificial Sequence: Synthetic oligonucleotide
  Target: ATXN1; (-) strand; PAM type: NRG; PAM sequence: GAG
cgctctcatcccccaggctg

SEQ ID NO: 79419 - DNA, 20 bp, Artificial Sequence
  Description of Artificial Sequence: Synthetic oligonucleotide
  Target: ATXN1; (-) strand; PAM type: NRG; PAM sequence: TGG
ctcgctctcatcccccaggc

SEQ ID NO: 79420 - DNA, 20 bp, Artificial Sequence
  Description of Artificial Sequence: Synthetic oligonucleotide
  Target: ATXN1; (-) strand; PAM type: NRG; PAM sequence: AGG
aagtctcgctctcatccccc

SEQ ID NO: 79421 - DNA, 20 bp, Artificial Sequence
  Description of Artificial Sequence: Synthetic oligonucleotide
  Target: ATXN1; (-) strand; PAM type: NRG; PAM sequence: CAG
aaagtctcgctctcatcccc

SEQ ID NO: 79422 - DNA, 20 bp, Artificial Sequence
  Description of Artificial Sequence: Synthetic oligonucleotide
  Target: ATXN1; (-) strand; PAM type: NRG; PAM sequence: AAG
tttttttttttcttgagaca

SEQ ID NO: 79423 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttctt

SEQ ID NO: 79424 - DNA, 20 bp, Artificial Sequence
  Description of Artificial Sequence: Synthetic oligonucleotide
  Target: ATXN1; (-) strand; PAM type: NRG; PAM sequence: CAG
ctgtcaccaccatccatctc

SEQ ID NO: 79425 - DNA, 20 bp, Artificial Sequence
  Description of Artificial Sequence: Synthetic oligonucleotide
  Target: ATXN1; (-) strand; PAM type: NRG; PAM sequence: TGG
accatcaagtgtacattcag

SEQ ID NO: 79426 - DNA, 20 bp, Artificial Sequence
  Description of Artificial Sequence: Synthetic oligonucleotide
  Target: ATXN1; (-) strand; PAM type: NRG; PAM sequence: CAG
ttcaccatcaagtgtacatt

SEQ ID NO: 79427 - DNA, 20 bp, Artificial Sequence
  Description of Artificial Sequence: Synthetic oligonucleotide
  Target: ATXN1; (-) strand; PAM type: NRG; PAM sequence: AAG
aattgaccgtcttcaccatc

SEQ ID NO: 79428 - DNA, 20 bp, Artificial Sequence
  Description of Artificial Sequence: Synthetic oligonucleotide
  Target: ATXN1; (-) strand; PAM type: NRG; PAM sequence: AGG
aaaccatacattgtggcaaa

SEQ ID NO: 79429 - DNA, 20 bp, Artificial Sequence
  Description of Artificial Sequence: Synthetic oligonucleotide
  Target: ATXN1; (-) strand; PAM type: NRG; PAM sequence: AAG
taaaccatacattgtggcaa

SEQ ID NO: 79430 - DNA, 20 bp, Artificial Sequence
  Description of Artificial Sequence: Synthetic oligonucleotide
  Target: ATXN1; (-) strand; PAM type: NRG; PAM sequence: TGG
aataaataaaccatacattg

SEQ ID NO: 79431 - DNA, 20 bp, Artificial Sequence
  Description of Artificial Sequence: Synthetic oligonucleotide
  Target: ATXN1; (-) strand; PAM type: NRG; PAM sequence: AAG
acaccgccacttttgctttt

SEQ ID NO: 79432 - DNA, 20 bp, Artificial Sequence
  Description of Artificial Sequence: Synthetic oligonucleotide
  Target: ATXN1; (-) strand; PAM type: NRG; PAM sequence: AGG
cagaatgtatatgattatga

SEQ ID NO: 79433 - DNA, 20 bp, Artificial Sequence
  Description of Artificial Sequence: Synthetic oligonucleotide
  Target: ATXN1; (-) strand; PAM type: NRG; PAM sequence: AAG
gcagaatgtatatgattatg

SEQ ID NO: 79434 - DNA, 20 bp, Artificial Sequence
  Description of Artificial Sequence: Synthetic oligonucleotide
  Target: ATXN1; (-) strand; PAM type: NRG; PAM sequence: CAG
gcaatgctcaatctatggtg

SEQ ID NO: 79435 - DNA, 20 bp, Artificial Sequence
  Description of Artificial Sequence: Synthetic oligonucleotide
  Target: ATXN1; (-) strand; PAM type: NRG; PAM sequence: TGG
atggtgcaatgctcaatcta

SEQ ID NO: 79436 - DNA, 20 bp, Artificial Sequence
  Description of Artificial Sequence: Synthetic oligonucleotide
  Target: ATXN1; (-) strand; PAM type: NRG; PAM sequence: TGG
agcttataaaaataaaaaaa

SEQ ID NO: 79437 - DNA, 20 bp, Artificial Sequence
  Description of Artificial Sequence: Synthetic oligonucleotide
  Target: ATXN1; (-) strand; PAM type: NRG; PAM sequence: TAG
ttgtgcactgaaatttggta

SEQ ID NO: 79438 - DNA, 20 bp, Artificial Sequence
  Description of Artificial Sequence: Synthetic oligonucleotide
  Target: ATXN1; (-) strand; PAM type: NRG; PAM sequence: TGG
agcatttgtgcactgaaatt

SEQ ID NO: 79439 - DNA, 20 bp, Artificial Sequence
  Description of Artificial Sequence: Synthetic oligonucleotide
  Target: ATXN1; (-) strand; PAM type: NRG; PAM sequence: TAG
acccacagtatgtgctgtta

SEQ ID NO: 79440 - DNA, 20 bp, Artificial Sequence
  Description of Artificial Sequence: Synthetic oligonucleotide
  Target: ATXN1; (-) strand; PAM type: NRG; PAM sequence: CAG
attttttatattctcaccca

SEQ ID NO: 79441 - DNA, 20 bp, Artificial Sequence
  Description of Artificial Sequence: Synthetic oligonucleotide
  Target: ATXN1; (-) strand; PAM type: NRG; PAM sequence: TAG
tgcaatgtgagcagtaactt

SEQ ID NO: 79442 - DNA, 20 bp, Artificial Sequence
  Description of Artificial Sequence: Synthetic oligonucleotide
  Target: ATXN1; (-) strand; PAM type: NRG; PAM sequence: CAG
tgtcaaggttgcaatgtgag

SEQ ID NO: 79443 - DNA, 20 bp, Artificial Sequence
  Description of Artificial Sequence: Synthetic oligonucleotide
  Target: ATXN1; (-) strand; PAM type: NRG; PAM sequence: GAG
ttgtgtcaaggttgcaatgt

SEQ ID NO: 79444 - DNA, 20 bp, Artificial Sequence
  Description of Artificial Sequence: Synthetic oligonucleotide
  Target: ATXN1; (-) strand; PAM type: NRG; PAM sequence: AGG
tttgcagagtcgttgtgtca

SEQ ID NO: 79445 - DNA, 20 bp, Artificial Sequence
  Description of Artificial Sequence: Synthetic oligonucleotide
  Target: ATXN1; (-) strand; PAM type: NRG; PAM sequence: AAG
ttttgcagagtcgttgtgtc

SEQ ID NO: 79446 - DNA, 20 bp, Artificial Sequence
  Description of Artificial Sequence: Synthetic oligonucleotide
  Target: ATXN1; (-) strand; PAM type: NRG; PAM sequence: GAG
tttaagcccttgtttttgca

SEQ ID NO: 79447 - DNA, 20 bp, Artificial Sequence
  Description of Artificial Sequence: Synthetic oligonucleotide
  Target: ATXN1; (-) strand; PAM type: NRG; PAM sequence: CAG
aatttaagcccttgtttttg

SEQ ID NO: 79448 - DNA, 20 bp, Artificial Sequence
  Description of Artificial Sequence: Synthetic oligonucleotide
  Target: ATXN1; (-) strand; PAM type: NRG; PAM sequence: AAG
tggcatattcagttaaattt

SEQ ID NO: 79449 - DNA, 20 bp, Artificial Sequence
  Description of Artificial Sequence: Synthetic oligonucleotide
  Target: ATXN1; (-) strand; PAM type: NRG; PAM sequence: CAG
tttctgaattgtggcatatt

SEQ ID NO: 79450 - DNA, 20 bp, Artificial Sequence
  Description of Artificial Sequence: Synthetic oligonucleotide
  Target: ATXN1; (-) strand; PAM type: NRG; PAM sequence: TGG
tagtagcattttctgaattg

SEQ ID NO: 79451 - DNA, 20 bp, Artificial Sequence
  Description of Artificial Sequence: Synthetic oligonucleotide
  Target: ATXN1; (-) strand; PAM type: NRG; PAM sequence: TAG
tcccctcgggcatatggtag

SEQ ID NO: 79452 - DNA, 20 bp, Artificial Sequence
  Description of Artificial Sequence: Synthetic oligonucleotide
  Target: ATXN1; (-) strand; PAM type: NRG; PAM sequence: TAG
cagtcccctcgggcatatgg

SEQ ID NO: 79453 - DNA, 20 bp, Artificial Sequence
  Description of Artificial Sequence: Synthetic oligonucleotide
  Target: ATXN1; (-) strand; PAM type: NRG; PAM sequence: TGG
actcagtcccctcgggcata

SEQ ID NO: 79454 - DNA, 20 bp, Artificial Sequence
  Description of Artificial Sequence: Synthetic oligonucleotide
  Target: ATXN1; (-) strand; PAM type: NRG; PAM sequence: GGG
aagtgtgactcagtcccctc

SEQ ID NO: 79455 - DNA, 20 bp, Artificial Sequence
  Description of Artificial Sequence: Synthetic oligonucleotide
  Target: ATXN1; (-) strand; PAM type: NRG; PAM sequence: CGG
caagtgtgactcagtcccct

SEQ ID NO: 79456 - DNA, 20 bp, Artificial Sequence
  Description of Artificial Sequence: Synthetic oligonucleotide
  Target: ATXN1; (-) strand; PAM type: NRG; PAM sequence: CAG
gttaaactgcaagtgtgact

SEQ ID NO: 79457 - DNA, 20 bp, Artificial Sequence
  Description of Artificial Sequence: Synthetic oligonucleotide
  Target: ATXN1; (-) strand; PAM type: NRG; PAM sequence: AAG
aggagttgaagttaaactgc

SEQ ID NO: 79458 - DNA, 20 bp, Artificial Sequence
  Description of Artificial Sequence: Synthetic oligonucleotide
  Target: ATXN1; (-) strand; PAM type: NRG; PAM sequence: AAG
gtcaaaaaattcaggagttg

SEQ ID NO: 79459 - DNA, 20 bp, Artificial Sequence
  Description of Artificial Sequence: Synthetic oligonucleotide
  Target: ATXN1; (-) strand; PAM type: NRG; PAM sequence: GAG
acagaagtcaaaaaattcag

SEQ ID NO: 79460 - DNA, 20 bp, Artificial Sequence
  Description of Artificial Sequence: Synthetic oligonucleotide
  Target: ATXN1; (-) strand; PAM type: NRG; PAM sequence: AGG
atacagaagtcaaaaaattc

SEQ ID NO: 79461 - DNA, 20 bp, Artificial Sequence
  Description of Artificial Sequence: Synthetic oligonucleotide
  Target: ATXN1; (-) strand; PAM type: NRG; PAM sequence: CAG
catacagaagtcaaaaaatt

SEQ ID NO: 79462 - DNA, 20 bp, Artificial Sequence
  Description of Artificial Sequence: Synthetic oligonucleotide
  Target: ATXN1; (-) strand; PAM type: NRG; PAM sequence: AAG
atgagaatttaaacatacag

SEQ ID NO: 79463 - DNA, 20 bp, Artificial Sequence
  Description of Artificial Sequence: Synthetic oligonucleotide
  Target: ATXN1; (-) strand; PAM type: NRG; PAM sequence: CAG
ttgatgagaatttaaacata

SEQ ID NO: 79464 - DNA, 20 bp, Artificial Sequence
  Description of Artificial Sequence: Synthetic oligonucleotide
  Target: ATXN1; (-) strand; PAM type: NRG; PAM sequence: GAG
ggttgaagctgcagtttgat

SEQ ID NO: 79465 - DNA, 20 bp, Artificial Sequence
  Description of Artificial Sequence: Synthetic oligonucleotide
  Target: ATXN1; (-) strand; PAM type: NRG; PAM sequence: CAG
agaaacaaaggttgaagctg

SEQ ID NO: 79466 - DNA, 20 bp, Artificial Sequence
  Description of Artificial Sequence: Synthetic oligonucleotide
  Target: ATXN1; (-) strand; PAM type: NRG; PAM sequence: AAG
agtggcagaaacaaaggttg

SEQ ID NO: 79467 - DNA, 20 bp, Artificial Sequence
  Description of Artificial Sequence: Synthetic oligonucleotide
  Target: ATXN1; (-) strand; PAM type: NRG; PAM sequence: AGG
gcgatcagtggcagaaacaa

SEQ ID NO: 79468 - DNA, 20 bp, Artificial Sequence
  Description of Artificial Sequence: Synthetic oligonucleotide
  Target: ATXN1; (-) strand; PAM type: NRG; PAM sequence: AAG
tgcgatcagtggcagaaaca

SEQ ID NO: 79469 - DNA, 20 bp, Artificial Sequence
  Description of Artificial Sequence: Synthetic oligonucleotide
  Target: ATXN1; (-) strand; PAM type: NRG; PAM sequence: CAG
atgcattctgcgatcagtgg

SEQ ID NO: 79470 - DNA, 20 bp, Artificial Sequence
  Description of Artificial Sequence: Synthetic oligonucleotide
  Target: ATXN1; (-) strand; PAM type: NRG; PAM sequence: TGG
gcgatgcattctgcgatcag

SEQ ID NO: 79471 - DNA, 20 bp, Artificial Sequence
  Description of Artificial Sequence: Synthetic oligonucleotide
  Target: ATXN1; (-) strand; PAM type: NRG; PAM sequence: CAG
taagcgatgcattctgcgat

SEQ ID NO: 79472 - DNA, 20 bp, Artificial Sequence
  Description of Artificial Sequence: Synthetic oligonucleotide
  Target: ATXN1; (-) strand; PAM type: NRG; PAM sequence: AAG
tagagattacgtcaaatgat

SEQ ID NO: 79473 - DNA, 20 bp, Artificial Sequence
  Description of Artificial Sequence: Synthetic oligonucleotide
  Target: ATXN1; (-) strand; PAM type: NRG; PAM sequence: GAG
aaaacaagtatttcatggta

SEQ ID NO: 79474 - DNA, 20 bp, Artificial Sequence
  Description of Artificial Sequence: Synthetic oligonucleotide
  Target: ATXN1; (-) strand; PAM type: NRG; PAM sequence: TAG
caaaaacaagtatttcatgg

SEQ ID NO: 79475 - DNA, 20 bp, Artificial Sequence
  Description of Artificial Sequence: Synthetic oligonucleotide
  Target: ATXN1; (-) strand; PAM type: NRG; PAM sequence: TGG
gttcaaaaacaagtatttca

SEQ ID NO: 79476 - DNA, 20 bp, Artificial Sequence
  Description of Artificial Sequence: Synthetic oligonucleotide
  Target: ATXN1; (-) strand; PAM type: NRG; PAM sequence: AAG
accttaggctgttcaaaaac

SEQ ID NO: 79477 - DNA, 20 bp, Artificial Sequence
  Description of Artificial Sequence: Synthetic oligonucleotide
  Target: ATXN1; (-) strand; PAM type: NRG; PAM sequence: AGG
aaaagtgtcctccgaacctt

SEQ ID NO: 79478 - DNA, 20 bp, Artificial Sequence
  Description of Artificial Sequence: Synthetic oligonucleotide
  Target: ATXN1; (-) strand; PAM type: NRG; PAM sequence: TAG
aaaaagtgtcctccgaacct

SEQ ID NO: 79479 - DNA, 20 bp, Artificial Sequence
  Description of Artificial Sequence: Synthetic oligonucleotide
  Target: ATXN1; (-) strand; PAM type: NRG; PAM sequence: AAG
tttttatttaacatttaaaa

SEQ ID NO: 79480 - DNA, 20 bp, Artificial Sequence
  Description of Artificial Sequence: Synthetic oligonucleotide
  Target: ATXN1; (-) strand; PAM type: NRG; PAM sequence: CAG
ccattcccagtaatcgttga

SEQ ID NO: 79481 - DNA, 20 bp, Artificial Sequence
  Description of Artificial Sequence: Synthetic oligonucleotide
  Target: ATXN1; (-) strand; PAM type: NRG; PAM sequence: CAG
cttggctgtttttccattcc

SEQ ID NO: 79482 - DNA, 20 bp, Artificial Sequence
  Description of Artificial Sequence: Synthetic oligonucleotide
  Target: ATXN1; (-) strand; PAM type: NRG; PAM sequence: TGG
aggatggcatcaaagaggct

SEQ ID NO: 79483 - DNA, 20 bp, Artificial Sequence
  Description of Artificial Sequence: Synthetic oligonucleotide
  Target: ATXN1; (-) strand; PAM type: NRG; PAM sequence: AGG
gcataaggatggcatcaaag

SEQ ID NO: 79484 - DNA, 20 bp, Artificial Sequence
  Description of Artificial Sequence: Synthetic oligonucleotide
  Target: ATXN1; (-) strand; PAM type: NRG; PAM sequence: GAG
ggcataaggatggcatcaaa

SEQ ID NO: 79485 - DNA, 20 bp, Artificial Sequence
  Description of Artificial Sequence: Synthetic oligonucleotide
  Target: ATXN1; (-) strand; PAM type: NRG; PAM sequence: AAG
taggcataaggatggcatca

SEQ ID NO: 79486 - DNA, 20 bp, Artificial Sequence
  Description of Artificial Sequence: Synthetic oligonucleotide
  Target: ATXN1; (-) strand; PAM type: NRG; PAM sequence: TGG
gatttttctaggcataagga

SEQ ID NO: 79487 - DNA, 20 bp, Artificial Sequence
  Description of Artificial Sequence: Synthetic oligonucleotide
  Target: ATXN1; (-) strand; PAM type: NRG; PAM sequence: AGG
ggaagatttttctaggcata

SEQ ID NO: 79488 - DNA, 20 bp, Artificial Sequence
  Description of Artificial Sequence: Synthetic oligonucleotide
  Target: ATXN1; (-) strand; PAM type: NRG; PAM sequence: AAG
gggaagatttttctaggcat

SEQ ID NO: 79489 - DNA, 20 bp, Artificial Sequence
  Description of Artificial Sequence: Synthetic oligonucleotide
  Target: ATXN1; (-) strand; PAM type: NRG; PAM sequence: AGG
gggagtgggaagatttttct

SEQ ID NO: 79490 - DNA, 20 bp, Artificial Sequence
  Description of Artificial Sequence: Synthetic oligonucleotide
  Target: ATXN1; (-) strand; PAM type: NRG; PAM sequence: TAG
tgggagtgggaagatttttc

SEQ ID NO: 79491 - DNA, 20 bp, Artificial Sequence
  Description of Artificial Sequence: Synthetic oligonucleotide
  Target: ATXN1; (-) strand; PAM type: NRG; PAM sequence: AAG
gatgtgggagtgggagtggg

SEQ ID NO: 79492 - DNA, 20 bp, Artificial Sequence
  Description of Artificial Sequence: Synthetic oligonucleotide
  Target: ATXN1; (-) strand; PAM type: NRG; PAM sequence: GGG
atcgatgtgggagtgggagt

SEQ ID NO: 79493 - DNA, 20 bp, Artificial Sequence
  Description of Artificial Sequence: Synthetic oligonucleotide
  Target: ATXN1; (-) strand; PAM type: NRG; PAM sequence: TGG
gatcgatgtgggagtgggag

SEQ ID NO: 79494 - DNA, 20 bp, Artificial Sequence
  Description of Artificial Sequence: Synthetic oligonucleotide
  Target: ATXN1; (-) strand; PAM type: NRG; PAM sequence: GAG
cttgatcgatgtgggagtgg

SEQ ID NO: 79495 - DNA, 20 bp, Artificial Sequence
  Description of Artificial Sequence: Synthetic oligonucleotide
  Target: ATXN1; (-) strand; PAM type: NRG; PAM sequence: GGG
cacttgatcgatgtgggagt

SEQ ID NO: 79496 - DNA, 20 bp, Artificial Sequence
  Description of Artificial Sequence: Synthetic oligonucleotide
  Target: ATXN1; (-) strand; PAM type: NRG; PAM sequence: TGG
tcacttgatcgatgtgggag

SEQ ID NO: 79497 - DNA, 20 bp, Artificial Sequence
  Description of Artificial Sequence: Synthetic oligonucleotide
  Target: ATXN1; (-) strand; PAM type: NRG; PAM sequence: GAG
agctcacttgatcgatgtgg

SEQ ID NO: 79498 - DNA, 20 bp, Artificial Sequence
  Description of Artificial Sequence: Synthetic oligonucleotide
  Target: ATXN1; (-) strand; PAM type: NRG; PAM sequence: GGG
gcagctcacttgatcgatgt

SEQ ID NO: 79499 - DNA, 20 bp, Artificial Sequence
  Description of Artificial Sequence: Synthetic oligonucleotide
  Target: ATXN1; (-) strand; PAM type: NRG; PAM sequence: TGG
tgcagctcacttgatcgatg

SEQ ID NO: 79500 - DNA, 20 bp, Artificial Sequence
  Description of Artificial Sequence: Synthetic oligonucleotide
  Target: ATXN1; (-) strand; PAM type: NRG; PAM sequence: CAG
tttgaaagaaggaagagatg

SEQ ID NO: 79501 - DNA, 20 bp, Artificial Sequence
  Description of Artificial Sequence: Synthetic oligonucleotide
  Target: ATXN1; (-) strand; PAM type: NRG; PAM sequence: GAG
gtgaactttgaaagaaggaa

SEQ ID NO: 79502 - DNA, 20 bp, Artificial Sequence
  Description of Artificial Sequence: Synthetic oligonucleotide
  Target: ATXN1; (-) strand; PAM type: NRG; PAM sequence: AAG
aggtgaactttgaaagaagg

SEQ ID NO: 79503 - DNA, 20 bp, Artificial Sequence
  Description of Artificial Sequence: Synthetic oligonucleotide
  Target: ATXN1; (-) strand; PAM type: NRG; PAM sequence: AGG
ttaaggtgaactttgaaaga

SEQ ID NO: 79504 - DNA, 20 bp, Artificial Sequence
  Description of Artificial Sequence: Synthetic oligonucleotide
  Target: ATXN1; (-) strand; PAM type: NRG; PAM sequence: AAG
attaaggtgaactttgaaag

SEQ ID NO: 79505 - DNA, 20 bp, Artificial Sequence
  Description of Artificial Sequence: Synthetic oligonucleotide
  Target: ATXN1; (-) strand; PAM type: NRG; PAM sequence: AAG
tgaattaaggtgaactttga

SEQ ID NO: 79506 - DNA, 20 bp, Artificial Sequence
  Description of Artificial Sequence: Synthetic oligonucleotide
  Target: ATXN1; (-) strand; PAM type: NRG; PAM sequence: AGG
aatcatagagaagtgaatta

SEQ ID NO: 79507 - DNA, 20 bp, Artificial Sequence
  Description of Artificial Sequence: Synthetic oligonucleotide
  Target: ATXN1; (-) strand; PAM type: NRG; PAM sequence: AAG
gaatcatagagaagtgaatt

SEQ ID NO: 79508 - DNA, 20 bp, Artificial Sequence
  Description of Artificial Sequence: Synthetic oligonucleotide
  Target: ATXN1; (-) strand; PAM type: NRG; PAM sequence: AAG
ttcattatagaatcatagag

SEQ ID NO: 79509 - DNA, 20 bp, Artificial Sequence
  Description of Artificial Sequence: Synthetic oligonucleotide
  Target: ATXN1; (-) strand; PAM type: NRG; PAM sequence: GAG
gccttcattatagaatcata

SEQ ID NO: 79510 - DNA, 20 bp, Artificial Sequence
  Description of Artificial Sequence: Synthetic oligonucleotide
  Target: ATXN1; (-) strand; PAM type: NRG; PAM sequence: TAG
ctgccttcattatagaatca

SEQ ID NO: 79511 - DNA, 20 bp, Artificial Sequence
  Description of Artificial Sequence: Synthetic oligonucleotide
  Target: ATXN1; (-) strand; PAM type: NRG; PAM sequence: TAG
aatcacagctgccttcatta

SEQ ID NO: 79512 - DNA, 20 bp, Artificial Sequence
  Description of Artificial Sequence: Synthetic oligonucleotide
  Target: ATXN1; (-) strand; PAM type: NRG; PAM sequence: CAG
cttcacttctgctgtaatca

SEQ ID NO: 79513 - DNA, 20 bp, Artificial Sequence
  Description of Artificial Sequence: Synthetic oligonucleotide
  Target: ATXN1; (-) strand; PAM type: NRG; PAM sequence: TAG
taacttgctcccagggtagg

SEQ ID NO: 79514 - DNA, 20 bp, Artificial Sequence
  Description of Artificial Sequence: Synthetic oligonucleotide
  Target: ATXN1; (-) strand; PAM type: NRG; PAM sequence: AGG
aattaacttgctcccagggt

SEQ ID NO: 79515 - DNA, 20 bp, Artificial Sequence
  Description of Artificial Sequence: Synthetic oligonucleotide
  Target: ATXN1; (-) strand; PAM type: NRG; PAM sequence: TAG
aaattaacttgctcccaggg

SEQ ID NO: 79516 - DNA, 20 bp, Artificial Sequence
  Description of Artificial Sequence: Synthetic oligonucleotide
  Target: ATXN1; (-) strand; PAM type: NRG; PAM sequence: GGG
cataaattaacttgctccca

SEQ ID NO: 79517 - DNA, 20 bp, Artificial Sequence
  Description of Artificial Sequence: Synthetic oligonucleotide
  Target: ATXN1; (-) strand; PAM type: NRG; PAM sequence: AGG
ccataaattaacttgctccc

SEQ ID NO: 79518 - DNA, 20 bp, Artificial Sequence
  Description of Artificial Sequence: Synthetic oligonucleotide
  Target: ATXN1; (-) strand; PAM type: NRG; PAM sequence: CAG
gccataaattaacttgctcc

SEQ ID NO: 79519 - DNA, 20 bp, Artificial Sequence
  Description of Artificial Sequence: Synthetic oligonucleotide
  Target: ATXN1; (-) strand; PAM type: NRG; PAM sequence: TGG
gtgtatccctagtgggccta

SEQ ID NO: 79520 - DNA, 20 bp, Artificial Sequence
  Description of Artificial Sequence: Synthetic oligonucleotide
  Target: ATXN1; (-) strand; PAM type: NRG; PAM sequence: GGG
tcgttcagtgtatccctagt

SEQ ID NO: 79521 - DNA, 20 bp, Artificial Sequence
  Description of Artificial Sequence: Synthetic oligonucleotide
  Target: ATXN1; (-) strand; PAM type: NRG; PAM sequence: TGG
ttcgttcagtgtatccctag

SEQ ID NO: 79522 - DNA, 20 bp, Artificial Sequence
  Description of Artificial Sequence: Synthetic oligonucleotide
  Target: ATXN1; (-) strand; PAM type: NRG; PAM sequence: TAG
tagttcgttcagtgtatccc

SEQ ID NO: 79523 - DNA, 20 bp, Artificial Sequence
  Description of Artificial Sequence: Synthetic oligonucleotide
  Target: ATXN1; (-) strand; PAM type: NRG; PAM sequence: CAG
attaaaaaatgtagttcgtt

SEQ ID NO: 79524 - DNA, 20 bp, Artificial Sequence
  Description of Artificial Sequence: Synthetic oligonucleotide
  Target: ATXN1; (-) strand; PAM type: NRG; PAM sequence: TAG
tagacatacattaaaaaatg

SEQ ID NO: 79525 - DNA, 20 bp, Artificial Sequence
  Description of Artificial Sequence: Synthetic oligonucleotide
  Target: ATXN1; (-) strand; PAM type: NRG; PAM sequence: TAG
atcatatacaggttattgca

SEQ ID NO: 79526 - DNA, 20 bp, Artificial Sequence
  Description of Artificial Sequence: Synthetic oligonucleotide
  Target: ATXN1; (-) strand; PAM type: NRG; PAM sequence: AGG
atgatggaaaaatcatatac

SEQ ID NO: 79527 - DNA, 20 bp, Artificial Sequence
  Description of Artificial Sequence: Synthetic oligonucleotide
  Target: ATXN1; (-) strand; PAM type: NRG; PAM sequence: CAG
aatgatggaaaaatcatata

SEQ ID NO: 79528 - DNA, 20 bp, Artificial Sequence
  Description of Artificial Sequence: Synthetic oligonucleotide
  Target: ATXN1; (-) strand; PAM type: NRG; PAM sequence: TGG
ctgttgaagattcttaatga

SEQ ID NO: 79529 - DNA, 20 bp, Artificial Sequence
  Description of Artificial Sequence: Synthetic oligonucleotide
  Target: ATXN1; (-) strand; PAM type: NRG; PAM sequence: AAG
ccttgcatctgggactgttg

SEQ ID NO: 79530 - DNA, 20 bp, Artificial Sequence
  Description of Artificial Sequence: Synthetic oligonucleotide
  Target: ATXN1; (-) strand; PAM type: NRG; PAM sequence: GGG
ggcctgtcttccttgcatct

SEQ ID NO: 79531 - DNA, 20 bp, Artificial Sequence
  Description of Artificial Sequence: Synthetic oligonucleotide
  Target: ATXN1; (-) strand; PAM type: NRG; PAM sequence: TGG
tggcctgtcttccttgcatc

SEQ ID NO: 79532 - DNA, 20 bp, Artificial Sequence
  Description of Artificial Sequence: Synthetic oligonucleotide
  Target: ATXN1; (-) strand; PAM type: NRG; PAM sequence: TGG
atccctagccccctccagga

SEQ ID NO: 79533 - DNA, 20 bp, Artificial Sequence
  Description of Artificial Sequence: Synthetic oligonucleotide
  Target: ATXN1; (-) strand; PAM type: NRG; PAM sequence: AGG
ctaaatccctagccccctcc

SEQ ID NO: 79534 - DNA, 20 bp, Artificial Sequence
  Description of Artificial Sequence: Synthetic oligonucleotide
  Target: ATXN1; (-) strand; PAM type: NRG; PAM sequence: CAG
cctaaatccctagccccctc

SEQ ID NO: 79535 - DNA, 20 bp, Artificial Sequence
  Description of Artificial Sequence: Synthetic oligonucleotide
  Target: ATXN1; (-) strand; PAM type: NRG; PAM sequence: TAG
gaatgccatccctaaatccc

SEQ ID NO: 79536 - DNA, 20 bp, Artificial Sequence
  Description of Artificial Sequence: Synthetic oligonucleotide
  Target: ATXN1; (-) strand; PAM type: NRG; PAM sequence: AGG
ctcagcgccttgtaaataat

SEQ ID NO: 79537 - DNA, 20 bp, Artificial Sequence
  Description of Artificial Sequence: Synthetic oligonucleotide
  Target: ATXN1; (-) strand; PAM type: NRG; PAM sequence: TAG
actcagcgccttgtaaataa

SEQ ID NO: 79538 - DNA, 20 bp, Artificial Sequence
  Description of Artificial Sequence: Synthetic oligonucleotide
  Target: ATXN1; (-) strand; PAM type: NRG; PAM sequence: CAG
cacacatggtctgtctaact

SEQ ID NO: 79539 - DNA, 20 bp, Artificial Sequence
  Description of Artificial Sequence: Synthetic oligonucleotide
  Target: ATXN1; (-) strand; PAM type: NRG; PAM sequence: TGG
aggaacaccatggtcacaca

SEQ ID NO: 79540 - DNA, 20 bp, Artificial Sequence
  Description of Artificial Sequence: Synthetic oligonucleotide
  Target: ATXN1; (-) strand; PAM type: NRG; PAM sequence: TGG
gcttctgagcaggaacacca

SEQ ID NO: 79541 - DNA, 20 bp, Artificial Sequence
  Description of Artificial Sequence: Synthetic oligonucleotide
  Target: ATXN1; (-) strand; PAM type: NRG; PAM sequence: AGG
gcgattgtaagcttctgagc

SEQ ID NO: 79542 - DNA, 20 bp, Artificial Sequence
  Description of Artificial Sequence: Synthetic oligonucleotide
  Target: ATXN1; (-) strand; PAM type: NRG; PAM sequence: CAG
agcgattgtaagcttctgag

SEQ ID NO: 79543 - DNA, 20 bp, Artificial Sequence
  Description of Artificial Sequence: Synthetic oligonucleotide
  Target: ATXN1; (-) strand; PAM type: NRG; PAM sequence: GAG
caaagcgattgtaagcttct

SEQ ID NO: 79544 - DNA, 20 bp, Artificial Sequence
  Description of Artificial Sequence: Synthetic oligonucleotide
  Target: ATXN1; (-) strand; PAM type: NRG; PAM sequence: AAG
tgcctctccaaagcgattgt

SEQ ID NO: 79545 - DNA, 20 bp, Artificial Sequence
  Description of Artificial Sequence: Synthetic oligonucleotide
  Target: ATXN1; (-) strand; PAM type: NRG; PAM sequence: AAG
ataaatgccttgcctctcca

SEQ ID NO: 79546 - DNA, 20 bp, Artificial Sequence
  Description of Artificial Sequence: Synthetic oligonucleotide
  Target: ATXN1; (-) strand; PAM type: NRG; PAM sequence: CAG
gaaaaattgcctgctattat

SEQ ID NO: 79547 - DNA, 20 bp, Artificial Sequence
  Description of Artificial Sequence: Synthetic oligonucleotide
  Target: ATXN1; (-) strand; PAM type: NRG; PAM sequence: CAG
cctggcatttagtaggtctt

SEQ ID NO: 79548 - DNA, 20 bp, Artificial Sequence
  Description of Artificial Sequence: Synthetic oligonucleotide
  Target: ATXN1; (-) strand; PAM type: NRG; PAM sequence: AGG
catcgtgcctggcatttagt

SEQ ID NO: 79549 - DNA, 20 bp, Artificial Sequence
  Description of Artificial Sequence: Synthetic oligonucleotide
  Target: ATXN1; (-) strand; PAM type: NRG; PAM sequence: TAG
gcatcgtgcctggcatttag

SEQ ID NO: 79550 - DNA, 20 bp, Artificial Sequence
  Description of Artificial Sequence: Synthetic oligonucleotide
  Target: ATXN1; (-) strand; PAM type: NRG; PAM sequence: TAG
ctggcatcgtgcctggcatt

SEQ ID NO: 79551 - DNA, 20 bp, Artificial Sequence
  Description of Artificial Sequence: Synthetic oligonucleotide
  Target: ATXN1; (-) strand; PAM type: NRG; PAM sequence: TGG
ctaatgtctggcatcgtgcc

SEQ ID NO: 79552 - DNA, 20 bp, Artificial Sequence
  Description of Artificial Sequence: Synthetic oligonucleotide
  Target: ATXN1; (-) strand; PAM type: NRG; PAM sequence: TGG
atatttttgtccctaatgtc

SEQ ID NO: 79553 - DNA, 20 bp, Artificial Sequence
  Description of Artificial Sequence: Synthetic oligonucleotide
  Target: ATXN1; (-) strand; PAM type: NRG; PAM sequence: TAG
tctctgctgggaccacatct

SEQ ID NO: 79554 - DNA, 20 bp, Artificial Sequence
  Description of Artificial Sequence: Synthetic oligonucleotide
  Target: ATXN1; (-) strand; PAM type: NRG; PAM sequence: GGG
accccatctgtttctctgct

SEQ ID NO: 79555 - DNA, 20 bp, Artificial Sequence
  Description of Artificial Sequence: Synthetic oligonucleotide
  Target: ATXN1; (-) strand; PAM type: NRG; PAM sequence: TGG
aaccccatctgtttctctgc

SEQ ID NO: 79556 - DNA, 20 bp, Artificial Sequence
  Description of Artificial Sequence: Synthetic oligonucleotide
  Target: ATXN1; (-) strand; PAM type: NRG; PAM sequence: CGG
ttgataacatggttactata

SEQ ID NO: 79557 - DNA, 20 bp, Artificial Sequence
  Description of Artificial Sequence: Synthetic oligonucleotide
  Target: ATXN1; (-) strand; PAM type: NRG; PAM sequence: TGG
ctgatgactccttgataaca

SEQ ID NO: 79558 - DNA, 20 bp, Artificial Sequence
  Description of Artificial Sequence: Synthetic oligonucleotide
  Target: ATXN1; (-) strand; PAM type: NRG; PAM sequence: TAG
ctgctatttttatcatctag

SEQ ID NO: 79559 - DNA, 20 bp, Artificial Sequence
  Description of Artificial Sequence: Synthetic oligonucleotide
  Target: ATXN1; (-) strand; PAM type: NRG; PAM sequence: TAG
aagctgctatttttatcatc

SEQ ID NO: 79560 - DNA, 20 bp, Artificial Sequence
  Description of Artificial Sequence: Synthetic oligonucleotide
  Target: ATXN1; (-) strand; PAM type: NRG; PAM sequence: AAG
tgcatttttcgaagagggga

SEQ ID NO: 79561 - DNA, 20 bp, Artificial Sequence
  Description of Artificial Sequence: Synthetic oligonucleotide
  Target: ATXN1; (-) strand; PAM type: NRG; PAM sequence: GGG
actctgcatttttcgaagag

SEQ ID NO: 79562 - DNA, 20 bp, Artificial Sequence
  Description of Artificial Sequence: Synthetic oligonucleotide
  Target: ATXN1; (-) strand; PAM type: NRG; PAM sequence: GGG
tactctgcatttttcgaaga

SEQ ID NO: 79563 - DNA, 20 bp, Artificial Sequence
  Description of Artificial Sequence: Synthetic oligonucleotide
  Target: ATXN1; (-) strand; PAM type: NRG; PAM sequence: AGG
gtactctgcatttttcgaag

SEQ ID NO: 79564 - DNA, 20 bp, Artificial Sequence
  Description of Artificial Sequence: Synthetic oligonucleotide
  Target: ATXN1; (-) strand; PAM type: NRG; PAM sequence: GAG
tgtactctgcatttttcgaa

SEQ ID NO: 79565 - DNA, 20 bp, Artificial Sequence
  Description of Artificial Sequence: Synthetic oligonucleotide
  Target: ATXN1; (-) strand; PAM type: NRG; PAM sequence: AAG
tgtgtactctgcatttttcg

SEQ ID NO: 79566 - DNA, 20 bp, Artificial Sequence
  Description of Artificial Sequence: Synthetic oligonucleotide
  Target: ATXN1; (-) strand; PAM type: NRG; PAM sequence: TAG
tgctcactcagtgactggat

SEQ ID NO: 79567 - DNA, 20 bp, Artificial Sequence
  Description of Artificial Sequence: Synthetic oligonucleotide
  Target: ATXN1; (-) strand; PAM type: NRG; PAM sequence: TGG
cagaatgctcactcagtgac

SEQ ID NO: 79568 - DNA, 20 bp, Artificial Sequence
  Description of Artificial Sequence: Synthetic oligonucleotide
  Target: ATXN1; (-) strand; PAM type: NRG; PAM sequence: CAG
tcattgccagaatgctcact

SEQ ID NO: 79569 - DNA, 20 bp, Artificial Sequence
  Description of Artificial Sequence: Synthetic oligonucleotide
  Target: ATXN1; (-) strand; PAM type: NRG; PAM sequence: CAG
caaatatgttttttcattgc

SEQ ID NO: 79570 - DNA, 20 bp, Artificial Sequence
  Description of Artificial Sequence: Synthetic oligonucleotide
  Target: ATXN1; (-) strand; PAM type: NRG; PAM sequence: AAG
gcttggtacctagagttctg

SEQ ID NO: 79571 - DNA, 20 bp, Artificial Sequence
  Description of Artificial Sequence: Synthetic oligonucleotide
  Target: ATXN1; (-) strand; PAM type: NRG; PAM sequence: GAG
tctggaatgcttggtaccta

SEQ ID NO: 79572 - DNA, 20 bp, Artificial Sequence
  Description of Artificial Sequence: Synthetic oligonucleotide
  Target: ATXN1; (-) strand; PAM type: NRG; PAM sequence: TAG
tatctggaatgcttggtacc

SEQ ID NO: 79573 - DNA, 20 bp, Artificial Sequence
  Description of Artificial Sequence: Synthetic oligonucleotide
  Target: ATXN1; (-) strand; PAM type: NRG; PAM sequence: TGG
atttatgtatctggaatgct

SEQ ID NO: 79574 - DNA, 20 bp, Artificial Sequence
  Description of Artificial Sequence: Synthetic oligonucleotide
  Target: ATXN1; (-) strand; PAM type: NRG; PAM sequence: TGG
gatcagaacatttatgtatc

SEQ ID NO: 79575 - DNA, 20 bp, Artificial Sequence
  Description of Artificial Sequence: Synthetic oligonucleotide
  Target: ATXN1; (-) strand; PAM type: NRG; PAM sequence: CAG
caattgccactcaaggggat

SEQ ID NO: 79576 - DNA, 20 bp, Artificial Sequence
  Description of Artificial Sequence: Synthetic oligonucleotide
  Target: ATXN1; (-) strand; PAM type: NRG; PAM sequence: GGG
ccggtcaattgccactcaag

SEQ ID NO: 79577 - DNA, 20 bp, Artificial Sequence
  Description of Artificial Sequence: Synthetic oligonucleotide
  Target: ATXN1; (-) strand; PAM type: NRG; PAM sequence: GGG
gccggtcaattgccactcaa

SEQ ID NO: 79578 - DNA, 20 bp, Artificial Sequence
  Description of Artificial Sequence: Synthetic oligonucleotide
  Target: ATXN1; (-) strand; PAM type: NRG; PAM sequence: AGG
agccggtcaattgccactca

SEQ ID NO: 79579 - DNA, 20 bp, Artificial Sequence
  Description of Artificial Sequence: Synthetic oligonucleotide
  Target: ATXN1; (-) strand; PAM type: NRG; PAM sequence: AAG
cagccggtcaattgccactc

SEQ ID NO: 79580 - DNA, 20 bp, Artificial Sequence
  Description of Artificial Sequence: Synthetic oligonucleotide
  Target: ATXN1; (-) strand; PAM type: NRG; PAM sequence: CGG
aagtttgcctcagtgtcagc

SEQ ID NO: 79581 - DNA, 20 bp, Artificial Sequence
  Description of Artificial Sequence: Synthetic oligonucleotide
  Target: ATXN1; (-) strand; PAM type: NRG; PAM sequence: CAG
tggcaagtttgcctcagtgt

SEQ ID NO: 79582 - DNA, 20 bp, Artificial Sequence
  Description of Artificial Sequence: Synthetic oligonucleotide
  Target: ATXN1; (-) strand; PAM type: NRG; PAM sequence: CAG
ccatggtggcaagtttgcct

SEQ ID NO: 79583 - DNA, 20 bp, Artificial Sequence
  Description of Artificial Sequence: Synthetic oligonucleotide
  Target: ATXN1; (-) strand; PAM type: NRG; PAM sequence: AAG
ttcacatcttccatggtggc

SEQ ID NO: 79584 - DNA, 20 bp, Artificial Sequence
  Description of Artificial Sequence: Synthetic oligonucleotide
  Target: ATXN1; (-) strand; PAM type: NRG; PAM sequence: TGG
ttaattcacatcttccatgg

SEQ ID NO: 79585 - DNA, 20 bp, Artificial Sequence
  Description of Artificial Sequence: Synthetic oligonucleotide
  Target: ATXN1; (-) strand; PAM type: NRG; PAM sequence: TGG
gttttaattcacatcttcca

SEQ ID NO: 79586 - DNA, 20 bp, Artificial Sequence
  Description of Artificial Sequence: Synthetic oligonucleotide
  Target: ATXN1; (-) strand; PAM type: NRG; PAM sequence: TAG
cgagtgccatttctatacct

SEQ ID NO: 79587 - DNA, 20 bp, Artificial Sequence
  Description of Artificial Sequence: Synthetic oligonucleotide
  Target: ATXN1; (-) strand; PAM type: NRG; PAM sequence: GAG
tgttatgaaacaggaagtac

SEQ ID NO: 79588 - DNA, 20 bp, Artificial Sequence
  Description of Artificial Sequence: Synthetic oligonucleotide
  Target: ATXN1; (-) strand; PAM type: NRG; PAM sequence: AAG
gaggactgttatgaaacagg

SEQ ID NO: 79589 - DNA, 20 bp, Artificial Sequence
  Description of Artificial Sequence: Synthetic oligonucleotide
  Target: ATXN1; (-) strand; PAM type: NRG; PAM sequence: AGG
tgtgaggactgttatgaaac

SEQ ID NO: 79590 - DNA, 20 bp, Artificial Sequence
  Description of Artificial Sequence: Synthetic oligonucleotide
  Target: ATXN1; (-) strand; PAM type: NRG; PAM sequence: CAG
ttgtgaggactgttatgaaa

SEQ ID NO: 79591 - DNA, 20 bp, Artificial Sequence
  Description of Artificial Sequence: Synthetic oligonucleotide
  Target: ATXN1; (-) strand; PAM type: NRG; PAM sequence: AGG
catttaaaaagggtcttgtg

SEQ ID NO: 79592 - DNA, 20 bp, Artificial Sequence
  Description of Artificial Sequence: Synthetic oligonucleotide
  Target: ATXN1; (-) strand; PAM type: NRG; PAM sequence: GAG
acatttaaaaagggtcttgt

SEQ ID NO: 79593 - DNA, 20 bp, Artificial Sequence
  Description of Artificial Sequence: Synthetic oligonucleotide
  Target: ATXN1; (-) strand; PAM type: NRG; PAM sequence: GGG
gaaaggcagacatttaaaaa

SEQ ID NO: 79594 - DNA, 20 bp, Artificial Sequence
  Description of Artificial Sequence: Synthetic oligonucleotide
  Target: ATXN1; (-) strand; PAM type: NRG; PAM sequence: AGG
ggaaaggcagacatttaaaa

SEQ ID NO: 79595 - DNA, 20 bp, Artificial Sequence
  Description of Artificial Sequence: Synthetic oligonucleotide
  Target: ATXN1; (-) strand; PAM type: NRG; PAM sequence: AAG
aggaaaggcagacatttaaa

SEQ ID NO: 79596 - DNA, 20 bp, Artificial Sequence
  Description of Artificial Sequence: Synthetic oligonucleotide
  Target: ATXN1; (-) strand; PAM type: NRG; PAM sequence: CAG
ttgcagtctatcaggaaagg

SEQ ID NO: 79597 - DNA, 20 bp, Artificial Sequence
  Description of Artificial Sequence: Synthetic oligonucleotide
  Target: ATXN1; (-) strand; PAM type: NRG; PAM sequence: AGG
aggttgcagtctatcaggaa

SEQ ID NO: 79598 - DNA, 20 bp, Artificial Sequence
  Description of Artificial Sequence: Synthetic oligonucleotide
  Target: ATXN1; (-) strand; PAM type: NRG; PAM sequence: AAG
caggttgcagtctatcagga

SEQ ID NO: 79599 - DNA, 20 bp, Artificial Sequence
  Description of Artificial Sequence: Synthetic oligonucleotide
  Target: ATXN1; (-) strand; PAM type: NRG; PAM sequence: AGG
ttttcaggttgcagtctatc

SEQ ID NO: 79600 - DNA, 20 bp, Artificial Sequence
  Description of Artificial Sequence: Synthetic oligonucleotide
  Target: ATXN1; (-) strand; PAM type: NRG; PAM sequence: CAG
tttttcaggttgcagtctat

SEQ ID NO: 79601 - DNA, 20 bp, Artificial Sequence
  Description of Artificial Sequence: Synthetic oligonucleotide
  Target: ATXN1; (-) strand; PAM type: NRG; PAM sequence: CAG
ccttcctttttttcaggttg

SEQ ID NO: 79602 - DNA, 20 bp, Artificial Sequence
  Description of Artificial Sequence: Synthetic oligonucleotide
  Target: ATXN1; (-) strand; PAM type: NRG; PAM sequence: AGG
ccagttccttcctttttttc

SEQ ID NO: 79603 - DNA, 20 bp, Artificial Sequence
  Description of Artificial Sequence: Synthetic oligonucleotide
  Target: ATXN1; (-) strand; PAM type: NRG; PAM sequence: CAG
cccagttccttccttttttt

SEQ ID NO: 79604 - DNA, 20 bp, Artificial Sequence
  Description of Artificial Sequence: Synthetic oligonucleotide
  Target: ATXN1; (-) strand; PAM type: NRG; PAM sequence: CAG
aactgtaaataaaagagacc

SEQ ID NO: 79605 - DNA, 20 bp, Artificial Sequence
  Description of Artificial Sequence: Synthetic oligonucleotide
  Target: ATXN1; (-) strand; PAM type: NRG; PAM sequence: GAG
ggggaaaactgtaaataaaa

SEQ ID NO: 79606 - DNA, 20 bp, Artificial Sequence
  Description of Artificial Sequence: Synthetic oligonucleotide
  Target: ATXN1; (-) strand; PAM type: NRG; PAM sequence: AAG
ctggggaaaactgtaaataa

SEQ ID NO: 79607 - DNA, 20 bp, Artificial Sequence
  Description of Artificial Sequence: Synthetic oligonucleotide
  Target: ATXN1; (-) strand; PAM type: NRG; PAM sequence: GGG
aggcgttgtactaggcactg

SEQ ID NO: 79608 - DNA, 20 bp, Artificial Sequence
  Description of Artificial Sequence: Synthetic oligonucleotide
  Target: ATXN1; (-) strand; PAM type: NRG; PAM sequence: GGG
caggcgttgtactaggcact

SEQ ID NO: 79609 - DNA, 20 bp, Artificial Sequence
  Description of Artificial Sequence: Synthetic oligonucleotide
  Target: ATXN1; (-) strand; PAM type: NRG; PAM sequence: TGG
tcaggcgttgtactaggcac

SEQ ID NO: 79610 - DNA, 20 bp, Artificial Sequence
  Description of Artificial Sequence: Synthetic oligonucleotide
  Target: ATXN1; (-) strand; PAM type: NRG; PAM sequence: AGG
tatgtgtcaggcgttgtact

SEQ ID NO: 79611 - DNA, 20 bp, Artificial Sequence
  Description of Artificial Sequence: Synthetic oligonucleotide
  Target: ATXN1; (-) strand; PAM type: NRG; PAM sequence: TAG
ctatgtgtcaggcgttgtac

SEQ ID NO: 79612 - DNA, 20 bp, Artificial Sequence
  Description of Artificial Sequence: Synthetic oligonucleotide
  Target: ATXN1; (-) strand; PAM type: NRG; PAM sequence: AGG
ttaattgcttactatgtgtc

SEQ ID NO: 79613 - DNA, 20 bp, Artificial Sequence
  Description of Artificial Sequence: Synthetic oligonucleotide
  Target: ATXN1; (-) strand; PAM type: NRG; PAM sequence: CAG
tttaattgcttactatgtgt

SEQ ID NO: 79614 - DNA, 20 bp, Artificial Sequence
  Description of Artificial Sequence: Synthetic oligonucleotide
  Target: ATXN1; (-) strand; PAM type: NRG; PAM sequence: TAG
agccagctaattgaaaattc

SEQ ID NO: 79615 - DNA, 20 bp, Artificial Sequence
  Description of Artificial Sequence: Synthetic oligonucleotide
  Target: ATXN1; (-) strand; PAM type: NRG; PAM sequence: CAG
actttgcaataatatgcagc

SEQ ID NO: 79616 - DNA, 20 bp, Artificial Sequence
  Description of Artificial Sequence: Synthetic oligonucleotide
  Target: ATXN1; (-) strand; PAM type: NRG; PAM sequence: CAG
gttaactttgcaataatatg

SEQ ID NO: 79617 - DNA, 20 bp, Artificial Sequence
  Description of Artificial Sequence: Synthetic oligonucleotide
  Target: ATXN1; (-) strand; PAM type: NRG; PAM sequence: CAG
gaccattttaatagcctttt

SEQ ID NO: 79618 - DNA, 20 bp, Artificial Sequence
  Description of Artificial Sequence: Synthetic oligonucleotide
  Target: ATXN1; (-) strand; PAM type: NRG; PAM sequence: TAG
tctttacatgaccattttaa

SEQ ID NO: 79619 - DNA, 20 bp, Artificial Sequence
  Description of Artificial Sequence: Synthetic oligonucleotide
  Target: ATXN1; (-) strand; PAM type: NRG; PAM sequence: AAG
actagattatattggttacc

SEQ ID NO: 79620 - DNA, 20 bp, Artificial Sequence
  Description of Artificial Sequence: Synthetic oligonucleotide
  Target: ATXN1; (-) strand; PAM type: NRG; PAM sequence: TGG
attattaaactagattatat

SEQ ID NO: 79621 - DNA, 20 bp, Artificial Sequence
  Description of Artificial Sequence: Synthetic oligonucleotide
  Target: ATXN1; (-) strand; PAM type: NRG; PAM sequence: TAG
ataaataaatattattaaac

SEQ ID NO: 79622 - DNA, 20 bp, Artificial Sequence
  Description of Artificial Sequence: Synthetic oligonucleotide
  Target: ATXN1; (-) strand; PAM type: NRG; PAM sequence: AAG
tgactcaaaaacaagaaata

SEQ ID NO: 79623 - DNA, 20 bp, Artificial Sequence
  Description of Artificial Sequence: Synthetic oligonucleotide
  Target: ATXN1; (-) strand; PAM type: NRG; PAM sequence: AAG
gaagaccctgactcaaaaac

SEQ ID NO: 79624 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggcaacagagg

SEQ ID NO: 79625 - DNA, 20 bp, Artificial Sequence
  Description of Artificial Sequence: Synthetic oligonucleotide
  Target: ATXN1; (-) strand; PAM type: NRG; PAM sequence: AGG
cactccagcctgggcaacag

SEQ ID NO: 79626 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcaaca

SEQ ID NO: 79627 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcaa

SEQ ID NO: 79628 - DNA, 20 bp, Artificial Sequence
  Description of Artificial Sequence: Synthetic oligonucleotide
  Target: ATXN1; (-) strand; PAM type: NRG; PAM sequence: GGG
gcaccactgcactccagcct

SEQ ID NO: 79629 - DNA, 20 bp, Artificial Sequence
  Description of Artificial Sequence: Synthetic oligonucleotide
  Target: ATXN1; (-) strand; PAM type: NRG; PAM sequence: TGG
tgcaccactgcactccagcc

SEQ ID NO: 79630 - DNA, 20 bp, Artificial Sequence
  Description of Artificial Sequence: Synthetic oligonucleotide
  Target: ATXN1; (-) strand; PAM type: NRG; PAM sequence: CAG
tcacatgcaccactgcactc

SEQ ID NO: 79631 - DNA, 20 bp, Artificial Sequence
  Description of Artificial Sequence: Synthetic oligonucleotide
  Target: ATXN1; (-) strand; PAM type: NRG; PAM sequence: AAG
cagagaggttgcagtgagct

SEQ ID NO: 79632 - DNA, 20 bp, Artificial Sequence
  Description of Artificial Sequence: Synthetic oligonucleotide
  Target: ATXN1; (-) strand; PAM type: NRG; PAM sequence: GAG
ggaggcagagaggttgcagt

SEQ ID NO: 79633 - DNA, 20 bp, Artificial Sequence
  Description of Artificial Sequence: Synthetic oligonucleotide
  Target: ATXN1; (-) strand; PAM type: NRG; PAM sequence: CAG
cctgggaggcagagaggttg

SEQ ID NO: 79634 - DNA, 20 bp, Artificial Sequence
  Description of Artificial Sequence: Synthetic oligonucleotide
  Target: ATXN1; (-) strand; PAM type: NRG; PAM sequence: AGG
cttgaacctgggaggcagag

SEQ ID NO: 79635 - DNA, 20 bp, Artificial Sequence
  Description of Artificial Sequence: Synthetic oligonucleotide
  Target: ATXN1; (-) strand; PAM type: NRG; PAM sequence: GAG
acttgaacctgggaggcaga

SEQ ID NO: 79636 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacctgggaggca

SEQ ID NO: 79637 - DNA, 20 bp, Artificial Sequence
  Description of Artificial Sequence: Synthetic oligonucleotide
  Target: ATXN1; (-) strand; PAM type: NRG; PAM sequence: CAG
aatcacttgaacctgggagg

SEQ ID NO: 79638 - DNA, 20 bp, Artificial Sequence
  Description of Artificial Sequence: Synthetic oligonucleotide
  Target: ATXN1; (-) strand; PAM type: NRG; PAM sequence: AGG
gagaatcacttgaacctggg

SEQ ID NO: 79639 - DNA, 20 bp, Artificial Sequence
  Description of Artificial Sequence: Synthetic oligonucleotide
  Target: ATXN1; (-) strand; PAM type: NRG; PAM sequence: GAG
ggagaatcacttgaacctgg

SEQ ID NO: 79640 - DNA, 20 bp, Artificial Sequence
  Description of Artificial Sequence: Synthetic oligonucleotide
  Target: ATXN1; (-) strand; PAM type: NRG; PAM sequence: GGG
caggagaatcacttgaacct

SEQ ID NO: 79641 - DNA, 20 bp, Artificial Sequence
  Description of Artificial Sequence: Synthetic oligonucleotide
  Target: ATXN1; (-) strand; PAM type: NRG; PAM sequence: TGG
gcaggagaatcacttgaacc

SEQ ID NO: 79642 - DNA, 20 bp, Artificial Sequence
  Description of Artificial Sequence: Synthetic oligonucleotide
  Target: ATXN1; (-) strand; PAM type: NRG; PAM sequence: GAG
tgcttgggaggctgaggcag

SEQ ID NO: 79643 - DNA, 20 bp, Artificial Sequence
  Description of Artificial Sequence: Synthetic oligonucleotide
  Target: ATXN1; (-) strand; PAM type: NRG; PAM sequence: AGG
gctgcttgggaggctgaggc

SEQ ID NO: 79644 - DNA, 20 bp, Artificial Sequence
  Description of Artificial Sequence: Synthetic oligonucleotide
  Target: ATXN1; (-) strand; PAM type: NRG; PAM sequence: CAG
agctgcttgggaggctgagg

SEQ ID NO: 79645 - DNA, 20 bp, Artificial Sequence
  Description of Artificial Sequence: Synthetic oligonucleotide
  Target: ATXN1; (-) strand; PAM type: NRG; PAM sequence: AGG
cccagctgcttgggaggctg

SEQ ID NO: 79646 - DNA, 20 bp, Artificial Sequence
  Description of Artificial Sequence: Synthetic oligonucleotide
  Target: ATXN1; (-) strand; PAM type: NRG; PAM sequence: GAG
tcccagctgcttgggaggct

SEQ ID NO: 79647 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctgcttggg

SEQ ID NO: 79648 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctgcttgg

SEQ ID NO: 79649 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagctgctt

SEQ ID NO: 79650 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagctgct

SEQ ID NO: 79651 - DNA, 20 bp, Artificial Sequence
  Description of Artificial Sequence: Synthetic oligonucleotide
  Target: ATXN1; (-) strand; PAM type: NRG; PAM sequence: CAG
gtggtgcgtgcctgtaatcc

SEQ ID NO: 79652 - DNA, 20 bp, Artificial Sequence
  Description of Artificial Sequence: Synthetic oligonucleotide
  Target: ATXN1; (-) strand; PAM type: NRG; PAM sequence: TGG
caaaaattagctgggcatgg

SEQ ID NO: 79653 - DNA, 20 bp, Artificial Sequence
  Description of Artificial Sequence: Synthetic oligonucleotide
  Target: ATXN1; (-) strand; PAM type: NRG; PAM sequence: TGG
aaacaaaaattagctgggca

SEQ ID NO: 79654 - DNA, 20 bp, Artificial Sequence
  Description of Artificial Sequence: Synthetic oligonucleotide
  Target: ATXN1; (-) strand; PAM type: NRG; PAM sequence: GGG
taaaaaaacaaaaattagct

SEQ ID NO: 79655 - DNA, 20 bp, Artificial Sequence
  Description of Artificial Sequence: Synthetic oligonucleotide
  Target: ATXN1; (-) strand; PAM type: NRG; PAM sequence: TGG
ctaaaaaaacaaaaattagc

SEQ ID NO: 79656 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaaaacaaaaat

SEQ ID NO: 79657 - DNA, 20 bp, Artificial Sequence
  Description of Artificial Sequence: Synthetic oligonucleotide
  Target: ATXN1; (-) strand; PAM type: NRG; PAM sequence: TGG
cgtgaacagcctggccaaca

SEQ ID NO: 79658 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgtgaacagcc

SEQ ID NO: 79659 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttcgtgaa

SEQ ID NO: 79660 - DNA, 20 bp, Artificial Sequence
  Description of Artificial Sequence: Synthetic oligonucleotide
  Target: ATXN1; (-) strand; PAM type: NRG; PAM sequence: GAG
ggcacatcatctgaggtcag

SEQ ID NO: 79661 - DNA, 20 bp, Artificial Sequence
  Description of Artificial Sequence: Synthetic oligonucleotide
  Target: ATXN1; (-) strand; PAM type: NRG; PAM sequence: AGG
tgggcacatcatctgaggtc

SEQ ID NO: 79662 - DNA, 20 bp, Artificial Sequence
  Description of Artificial Sequence: Synthetic oligonucleotide
  Target: ATXN1; (-) strand; PAM type: NRG; PAM sequence: CAG
gtgggcacatcatctgaggt

SEQ ID NO: 79663 - DNA, 20 bp, Artificial Sequence
  Description of Artificial Sequence: Synthetic oligonucleotide
  Target: ATXN1; (-) strand; PAM type: NRG; PAM sequence: AGG
gtgggtgggcacatcatctg

SEQ ID NO: 79664 - DNA, 20 bp, Artificial Sequence
  Description of Artificial Sequence: Synthetic oligonucleotide
  Target: ATXN1; (-) strand; PAM type: NRG; PAM sequence: GAG
ggtgggtgggcacatcatct

SEQ ID NO: 79665 - DNA, 20 bp, Artificial Sequence
  Description of Artificial Sequence: Synthetic oligonucleotide
  Target: ATXN1; (-) strand; PAM type: NRG; PAM sequence: GGG
tttgggaggccgaggtgggt

SEQ ID NO: 79666 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccgaggtggg

SEQ ID NO: 79667 - DNA, 20 bp, Artificial Sequence
  Description of Artificial Sequence: Synthetic oligonucleotide
  Target: ATXN1; (-) strand; PAM type: NRG; PAM sequence: GGG
gtactttgggaggccgaggt

SEQ ID NO: 79668 - DNA, 20 bp, Artificial Sequence
  Description of Artificial Sequence: Synthetic oligonucleotide
  Target: ATXN1; (-) strand; PAM type: NRG; PAM sequence: TGG
agtactttgggaggccgagg

SEQ ID NO: 79669 - DNA, 20 bp, Artificial Sequence
  Description of Artificial Sequence: Synthetic oligonucleotide
  Target: ATXN1; (-) strand; PAM type: NRG; PAM sequence: AGG
ctcagtactttgggaggccg

SEQ ID NO: 79670 - DNA, 20 bp, Artificial Sequence
  Description of Artificial Sequence: Synthetic oligonucleotide
  Target: ATXN1; (-) strand; PAM type: NRG; PAM sequence: GAG
tctcagtactttgggaggcc

SEQ ID NO: 79671 - DNA, 20 bp, Artificial Sequence
  Description of Artificial Sequence: Synthetic oligonucleotide
  Target: ATXN1; (-) strand; PAM type: NRG; PAM sequence: AGG
tgtaatctcagtactttggg

SEQ ID NO: 79672 - DNA, 20 bp, Artificial Sequence
  Description of Artificial Sequence: Synthetic oligonucleotide
  Target: ATXN1; (-) strand; PAM type: NRG; PAM sequence: GAG
ctgtaatctcagtactttgg

SEQ ID NO: 79673 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatctcagtacttt

SEQ ID NO: 79674 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatctcagtactt

SEQ ID NO: 79675 - DNA, 20 bp, Artificial Sequence
  Description of Artificial Sequence: Synthetic oligonucleotide
  Target: ATXN1; (-) strand; PAM type: NRG; PAM sequence: CAG
gtggctcatgcctgtaatct

SEQ ID NO: 79676 - DNA, 20 bp, Artificial Sequence
  Description of Artificial Sequence: Synthetic oligonucleotide
  Target: ATXN1; (-) strand; PAM type: NRG; PAM sequence: TGG
attaaaccagctgggcgcag

SEQ ID NO: 79677 - DNA, 20 bp, Artificial Sequence
  Description of Artificial Sequence: Synthetic oligonucleotide
  Target: ATXN1; (-) strand; PAM type: NRG; PAM sequence: CAG
atgattaaaccagctgggcg

SEQ ID NO: 79678 - DNA, 20 bp, Artificial Sequence
  Description of Artificial Sequence: Synthetic oligonucleotide
  Target: ATXN1; (-) strand; PAM type: NRG; PAM sequence: GGG
taagtatgattaaaccagct

SEQ ID NO: 79679 - DNA, 20 bp, Artificial Sequence
  Description of Artificial Sequence: Synthetic oligonucleotide
  Target: ATXN1; (-) strand; PAM type: NRG; PAM sequence: TGG
ttaagtatgattaaaccagc

SEQ ID NO: 79680 - DNA, 20 bp, Artificial Sequence
  Description of Artificial Sequence: Synthetic oligonucleotide
  Target: ATXN1; (-) strand; PAM type: NRG; PAM sequence: CAG
ttgattaagtatgattaaac

SEQ ID NO: 79681 - DNA, 20 bp, Artificial Sequence
  Description of Artificial Sequence: Synthetic oligonucleotide
  Target: ATXN1; (-) strand; PAM type: NRG; PAM sequence: AAG
acttgattcattagttgatt

SEQ ID NO: 79682 - DNA, 20 bp, Artificial Sequence
  Description of Artificial Sequence: Synthetic oligonucleotide
  Target: ATXN1; (-) strand; PAM type: NRG; PAM sequence: TAG
cataagttaacttgattcat

SEQ ID NO: 79683 - DNA, 20 bp, Artificial Sequence
  Description of Artificial Sequence: Synthetic oligonucleotide
  Target: ATXN1; (-) strand; PAM type: NRG; PAM sequence: AAG
cagccagtaacagtatccat

SEQ ID NO: 79684 - DNA, 20 bp, Artificial Sequence
  Description of Artificial Sequence: Synthetic oligonucleotide
  Target: ATXN1; (-) strand; PAM type: NRG; PAM sequence: CAG
ggaaaaaattcagccagtaa

SEQ ID NO: 79685 - DNA, 20 bp, Artificial Sequence
  Description of Artificial Sequence: Synthetic oligonucleotide
  Target: ATXN1; (-) strand; PAM type: NRG; PAM sequence: CAG
gtggggggaaaaaattcagc

SEQ ID NO: 79686 - DNA, 20 bp, Artificial Sequence
  Description of Artificial Sequence: Synthetic oligonucleotide
  Target: ATXN1; (-) strand; PAM type: NRG; PAM sequence: CAG
ggttgtggggggaaaaaatt

SEQ ID NO: 79687 - DNA, 20 bp, Artificial Sequence
  Description of Artificial Sequence: Synthetic oligonucleotide
  Target: ATXN1; (-) strand; PAM type: NRG; PAM sequence: GGG
gaattttgagtggttgtggg

SEQ ID NO: 79688 - DNA, 20 bp, Artificial Sequence
  Description of Artificial Sequence: Synthetic oligonucleotide
  Target: ATXN1; (-) strand; PAM type: NRG; PAM sequence: GGG
tgaattttgagtggttgtgg

SEQ ID NO: 79689 - DNA, 20 bp, Artificial Sequence
  Description of Artificial Sequence: Synthetic oligonucleotide
  Target: ATXN1; (-) strand; PAM type: NRG; PAM sequence: GGG
atgaattttgagtggttgtg

SEQ ID NO: 79690 - DNA, 20 bp, Artificial Sequence
  Description of Artificial Sequence: Synthetic oligonucleotide
  Target: ATXN1; (-) strand; PAM type: NRG; PAM sequence: GGG
catgaattttgagtggttgt

SEQ ID NO: 79691 - DNA, 20 bp, Artificial Sequence
  Description of Artificial Sequence: Synthetic oligonucleotide
  Target: ATXN1; (-) strand; PAM type: NRG; PAM sequence: TGG
acatgaattttgagtggttg

SEQ ID NO: 79692 - DNA, 20 bp, Artificial Sequence
  Description of Artificial Sequence: Synthetic oligonucleotide
  Target: ATXN1; (-) strand; PAM type: NRG; PAM sequence: TGG
ttcaacacatgaattttgag

SEQ ID NO: 79693 - DNA, 20 bp, Artificial Sequence
  Description of Artificial Sequence: Synthetic oligonucleotide
  Target: ATXN1; (-) strand; PAM type: NRG; PAM sequence: GAG
ggcttcaacacatgaatttt

SEQ ID NO: 79694 - DNA, 20 bp, Artificial Sequence
  Description of Artificial Sequence: Synthetic oligonucleotide
  Target: ATXN1; (-) strand; PAM type: NRG; PAM sequence: GGG
ttctgagaaactggaagtta

SEQ ID NO: 79695 - DNA, 20 bp, Artificial Sequence
  Description of Artificial Sequence: Synthetic oligonucleotide
  Target: ATXN1; (-) strand; PAM type: NRG; PAM sequence: AGG
attctgagaaactggaagtt

SEQ ID NO: 79696 - DNA, 20 bp, Artificial Sequence
  Description of Artificial Sequence: Synthetic oligonucleotide
  Target: ATXN1; (-) strand; PAM type: NRG; PAM sequence: TAG
tattctgagaaactggaagt

SEQ ID NO: 79697 - DNA, 20 bp, Artificial Sequence
  Description of Artificial Sequence: Synthetic oligonucleotide
  Target: ATXN1; (-) strand; PAM type: NRG; PAM sequence: AAG
gttatattctgagaaactgg

SEQ ID NO: 79698 - DNA, 20 bp, Artificial Sequence
  Description of Artificial Sequence: Synthetic oligonucleotide
  Target: ATXN1; (-) strand; PAM type: NRG; PAM sequence: TGG
acagttatattctgagaaac

SEQ ID NO: 79699 - DNA, 20 bp, Artificial Sequence
  Description of Artificial Sequence: Synthetic oligonucleotide
  Target: ATXN1; (-) strand; PAM type: NRG; PAM sequence: GAG
tccaaatacagttatattct

SEQ ID NO: 79700 - DNA, 20 bp, Artificial Sequence
  Description of Artificial Sequence: Synthetic oligonucleotide
  Target: ATXN1; (-) strand; PAM type: NRG; PAM sequence: CAG
aaaggtccaatttccaaata

SEQ ID NO: 79701 - DNA, 20 bp, Artificial Sequence
  Description of Artificial Sequence: Synthetic oligonucleotide
  Target: ATXN1; (-) strand; PAM type: NRG; PAM sequence: AGG
tgttttaattacctctcaaa

SEQ ID NO: 79702 - DNA, 20 bp, Artificial Sequence
  Description of Artificial Sequence: Synthetic oligonucleotide
  Target: ATXN1; (-) strand; PAM type: NRG; PAM sequence: AAG
ttgttttaattacctctcaa

SEQ ID NO: 79703 - DNA, 20 bp, Artificial Sequence
  Description of Artificial Sequence: Synthetic oligonucleotide
  Target: ATXN1; (-) strand; PAM type: NRG; PAM sequence: GGG
acaccagtcatagtggaata

SEQ ID NO: 79704 - DNA, 20 bp, Artificial Sequence
  Description of Artificial Sequence: Synthetic oligonucleotide
  Target: ATXN1; (-) strand; PAM type: NRG; PAM sequence: AGG
gacaccagtcatagtggaat

SEQ ID NO: 79705 - DNA, 20 bp, Artificial Sequence
  Description of Artificial Sequence: Synthetic oligonucleotide
  Target: ATXN1; (-) strand; PAM type: NRG; PAM sequence: TAG
ggacaccagtcatagtggaa

SEQ ID NO: 79706 - DNA, 20 bp, Artificial Sequence
  Description of Artificial Sequence: Synthetic oligonucleotide
  Target: ATXN1; (-) strand; PAM type: NRG; PAM sequence: TGG
tacaaggacaccagtcatag

SEQ ID NO: 79707 - DNA, 20 bp, Artificial Sequence
  Description of Artificial Sequence: Synthetic oligonucleotide
  Target: ATXN1; (-) strand; PAM type: NRG; PAM sequence: TAG
tgttacaaggacaccagtca

SEQ ID NO: 79708 - DNA, 20 bp, Artificial Sequence
  Description of Artificial Sequence: Synthetic oligonucleotide
  Target: ATXN1; (-) strand; PAM type: NRG; PAM sequence: CAG
gtctcctgttacaaggacac

SEQ ID NO: 79709 - DNA, 20 bp, Artificial Sequence
  Description of Artificial Sequence: Synthetic oligonucleotide
  Target: ATXN1; (-) strand; PAM type: NRG; PAM sequence: AGG
tgtcccagtctcctgttaca

SEQ ID NO: 79710 - DNA, 20 bp, Artificial Sequence
  Description of Artificial Sequence: Synthetic oligonucleotide
  Target: ATXN1; (-) strand; PAM type: NRG; PAM sequence: AAG
gtgtcccagtctcctgttac

SEQ ID NO: 79711 - DNA, 20 bp, Artificial Sequence
  Description of Artificial Sequence: Synthetic oligonucleotide
  Target: ATXN1; (-) strand; PAM type: NRG; PAM sequence: CAG
ttccctccaagtctgtgtcc

SEQ ID NO: 79712 - DNA, 20 bp, Artificial Sequence
  Description of Artificial Sequence: Synthetic oligonucleotide
  Target: ATXN1; (-) strand; PAM type: NRG; PAM sequence: AAG
cctctcgtgggcttccctcc

SEQ ID NO: 79713 - DNA, 20 bp, Artificial Sequence
  Description of Artificial Sequence: Synthetic oligonucleotide
  Target: ATXN1; (-) strand; PAM type: NRG; PAM sequence: GGG
ttccccctgtgtcctctcgt

SEQ ID NO: 79714 - DNA, 20 bp, Artificial Sequence
  Description of Artificial Sequence: Synthetic oligonucleotide
  Target: ATXN1; (-) strand; PAM type: NRG; PAM sequence: TGG
cttccccctgtgtcctctcg

SEQ ID NO: 79715 - DNA, 20 bp, Artificial Sequence
  Description of Artificial Sequence: Synthetic oligonucleotide
  Target: ATXN1; (-) strand; PAM type: NRG; PAM sequence: TGG
ccttctccttggcttgcaga

SEQ ID NO: 79716 - DNA, 20 bp, Artificial Sequence
  Description of Artificial Sequence: Synthetic oligonucleotide
  Target: ATXN1; (-) strand; PAM type: NRG; PAM sequence: CAG
aagtccttctccttggcttg

SEQ ID NO: 79717 - DNA, 20 bp, Artificial Sequence
  Description of Artificial Sequence: Synthetic oligonucleotide
  Target: ATXN1; (-) strand; PAM type: NRG; PAM sequence: TGG
ccttctgaagtccttctcct

SEQ ID NO: 79718 - DNA, 20 bp, Artificial Sequence
  Description of Artificial Sequence: Synthetic oligonucleotide
  Target: ATXN1; (-) strand; PAM type: NRG; PAM sequence: AAG
aggaaagttggttccttctg

SEQ ID NO: 79719 - DNA, 20 bp, Artificial Sequence
  Description of Artificial Sequence: Synthetic oligonucleotide
  Target: ATXN1; (-) strand; PAM type: NRG; PAM sequence: TGG
aatgaaagtgtcaggaaagt

SEQ ID NO: 79720 - DNA, 20 bp, Artificial Sequence
  Description of Artificial Sequence: Synthetic oligonucleotide
  Target: ATXN1; (-) strand; PAM type: NRG; PAM sequence: AAG
ttgaaatgaaagtgtcagga

SEQ ID NO: 79721 - DNA, 20 bp, Artificial Sequence
  Description of Artificial Sequence: Synthetic oligonucleotide
  Target: ATXN1; (-) strand; PAM type: NRG; PAM sequence: AGG
aagtttgaaatgaaagtgtc

SEQ ID NO: 79722 - DNA, 20 bp, Artificial Sequence
  Description of Artificial Sequence: Synthetic oligonucleotide
  Target: ATXN1; (-) strand; PAM type: NRG; PAM sequence: CAG
taagtttgaaatgaaagtgt

SEQ ID NO: 79723 - DNA, 20 bp, Artificial Sequence
  Description of Artificial Sequence: Synthetic oligonucleotide
  Target: ATXN1; (-) strand; PAM type: NRG; PAM sequence: AAG
agacagtaagtttgaaatga

SEQ ID NO: 79724 - DNA, 20 bp, Artificial Sequence
  Description of Artificial Sequence: Synthetic oligonucleotide
  Target: ATXN1; (-) strand; PAM type: NRG; PAM sequence: AAG
cttatgattctagagacagt

SEQ ID NO: 79725 - DNA, 20 bp, Artificial Sequence
  Description of Artificial Sequence: Synthetic oligonucleotide
  Target: ATXN1; (-) strand; PAM type: NRG; PAM sequence: CAG
ttttcttatgattctagaga

SEQ ID NO: 79726 - DNA, 20 bp, Artificial Sequence
  Description of Artificial Sequence: Synthetic oligonucleotide
  Target: ATXN1; (-) strand; PAM type: NRG; PAM sequence: GAG
cttattttcttatgattcta

SEQ ID NO: 79727 - DNA, 20 bp, Artificial Sequence
  Description of Artificial Sequence: Synthetic oligonucleotide
  Target: ATXN1; (-) strand; PAM type: NRG; PAM sequence: TAG
aacttattttcttatgattc

SEQ ID NO: 79728 - DNA, 20 bp, Artificial Sequence
  Description of Artificial Sequence: Synthetic oligonucleotide
  Target: ATXN1; (-) strand; PAM type: NRG; PAM sequence: CAG
cccagactgagtggcttaaa

SEQ ID NO: 79729 - DNA, 20 bp, Artificial Sequence
  Description of Artificial Sequence: Synthetic oligonucleotide
  Target: ATXN1; (-) strand; PAM type: NRG; PAM sequence: TGG
acaaagtaacccagactgag

SEQ ID NO: 79730 - DNA, 20 bp, Artificial Sequence
  Description of Artificial Sequence: Synthetic oligonucleotide
  Target: ATXN1; (-) strand; PAM type: NRG; PAM sequence: GAG
ataacaaagtaacccagact

SEQ ID NO: 79731 - DNA, 20 bp, Artificial Sequence
  Description of Artificial Sequence: Synthetic oligonucleotide
  Target: ATXN1; (-) strand; PAM type: NRG; PAM sequence: CAG
tctaccataacaaagtaacc

SEQ ID NO: 79732 - DNA, 20 bp, Artificial Sequence
  Description of Artificial Sequence: Synthetic oligonucleotide
  Target: ATXN1; (-) strand; PAM type: NRG; PAM sequence: AAG
ttgcgaggtctaccataaca

SEQ ID NO: 79733 - DNA, 20 bp, Artificial Sequence
  Description of Artificial Sequence: Synthetic oligonucleotide
  Target: ATXN1; (-) strand; PAM type: NRG; PAM sequence: AGG
ttagtatctgtcagtttgcg

SEQ ID NO: 79734 - DNA, 20 bp, Artificial Sequence
  Description of Artificial Sequence: Synthetic oligonucleotide
  Target: ATXN1; (-) strand; PAM type: NRG; PAM sequence: GAG
cttagtatctgtcagtttgc

SEQ ID NO: 79735 - DNA, 20 bp, Artificial Sequence
  Description of Artificial Sequence: Synthetic oligonucleotide
  Target: ATXN1; (-) strand; PAM type: NRG; PAM sequence: CAG
aacaagggcttagtatctgt

SEQ ID NO: 79736 - DNA, 20 bp, Artificial Sequence
  Description of Artificial Sequence: Synthetic oligonucleotide
  Target: ATXN1; (-) strand; PAM type: NRG; PAM sequence: TAG
ctccatctcaaacaagggct

SEQ ID NO: 79737 - DNA, 20 bp, Artificial Sequence
  Description of Artificial Sequence: Synthetic oligonucleotide
  Target: ATXN1; (-) strand; PAM type: NRG; PAM sequence: GGG
cacagctccatctcaaacaa

SEQ ID NO: 79738 - DNA, 20 bp, Artificial Sequence
  Description of Artificial Sequence: Synthetic oligonucleotide
  Target: ATXN1; (-) strand; PAM type: NRG; PAM sequence: AGG
ccacagctccatctcaaaca

SEQ ID NO: 79739 - DNA, 20 bp, Artificial Sequence
  Description of Artificial Sequence: Synthetic oligonucleotide
  Target: ATXN1; (-) strand; PAM type: NRG; PAM sequence: AAG
gccacagctccatctcaaac

SEQ ID NO: 79740 - DNA, 20 bp, Artificial Sequence
  Description of Artificial Sequence: Synthetic oligonucleotide
  Target: ATXN1; (-) strand; PAM type: NRG; PAM sequence: CAG
aatagccatttatagggcca

SEQ ID NO: 79741 - DNA, 20 bp, Artificial Sequence
  Description of Artificial Sequence: Synthetic oligonucleotide
  Target: ATXN1; (-) strand; PAM type: NRG; PAM sequence: GGG
ttctaaaatagccatttata

SEQ ID NO: 79742 - DNA, 20 bp, Artificial Sequence
  Description of Artificial Sequence: Synthetic oligonucleotide
  Target: ATXN1; (-) strand; PAM type: NRG; PAM sequence: AGG
tttctaaaatagccatttat

SEQ ID NO: 79743 - DNA, 20 bp, Artificial Sequence
  Description of Artificial Sequence: Synthetic oligonucleotide
  Target: ATXN1; (-) strand; PAM type: NRG; PAM sequence: TAG
ctttctaaaatagccattta

SEQ ID NO: 79744 - DNA, 20 bp, Artificial Sequence
  Description of Artificial Sequence: Synthetic oligonucleotide
  Target: ATXN1; (-) strand; PAM type: NRG; PAM sequence: TAG
ttcacattgtctttctaaaa

SEQ ID NO: 79745 - DNA, 20 bp, Artificial Sequence
  Description of Artificial Sequence: Synthetic oligonucleotide
  Target: ATXN1; (-) strand; PAM type: NRG; PAM sequence: CAG
tgttccagtaccgttgctgc

SEQ ID NO: 79746 - DNA, 20 bp, Artificial Sequence
  Description of Artificial Sequence: Synthetic oligonucleotide
  Target: ATXN1; (-) strand; PAM type: NRG; PAM sequence: CAG
tggactcctcattcctgttc

SEQ ID NO: 79747 - DNA, 20 bp, Artificial Sequence
  Description of Artificial Sequence: Synthetic oligonucleotide
  Target: ATXN1; (-) strand; PAM type: NRG; PAM sequence: TGG
tggaaccagaagtggacata

SEQ ID NO: 79748 - DNA, 20 bp, Artificial Sequence
  Description of Artificial Sequence: Synthetic oligonucleotide
  Target: ATXN1; (-) strand; PAM type: NRG; PAM sequence: TGG
agtcagactggaaccagaag

SEQ ID NO: 79749 - DNA, 20 bp, Artificial Sequence
  Description of Artificial Sequence: Synthetic oligonucleotide
  Target: ATXN1; (-) strand; PAM type: NRG; PAM sequence: AAG
agaagtcagactggaaccag

SEQ ID NO: 79750 - DNA, 20 bp, Artificial Sequence
  Description of Artificial Sequence: Synthetic oligonucleotide
  Target: ATXN1; (-) strand; PAM type: NRG; PAM sequence: CAG
ccaagaagtcagactggaac

SEQ ID NO: 79751 - DNA, 20 bp, Artificial Sequence
  Description of Artificial Sequence: Synthetic oligonucleotide
  Target: ATXN1; (-) strand; PAM type: NRG; PAM sequence: TGG
gcttgaccaagaagtcagac

SEQ ID NO: 79752 - DNA, 20 bp, Artificial Sequence
  Description of Artificial Sequence: Synthetic oligonucleotide
  Target: ATXN1; (-) strand; PAM type: NRG; PAM sequence: CAG
aaatggcttgaccaagaagt

SEQ ID NO: 79753 - DNA, 20 bp, Artificial Sequence
  Description of Artificial Sequence: Synthetic oligonucleotide
  Target: ATXN1; (-) strand; PAM type: NRG; PAM sequence: AAG
gtaaaaatggcttgaccaag

SEQ ID NO: 79754 - DNA, 20 bp, Artificial Sequence
  Description of Artificial Sequence: Synthetic oligonucleotide
  Target: ATXN1; (-) strand; PAM type: NRG; PAM sequence: AAG
gaagtaaaaatggcttgacc

SEQ ID NO: 79755 - DNA, 20 bp, Artificial Sequence
  Description of Artificial Sequence: Synthetic oligonucleotide
  Target: ATXN1; (-) strand; PAM type: NRG; PAM sequence: TGG
gagactcagagaagtaaaaa

SEQ ID NO: 79756 - DNA, 20 bp, Artificial Sequence
  Description of Artificial Sequence: Synthetic oligonucleotide
  Target: ATXN1; (-) strand; PAM type: NRG; PAM sequence: AAG
aggaggaaagagactcagag

SEQ ID NO: 79757 - DNA, 20 bp, Artificial Sequence
  Description of Artificial Sequence: Synthetic oligonucleotide
  Target: ATXN1; (-) strand; PAM type: NRG; PAM sequence: GAG
taaaggaggaaagagactca

SEQ ID NO: 79758 - DNA, 20 bp, Artificial Sequence
  Description of Artificial Sequence: Synthetic oligonucleotide
  Target: ATXN1; (-) strand; PAM type: NRG; PAM sequence: CAG
tttaaaggaggaaagagact

SEQ ID NO: 79759 - DNA, 20 bp, Artificial Sequence
  Description of Artificial Sequence: Synthetic oligonucleotide
  Target: ATXN1; (-) strand; PAM type: NRG; PAM sequence: GAG
tctatatttaaaggaggaaa

SEQ ID NO: 79760 - DNA, 20 bp, Artificial Sequence
  Description of Artificial Sequence: Synthetic oligonucleotide
  Target: ATXN1; (-) strand; PAM type: NRG; PAM sequence: AAG
cttctatatttaaaggagga

SEQ ID NO: 79761 - DNA, 20 bp, Artificial Sequence
  Description of Artificial Sequence: Synthetic oligonucleotide
  Target: ATXN1; (-) strand; PAM type: NRG; PAM sequence: AGG
taaacttctatatttaaagg

SEQ ID NO: 79762 - DNA, 20 bp, Artificial Sequence
  Description of Artificial Sequence: Synthetic oligonucleotide
  Target: ATXN1; (-) strand; PAM type: NRG; PAM sequence: GAG
ctaaacttctatatttaaag

SEQ ID NO: 79763 - DNA, 20 bp, Artificial Sequence
  Description of Artificial Sequence: Synthetic oligonucleotide
  Target: ATXN1; (-) strand; PAM type: NRG; PAM sequence: AGG
atctaaacttctatatttaa

SEQ ID NO: 79764 - DNA, 20 bp, Artificial Sequence
  Description of Artificial Sequence: Synthetic oligonucleotide
  Target: ATXN1; (-) strand; PAM type: NRG; PAM sequence: AAG
gatctaaacttctatattta

SEQ ID NO: 79765 - DNA, 20 bp, Artificial Sequence
  Description of Artificial Sequence: Synthetic oligonucleotide
  Target: ATXN1; (-) strand; PAM type: NRG; PAM sequence: GAG
tctaggtcacctgaaactca

SEQ ID NO: 79766 - DNA, 20 bp, Artificial Sequence
  Description of Artificial Sequence: Synthetic oligonucleotide
  Target: ATXN1; (-) strand; PAM type: NRG; PAM sequence: CAG
gttctaggtcacctgaaact

SEQ ID NO: 79767 - DNA, 20 bp, Artificial Sequence
  Description of Artificial Sequence: Synthetic oligonucleotide
  Target: ATXN1; (-) strand; PAM type: NRG; PAM sequence: AGG
gcatagaaccatacagttct

SEQ ID NO: 79768 - DNA, 20 bp, Artificial Sequence
  Description of Artificial Sequence: Synthetic oligonucleotide
  Target: ATXN1; (-) strand; PAM type: NRG; PAM sequence: TAG
tgcatagaaccatacagttc

SEQ ID NO: 79769 - DNA, 20 bp, Artificial Sequence
  Description of Artificial Sequence: Synthetic oligonucleotide
  Target: ATXN1; (-) strand; PAM type: NRG; PAM sequence: CAG
gtttgctgcatagaaccata

SEQ ID NO: 79770 - DNA, 20 bp, Artificial Sequence
  Description of Artificial Sequence: Synthetic oligonucleotide
  Target: ATXN1; (-) strand; PAM type: NRG; PAM sequence: TAG
gtaacattgagtttgctgca

SEQ ID NO: 79771 - DNA, 20 bp, Artificial Sequence
  Description of Artificial Sequence: Synthetic oligonucleotide
  Target: ATXN1; (-) strand; PAM type: NRG; PAM sequence: GAG
acatcttagaaggtaacatt

SEQ ID NO: 79772 - DNA, 20 bp, Artificial Sequence
  Description of Artificial Sequence: Synthetic oligonucleotide
  Target: ATXN1; (-) strand; PAM type: NRG; PAM sequence: AGG
gccatctctcacatcttaga

SEQ ID NO: 79773 - DNA, 20 bp, Artificial Sequence
  Description of Artificial Sequence: Synthetic oligonucleotide
  Target: ATXN1; (-) strand; PAM type: NRG; PAM sequence: AAG
tgccatctctcacatcttag

SEQ ID NO: 79774 - DNA, 20 bp, Artificial Sequence
  Description of Artificial Sequence: Synthetic oligonucleotide
  Target: ATXN1; (-) strand; PAM type: NRG; PAM sequence: TAG
ctgtgccatctctcacatct

SEQ ID NO: 79775 - DNA, 20 bp, Artificial Sequence
  Description of Artificial Sequence: Synthetic oligonucleotide
  Target: ATXN1; (-) strand; PAM type: NRG; PAM sequence: CAG
tcagtgtagccagggaaaaa

SEQ ID NO: 79776 - DNA, 20 bp, Artificial Sequence
  Description of Artificial Sequence: Synthetic oligonucleotide
  Target: ATXN1; (-) strand; PAM type: NRG; PAM sequence: GGG
ccagtggctcagtgtagcca

SEQ ID NO: 79777 - DNA, 20 bp, Artificial Sequence
  Description of Artificial Sequence: Synthetic oligonucleotide
  Target: ATXN1; (-) strand; PAM type: NRG; PAM sequence: AGG
gccagtggctcagtgtagcc

SEQ ID NO: 79778 - DNA, 20 bp, Artificial Sequence
  Description of Artificial Sequence: Synthetic oligonucleotide
  Target: ATXN1; (-) strand; PAM type: NRG; PAM sequence: CAG
tgccagtggctcagtgtagc

SEQ ID NO: 79779 - DNA, 20 bp, Artificial Sequence
  Description of Artificial Sequence: Synthetic oligonucleotide
  Target: ATXN1; (-) strand; PAM type: NRG; PAM sequence: TAG
ctactgccagtggctcagtg

SEQ ID NO: 79780 - DNA, 20 bp, Artificial Sequence
  Description of Artificial Sequence: Synthetic oligonucleotide
  Target: ATXN1; (-) strand; PAM type: NRG; PAM sequence: CAG
gaggcctactgccagtggct

SEQ ID NO: 79781 - DNA, 20 bp, Artificial Sequence
  Description of Artificial Sequence: Synthetic oligonucleotide
  Target: ATXN1; (-) strand; PAM type: NRG; PAM sequence: TGG
tttgggaggcctactgccag

SEQ ID NO: 79782 - DNA, 20 bp, Artificial Sequence
  Description of Artificial Sequence: Synthetic oligonucleotide
  Target: ATXN1; (-) strand; PAM type: NRG; PAM sequence: CAG
gtgtttgggaggcctactgc

SEQ ID NO: 79783 - DNA, 20 bp, Artificial Sequence
  Description of Artificial Sequence: Synthetic oligonucleotide
  Target: ATXN1; (-) strand; PAM type: NRG; PAM sequence: AGG
gcagatgggaagtgtttggg

SEQ ID NO: 79784 - DNA, 20 bp, Artificial Sequence
  Description of Artificial Sequence: Synthetic oligonucleotide
  Target: ATXN1; (-) strand; PAM type: NRG; PAM sequence: GAG
agcagatgggaagtgtttgg

SEQ ID NO: 79785 - DNA, 20 bp, Artificial Sequence
  Description of Artificial Sequence: Synthetic oligonucleotide
  Target: ATXN1; (-) strand; PAM type: NRG; PAM sequence: GGG
gaagcagatgggaagtgttt

SEQ ID NO: 79786 - DNA, 20 bp, Artificial Sequence
  Description of Artificial Sequence: Synthetic oligonucleotide
  Target: ATXN1; (-) strand; PAM type: NRG; PAM sequence: TGG
agaagcagatgggaagtgtt

SEQ ID NO: 79787 - DNA, 20 bp, Artificial Sequence
  Description of Artificial Sequence: Synthetic oligonucleotide
  Target: ATXN1; (-) strand; PAM type: NRG; PAM sequence: AAG
tggttcaagaagcagatggg

SEQ ID NO: 79788 - DNA, 20 bp, Artificial Sequence
  Description of Artificial Sequence: Synthetic oligonucleotide
  Target: ATXN1; (-) strand; PAM type: NRG; PAM sequence: GGG
aaatggttcaagaagcagat

SEQ ID NO: 79789 - DNA, 20 bp, Artificial Sequence
  Description of Artificial Sequence: Synthetic oligonucleotide
  Target: ATXN1; (-) strand; PAM type: NRG; PAM sequence: TGG
gaaatggttcaagaagcaga

SEQ ID NO: 79790 - DNA, 20 bp, Artificial Sequence
  Description of Artificial Sequence: Synthetic oligonucleotide
  Target: ATXN1; (-) strand; PAM type: NRG; PAM sequence: CAG
gtatgaaatggttcaagaag

SEQ ID NO: 79791 - DNA, 20 bp, Artificial Sequence
  Description of Artificial Sequence: Synthetic oligonucleotide
  Target: ATXN1; (-) strand; PAM type: NRG; PAM sequence: AAG
tatgtatgaaatggttcaag

SEQ ID NO: 79792 - DNA, 20 bp, Artificial Sequence
  Description of Artificial Sequence: Synthetic oligonucleotide
  Target: ATXN1; (-) strand; PAM type: NRG; PAM sequence: AAG
tgatatgtatgaaatggttc

SEQ ID NO: 79793 - DNA, 20 bp, Artificial Sequence
  Description of Artificial Sequence: Synthetic oligonucleotide
  Target: ATXN1; (-) strand; PAM type: NRG; PAM sequence: TGG
gttgggtgatatgtatgaaa

SEQ ID NO: 79794 - DNA, 20 bp, Artificial Sequence
  Description of Artificial Sequence: Synthetic oligonucleotide
  Target: ATXN1; (-) strand; PAM type: NRG; PAM sequence: GGG
cctgtctttaatgggatgtt

SEQ ID NO: 79795 - DNA, 20 bp, Artificial Sequence
  Description of Artificial Sequence: Synthetic oligonucleotide
  Target: ATXN1; (-) strand; PAM type: NRG; PAM sequence: TGG
ccctgtctttaatgggatgt

SEQ ID NO: 79796 - DNA, 20 bp, Artificial Sequence
  Description of Artificial Sequence: Synthetic oligonucleotide
  Target: ATXN1; (-) strand; PAM type: NRG; PAM sequence: GGG
ccgaggaccctgtctttaat

SEQ ID NO: 79797 - DNA, 20 bp, Artificial Sequence
  Description of Artificial Sequence: Synthetic oligonucleotide
  Target: ATXN1; (-) strand; PAM type: NRG; PAM sequence: TGG
gccgaggaccctgtctttaa

SEQ ID NO: 79798 - DNA, 20 bp, Artificial Sequence
  Description of Artificial Sequence: Synthetic oligonucleotide
  Target: ATXN1; (-) strand; PAM type: NRG; PAM sequence: AGG
tgagccaccgcgcctggccg

SEQ ID NO: 79799 - DNA, 20 bp, Artificial Sequence
  Description of Artificial Sequence: Synthetic oligonucleotide
  Target: ATXN1; (-) strand; PAM type: NRG; PAM sequence: GAG
gtgagccaccgcgcctggcc

SEQ ID NO: 79800 - DNA, 20 bp, Artificial Sequence
  Description of Artificial Sequence: Synthetic oligonucleotide
  Target: ATXN1; (-) strand; PAM type: NRG; PAM sequence: TGG
caagtgtgagccaccgcgcc

SEQ ID NO: 79801 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaagtgt

SEQ ID NO: 79802 - DNA, 20 bp, Artificial Sequence
  Description of Artificial Sequence: Synthetic oligonucleotide
  Target: ATXN1; (-) strand; PAM type: NRG; PAM sequence: AAG
tcccaaagtgctgggattac

SEQ ID NO: 79803 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 79804 - DNA, 20 bp, Artificial Sequence
  Description of Artificial Sequence: Synthetic oligonucleotide
  Target: ATXN1; (-) strand; PAM type: NRG; PAM sequence: TGG
acctcggcctcccaaagtgc

SEQ ID NO: 79805 - DNA, 20 bp, Artificial Sequence
  Description of Artificial Sequence: Synthetic oligonucleotide
  Target: ATXN1; (-) strand; PAM type: NRG; PAM sequence: AAG
ccgcccacctcggcctccca

SEQ ID NO: 79806 - DNA, 20 bp, Artificial Sequence
  Description of Artificial Sequence: Synthetic oligonucleotide
  Target: ATXN1; (-) strand; PAM type: NRG; PAM sequence: CGG
acctcgtgacccgcccacct

SEQ ID NO: 79807 - DNA, 20 bp, Artificial Sequence
  Description of Artificial Sequence: Synthetic oligonucleotide
  Target: ATXN1; (-) strand; PAM type: NRG; PAM sequence: AGG
tttcaccatgttggccaggc

SEQ ID NO: 79808 - DNA, 20 bp, Artificial Sequence
  Description of Artificial Sequence: Synthetic oligonucleotide
  Target: ATXN1; (-) strand; PAM type: NRG; PAM sequence: CAG
atttcaccatgttggccagg

SEQ ID NO: 79809 - DNA, 20 bp, Artificial Sequence
  Description of Artificial Sequence: Synthetic oligonucleotide
  Target: ATXN1; (-) strand; PAM type: NRG; PAM sequence: AGG
gggatttcaccatgttggcc

SEQ ID NO: 79810 - DNA, 20 bp, Artificial Sequence
  Description of Artificial Sequence: Synthetic oligonucleotide
  Target: ATXN1; (-) strand; PAM type: NRG; PAM sequence: CAG
tgggatttcaccatgttggc

SEQ ID NO: 79811 - DNA, 20 bp, Artificial Sequence
  Description of Artificial Sequence: Synthetic oligonucleotide
  Target: ATXN1; (-) strand; PAM type: NRG; PAM sequence: TGG
gagatgggatttcaccatgt

SEQ ID NO: 79812 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 79813 - DNA, 20 bp, Artificial Sequence
  Description of Artificial Sequence: Synthetic oligonucleotide
  Target: ATXN1; (-) strand; PAM type: NRG; PAM sequence: TGG
gtttgtatttttagtagaga

SEQ ID NO: 79814 - DNA, 20 bp, Artificial Sequence
  Description of Artificial Sequence: Synthetic oligonucleotide
  Target: ATXN1; (-) strand; PAM type: NRG; PAM sequence: GAG
taatgtttgtatttttagta

SEQ ID NO: 79815 - DNA, 20 bp, Artificial Sequence
  Description of Artificial Sequence: Synthetic oligonucleotide
  Target: ATXN1; (-) strand; PAM type: NRG; PAM sequence: TAG
gctaatgtttgtatttttag

SEQ ID NO: 79816 - DNA, 20 bp, Artificial Sequence
  Description of Artificial Sequence: Synthetic oligonucleotide
  Target: ATXN1; (-) strand; PAM type: NRG; PAM sequence: TAG
ccggctaatgtttgtatttt

SEQ ID NO: 79817 - DNA, 20 bp, Artificial Sequence
  Description of Artificial Sequence: Synthetic oligonucleotide
  Target: ATXN1; (-) strand; PAM type: NRG; PAM sequence: CGG
caggcgtgagccaccacacc

SEQ ID NO: 79818 - DNA, 20 bp, Artificial Sequence
  Description of Artificial Sequence: Synthetic oligonucleotide
  Target: ATXN1; (-) strand; PAM type: NRG; PAM sequence: GAG
gtagctagtatgacaggcgt

SEQ ID NO: 79819 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctagtatgac

SEQ ID NO: 79820 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctagtatga

SEQ ID NO: 79821 - DNA, 20 bp, Artificial Sequence
  Description of Artificial Sequence: Synthetic oligonucleotide
  Target: ATXN1; (-) strand; PAM type: NRG; PAM sequence: TAG
gcctcagcctcccgagtagc

SEQ ID NO: 79822 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 79823 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 79824 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcct

SEQ ID NO: 79825 - DNA, 20 bp, Artificial Sequence
  Description of Artificial Sequence: Synthetic oligonucleotide
  Target: ATXN1; (-) strand; PAM type: NRG; PAM sequence: AAG
agcctctgcctcccaggttc

SEQ ID NO: 79826 - DNA, 20 bp, Artificial Sequence
  Description of Artificial Sequence: Synthetic oligonucleotide
  Target: ATXN1; (-) strand; PAM type: NRG; PAM sequence: AGG
cactgcagcctctgcctccc

SEQ ID NO: 79827 - DNA, 20 bp, Artificial Sequence
  Description of Artificial Sequence: Synthetic oligonucleotide
  Target: ATXN1; (-) strand; PAM type: NRG; PAM sequence: CAG
tcactgcagcctctgcctcc

SEQ ID NO: 79828 - DNA, 20 bp, Artificial Sequence
  Description of Artificial Sequence: Synthetic oligonucleotide
  Target: ATXN1; (-) strand; PAM type: NRG; PAM sequence: CAG
ggcatgatctcagctcactg

SEQ ID NO: 79829 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcatgatct

SEQ ID NO: 79830 - DNA, 20 bp, Artificial Sequence
  Description of Artificial Sequence: Synthetic oligonucleotide
  Target: ATXN1; (-) strand; PAM type: NRG; PAM sequence: TGG
ccacccaggctggagtgcag

SEQ ID NO: 79831 - DNA, 20 bp, Artificial Sequence
  Description of Artificial Sequence: Synthetic oligonucleotide
  Target: ATXN1; (-) strand; PAM type: NRG; PAM sequence: CAG
ctgccacccaggctggagtg

SEQ ID NO: 79832 - DNA, 20 bp, Artificial Sequence
  Description of Artificial Sequence: Synthetic oligonucleotide
  Target: ATXN1; (-) strand; PAM type: NRG; PAM sequence: GAG
ttgctctgccacccaggctg

SEQ ID NO: 79833 - DNA, 20 bp, Artificial Sequence
  Description of Artificial Sequence: Synthetic oligonucleotide
  Target: ATXN1; (-) strand; PAM type: NRG; PAM sequence: TGG
tcttgctctgccacccaggc

SEQ ID NO: 79834 - DNA, 20 bp, Artificial Sequence
  Description of Artificial Sequence: Synthetic oligonucleotide
  Target: ATXN1; (-) strand; PAM type: NRG; PAM sequence: AGG
ggagtcttgctctgccaccc

SEQ ID NO: 79835 - DNA, 20 bp, Artificial Sequence
  Description of Artificial Sequence: Synthetic oligonucleotide
  Target: ATXN1; (-) strand; PAM type: NRG; PAM sequence: CAG
tggagtcttgctctgccacc

SEQ ID NO: 79836 - DNA, 20 bp, Artificial Sequence
  Description of Artificial Sequence: Synthetic oligonucleotide
  Target: ATXN1; (-) strand; PAM type: NRG; PAM sequence: GAG
tgtttgtttgctttgagatg

SEQ ID NO: 79837 - DNA, 20 bp, Artificial Sequence
  Description of Artificial Sequence: Synthetic oligonucleotide
  Target: ATXN1; (-) strand; PAM type: NRG; PAM sequence: TGG
tttgtttgtttgctttgaga

SEQ ID NO: 79838 - DNA, 20 bp, Artificial Sequence
  Description of Artificial Sequence: Synthetic oligonucleotide
  Target: ATXN1; (-) strand; PAM type: NRG; PAM sequence: GAG
tttgtttgtttgtttgcttt

SEQ ID NO: 79839 - DNA, 20 bp, Artificial Sequence
  Description of Artificial Sequence: Synthetic oligonucleotide
  Target: ATXN1; (-) strand; PAM type: NRG; PAM sequence: AGG
gataggagacttgctgagag

SEQ ID NO: 79840 - DNA, 20 bp, Artificial Sequence
  Description of Artificial Sequence: Synthetic oligonucleotide
  Target: ATXN1; (-) strand; PAM type: NRG; PAM sequence: GAG
tgataggagacttgctgaga

SEQ ID NO: 79841 - DNA, 20 bp, Artificial Sequence
  Description of Artificial Sequence: Synthetic oligonucleotide
  Target: ATXN1; (-) strand; PAM type: NRG; PAM sequence: GAG
tgtgataggagacttgctga

SEQ ID NO: 79842 - DNA, 20 bp, Artificial Sequence
  Description of Artificial Sequence: Synthetic oligonucleotide
  Target: ATXN1; (-) strand; PAM type: NRG; PAM sequence: GAG
tttgtgataggagacttgct

SEQ ID NO: 79843 - DNA, 20 bp, Artificial Sequence
  Description of Artificial Sequence: Synthetic oligonucleotide
  Target: ATXN1; (-) strand; PAM type: NRG; PAM sequence: GAG
gtgtattccttttgtgatag

SEQ ID NO: 79844 - DNA, 20 bp, Artificial Sequence
  Description of Artificial Sequence: Synthetic oligonucleotide
  Target: ATXN1; (-) strand; PAM type: NRG; PAM sequence: AGG
atgtgtattccttttgtgat

SEQ ID NO: 79845 - DNA, 20 bp, Artificial Sequence
  Description of Artificial Sequence: Synthetic oligonucleotide
  Target: ATXN1; (-) strand; PAM type: NRG; PAM sequence: TAG
gatgtgtattccttttgtga

SEQ ID NO: 79846 - DNA, 20 bp, Artificial Sequence
  Description of Artificial Sequence: Synthetic oligonucleotide
  Target: ATXN1; (-) strand; PAM type: NRG; PAM sequence: GGG
agagctggggtggtccagca

SEQ ID NO: 79847 - DNA, 20 bp, Artificial Sequence
  Description of Artificial Sequence: Synthetic oligonucleotide
  Target: ATXN1; (-) strand; PAM type: NRG; PAM sequence: AGG
tagagctggggtggtccagc

SEQ ID NO: 79848 - DNA, 20 bp, Artificial Sequence
  Description of Artificial Sequence: Synthetic oligonucleotide
  Target: ATXN1; (-) strand; PAM type: NRG; PAM sequence: CAG
ttagagctggggtggtccag

SEQ ID NO: 79849 - DNA, 20 bp, Artificial Sequence
  Description of Artificial Sequence: Synthetic oligonucleotide
  Target: ATXN1; (-) strand; PAM type: NRG; PAM sequence: CAG
cccttagagctggggtggtc

SEQ ID NO: 79850 - DNA, 20 bp, Artificial Sequence
  Description of Artificial Sequence: Synthetic oligonucleotide
  Target: ATXN1; (-) strand; PAM type: NRG; PAM sequence: TGG
cctcccccttagagctgggg

SEQ ID NO: 79851 - DNA, 20 bp, Artificial Sequence
  Description of Artificial Sequence: Synthetic oligonucleotide
  Target: ATXN1; (-) strand; PAM type: NRG; PAM sequence: GGG
tgacctcccccttagagctg

SEQ ID NO: 79852 - DNA, 20 bp, Artificial Sequence
  Description of Artificial Sequence: Synthetic oligonucleotide
  Target: ATXN1; (-) strand; PAM type: NRG; PAM sequence: GGG
ttgacctcccccttagagct

SEQ ID NO: 79853 - DNA, 20 bp, Artificial Sequence
  Description of Artificial Sequence: Synthetic oligonucleotide
  Target: ATXN1; (-) strand; PAM type: NRG; PAM sequence: TGG
gttgacctcccccttagagc

SEQ ID NO: 79854 - DNA, 20 bp, Artificial Sequence
  Description of Artificial Sequence: Synthetic oligonucleotide
  Target: ATXN1; (-) strand; PAM type: NRG; PAM sequence: GAG
acaagttgacctccccctta

SEQ ID NO: 79855 - DNA, 20 bp, Artificial Sequence
  Description of Artificial Sequence: Synthetic oligonucleotide
  Target: ATXN1; (-) strand; PAM type: NRG; PAM sequence: TAG
tcacaagttgacctccccct

SEQ ID NO: 79856 - DNA, 20 bp, Artificial Sequence
  Description of Artificial Sequence: Synthetic oligonucleotide
  Target: ATXN1; (-) strand; PAM type: NRG; PAM sequence: AAG
tgcttcgacttattgctcac

SEQ ID NO: 79857 - DNA, 20 bp, Artificial Sequence
  Description of Artificial Sequence: Synthetic oligonucleotide
  Target: ATXN1; (-) strand; PAM type: NRG; PAM sequence: GAG
tgaaaattatacaatgtatg

SEQ ID NO: 79858 - DNA, 20 bp, Artificial Sequence
  Description of Artificial Sequence: Synthetic oligonucleotide
  Target: ATXN1; (-) strand; PAM type: NRG; PAM sequence: TGG
gatgaaaattatacaatgta

SEQ ID NO: 79859 - DNA, 20 bp, Artificial Sequence
  Description of Artificial Sequence: Synthetic oligonucleotide
  Target: ATXN1; (-) strand; PAM type: NRG; PAM sequence: TAG
cagctcttttctggttggaa

SEQ ID NO: 79860 - DNA, 20 bp, Artificial Sequence
  Description of Artificial Sequence: Synthetic oligonucleotide
  Target: ATXN1; (-) strand; PAM type: NRG; PAM sequence: TGG
atgagcagctcttttctggt

SEQ ID NO: 79861 - DNA, 20 bp, Artificial Sequence
  Description of Artificial Sequence: Synthetic oligonucleotide
  Target: ATXN1; (-) strand; PAM type: NRG; PAM sequence: TGG
cagaatgagcagctcttttc

SEQ ID NO: 79862 - DNA, 20 bp, Artificial Sequence
  Description of Artificial Sequence: Synthetic oligonucleotide
  Target: ATXN1; (-) strand; PAM type: NRG; PAM sequence: CAG
acatctttgatcagaatgag

SEQ ID NO: 79863 - DNA, 20 bp, Artificial Sequence
  Description of Artificial Sequence: Synthetic oligonucleotide
  Target: ATXN1; (-) strand; PAM type: NRG; PAM sequence: GAG
ttaacatctttgatcagaat

SEQ ID NO: 79864 - DNA, 20 bp, Artificial Sequence
  Description of Artificial Sequence: Synthetic oligonucleotide
  Target: ATXN1; (-) strand; PAM type: NRG; PAM sequence: CAG
ggctcattaacatctttgat

SEQ ID NO: 79865 - DNA, 20 bp, Artificial Sequence
  Description of Artificial Sequence: Synthetic oligonucleotide
  Target: ATXN1; (-) strand; PAM type: NRG; PAM sequence: GGG
tgtagtaatttctgtttgca

SEQ ID NO: 79866 - DNA, 20 bp, Artificial Sequence
  Description of Artificial Sequence: Synthetic oligonucleotide
  Target: ATXN1; (-) strand; PAM type: NRG; PAM sequence: AGG
ttgtagtaatttctgtttgc

SEQ ID NO: 79867 - DNA, 20 bp, Artificial Sequence
  Description of Artificial Sequence: Synthetic oligonucleotide
  Target: ATXN1; (-) strand; PAM type: NRG; PAM sequence: CAG
attgtagtaatttctgtttg

SEQ ID NO: 79868 - DNA, 20 bp, Artificial Sequence
  Description of Artificial Sequence: Synthetic oligonucleotide
  Target: ATXN1; (-) strand; PAM type: NRG; PAM sequence: TAG
aggtgtctactgttctattg

SEQ ID NO: 79869 - DNA, 20 bp, Artificial Sequence
  Description of Artificial Sequence: Synthetic oligonucleotide
  Target: ATXN1; (-) strand; PAM type: NRG; PAM sequence: AGG
caggagaaaataattaatga

SEQ ID NO: 79870 - DNA, 20 bp, Artificial Sequence
  Description of Artificial Sequence: Synthetic oligonucleotide
  Target: ATXN1; (-) strand; PAM type: NRG; PAM sequence: AAG
gcaggagaaaataattaatg

SEQ ID NO: 79871 - DNA, 20 bp, Artificial Sequence
  Description of Artificial Sequence: Synthetic oligonucleotide
  Target: ATXN1; (-) strand; PAM type: NRG; PAM sequence: GAG
cattagtgctaatattgcag

SEQ ID NO: 79872 - DNA, 20 bp, Artificial Sequence
  Description of Artificial Sequence: Synthetic oligonucleotide
  Target: ATXN1; (-) strand; PAM type: NRG; PAM sequence: AGG
atcattagtgctaatattgc

SEQ ID NO: 79873 - DNA, 20 bp, Artificial Sequence
  Description of Artificial Sequence: Synthetic oligonucleotide
  Target: ATXN1; (-) strand; PAM type: NRG; PAM sequence: CAG
aatcattagtgctaatattg

SEQ ID NO: 79874 - DNA, 20 bp, Artificial Sequence
  Description of Artificial Sequence: Synthetic oligonucleotide
  Target: ATXN1; (-) strand; PAM type: NRG; PAM sequence: TAG
attgaagattttctaatcat

SEQ ID NO: 79875 - DNA, 20 bp, Artificial Sequence
  Description of Artificial Sequence: Synthetic oligonucleotide
  Target: ATXN1; (-) strand; PAM type: NRG; PAM sequence: AAG
ttttatttgtgctgctattg

SEQ ID NO: 79876 - DNA, 20 bp, Artificial Sequence
  Description of Artificial Sequence: Synthetic oligonucleotide
  Target: ATXN1; (-) strand; PAM type: NRG; PAM sequence: TGG
acggaggctgtaccaaggat

SEQ ID NO: 79877 - DNA, 20 bp, Artificial Sequence
  Description of Artificial Sequence: Synthetic oligonucleotide
  Target: ATXN1; (-) strand; PAM type: NRG; PAM sequence: AGG
tctgtacggaggctgtacca

SEQ ID NO: 79878 - DNA, 20 bp, Artificial Sequence
  Description of Artificial Sequence: Synthetic oligonucleotide
  Target: ATXN1; (-) strand; PAM type: NRG; PAM sequence: AAG
atctgtacggaggctgtacc

SEQ ID NO: 79879 - DNA, 20 bp, Artificial Sequence
  Description of Artificial Sequence: Synthetic oligonucleotide
  Target: ATXN1; (-) strand; PAM type: NRG; PAM sequence: AGG
tccagtatggatctgtacgg

SEQ ID NO: 79880 - DNA, 20 bp, Artificial Sequence
  Description of Artificial Sequence: Synthetic oligonucleotide
  Target: ATXN1; (-) strand; PAM type: NRG; PAM sequence: GAG
gtccagtatggatctgtacg

SEQ ID NO: 79881 - DNA, 20 bp, Artificial Sequence
  Description of Artificial Sequence: Synthetic oligonucleotide
  Target: ATXN1; (-) strand; PAM type: NRG; PAM sequence: CGG
cagtccagtatggatctgta

SEQ ID NO: 79882 - DNA, 20 bp, Artificial Sequence
  Description of Artificial Sequence: Synthetic oligonucleotide
  Target: ATXN1; (-) strand; PAM type: NRG; PAM sequence: TGG
gctgaatgaacagtccagta

SEQ ID NO: 79883 - DNA, 20 bp, Artificial Sequence
  Description of Artificial Sequence: Synthetic oligonucleotide
  Target: ATXN1; (-) strand; PAM type: NRG; PAM sequence: CAG
tgggtgctgaatgaacagtc

SEQ ID NO: 79884 - DNA, 20 bp, Artificial Sequence
  Description of Artificial Sequence: Synthetic oligonucleotide
  Target: ATXN1; (-) strand; PAM type: NRG; PAM sequence: CAG
aatactgggtgctgaatgaa

SEQ ID NO: 79885 - DNA, 20 bp, Artificial Sequence
  Description of Artificial Sequence: Synthetic oligonucleotide
  Target: ATXN1; (-) strand; PAM type: NRG; PAM sequence: GGG
taggcaaattccagaatact

SEQ ID NO: 79886 - DNA, 20 bp, Artificial Sequence
  Description of Artificial Sequence: Synthetic oligonucleotide
  Target: ATXN1; (-) strand; PAM type: NRG; PAM sequence: TGG
ataggcaaattccagaatac

SEQ ID NO: 79887 - DNA, 20 bp, Artificial Sequence
  Description of Artificial Sequence: Synthetic oligonucleotide
  Target: ATXN1; (-) strand; PAM type: NRG; PAM sequence: CAG
ctgcattaataggcaaattc

SEQ ID NO: 79888 - DNA, 20 bp, Artificial Sequence
  Description of Artificial Sequence: Synthetic oligonucleotide
  Target: ATXN1; (-) strand; PAM type: NRG; PAM sequence: AGG
ctgcttccacctgcattaat

SEQ ID NO: 79889 - DNA, 20 bp, Artificial Sequence
  Description of Artificial Sequence: Synthetic oligonucleotide
  Target: ATXN1; (-) strand; PAM type: NRG; PAM sequence: TAG
actgcttccacctgcattaa

SEQ ID NO: 79890 - DNA, 20 bp, Artificial Sequence
  Description of Artificial Sequence: Synthetic oligonucleotide
  Target: ATXN1; (-) strand; PAM type: NRG; PAM sequence: AGG
ttgggtcatattgtatgaac

SEQ ID NO: 79891 - DNA, 20 bp, Artificial Sequence
  Description of Artificial Sequence: Synthetic oligonucleotide
  Target: ATXN1; (-) strand; PAM type: NRG; PAM sequence: CAG
tttgggtcatattgtatgaa

SEQ ID NO: 79892 - DNA, 20 bp, Artificial Sequence
  Description of Artificial Sequence: Synthetic oligonucleotide
  Target: ATXN1; (-) strand; PAM type: NRG; PAM sequence: GGG
tcacattgaatttggagttt

SEQ ID NO: 79893 - DNA, 20 bp, Artificial Sequence
  Description of Artificial Sequence: Synthetic oligonucleotide
  Target: ATXN1; (-) strand; PAM type: NRG; PAM sequence: TGG
ttcacattgaatttggagtt

SEQ ID NO: 79894 - DNA, 20 bp, Artificial Sequence
  Description of Artificial Sequence: Synthetic oligonucleotide
  Target: ATXN1; (-) strand; PAM type: NRG; PAM sequence: GAG
aaaaattcacattgaatttg

SEQ ID NO: 79895 - DNA, 20 bp, Artificial Sequence
  Description of Artificial Sequence: Synthetic oligonucleotide
  Target: ATXN1; (-) strand; PAM type: NRG; PAM sequence: TGG
ccaaaaattcacattgaatt

SEQ ID NO: 79896 - DNA, 20 bp, Artificial Sequence
  Description of Artificial Sequence: Synthetic oligonucleotide
  Target: ATXN1; (-) strand; PAM type: NRG; PAM sequence: GGG
acgggcacggctgggccttg

SEQ ID NO: 79897 - DNA, 20 bp, Artificial Sequence
  Description of Artificial Sequence: Synthetic oligonucleotide
  Target: ATXN1; (-) strand; PAM type: NRG; PAM sequence: GGG
gacgggcacggctgggcctt

SEQ ID NO: 79898 - DNA, 20 bp, Artificial Sequence
  Description of Artificial Sequence: Synthetic oligonucleotide
  Target: ATXN1; (-) strand; PAM type: NRG; PAM sequence: TGG
ggacgggcacggctgggcct

SEQ ID NO: 79899 - DNA, 20 bp, Artificial Sequence
  Description of Artificial Sequence: Synthetic oligonucleotide
  Target: ATXN1; (-) strand; PAM type: NRG; PAM sequence: GGG
ttttagggacgggcacggct

SEQ ID NO: 79900 - DNA, 20 bp, Artificial Sequence
  Description of Artificial Sequence: Synthetic oligonucleotide
  Target: ATXN1; (-) strand; PAM type: NRG; PAM sequence: TGG
attttagggacgggcacggc

SEQ ID NO: 79901 - DNA, 20 bp, Artificial Sequence
  Description of Artificial Sequence: Synthetic oligonucleotide
  Target: ATXN1; (-) strand; PAM type: NRG; PAM sequence: CGG
atggattttagggacgggca

SEQ ID NO: 79902 - DNA, 20 bp, Artificial Sequence
  Description of Artificial Sequence: Synthetic oligonucleotide
  Target: ATXN1; (-) strand; PAM type: NRG; PAM sequence: GGG
atcccatggattttagggac

SEQ ID NO: 79903 - DNA, 20 bp, Artificial Sequence
  Description of Artificial Sequence: Synthetic oligonucleotide
  Target: ATXN1; (-) strand; PAM type: NRG; PAM sequence: CGG
tatcccatggattttaggga

SEQ ID NO: 79904 - DNA, 20 bp, Artificial Sequence
  Description of Artificial Sequence: Synthetic oligonucleotide
  Target: ATXN1; (-) strand; PAM type: NRG; PAM sequence: GGG
tggatatcccatggatttta

SEQ ID NO: 79905 - DNA, 20 bp, Artificial Sequence
  Description of Artificial Sequence: Synthetic oligonucleotide
  Target: ATXN1; (-) strand; PAM type: NRG; PAM sequence: AGG
gtggatatcccatggatttt

SEQ ID NO: 79906 - DNA, 20 bp, Artificial Sequence
  Description of Artificial Sequence: Synthetic oligonucleotide
  Target: ATXN1; (-) strand; PAM type: NRG; PAM sequence: TAG
cgtggatatcccatggattt

SEQ ID NO: 79907 - DNA, 20 bp, Artificial Sequence
  Description of Artificial Sequence: Synthetic oligonucleotide
  Target: ATXN1; (-) strand; PAM type: NRG; PAM sequence: TGG
gagggcacgtggatatccca

SEQ ID NO: 79908 - DNA, 20 bp, Artificial Sequence
  Description of Artificial Sequence: Synthetic oligonucleotide
  Target: ATXN1; (-) strand; PAM type: NRG; PAM sequence: TGG
gggattttgatgagggcacg

SEQ ID NO: 79909 - DNA, 20 bp, Artificial Sequence
  Description of Artificial Sequence: Synthetic oligonucleotide
  Target: ATXN1; (-) strand; PAM type: NRG; PAM sequence: GGG
agaaacggggattttgatga

SEQ ID NO: 79910 - DNA, 20 bp, Artificial Sequence
  Description of Artificial Sequence: Synthetic oligonucleotide
  Target: ATXN1; (-) strand; PAM type: NRG; PAM sequence: AGG
aagaaacggggattttgatg

SEQ ID NO: 79911 - DNA, 20 bp, Artificial Sequence
  Description of Artificial Sequence: Synthetic oligonucleotide
  Target: ATXN1; (-) strand; PAM type: NRG; PAM sequence: GAG
taagaaacggggattttgat

SEQ ID NO: 79912 - DNA, 20 bp, Artificial Sequence
  Description of Artificial Sequence: Synthetic oligonucleotide
  Target: ATXN1; (-) strand; PAM type: NRG; PAM sequence: GGG
gagggagcttctaagaaacg

SEQ ID NO: 79913 - DNA, 20 bp, Artificial Sequence
  Description of Artificial Sequence: Synthetic oligonucleotide
  Target: ATXN1; (-) strand; PAM type: NRG; PAM sequence: GGG
agagggagcttctaagaaac

SEQ ID NO: 79914 - DNA, 20 bp, Artificial Sequence
  Description of Artificial Sequence: Synthetic oligonucleotide
  Target: ATXN1; (-) strand; PAM type: NRG; PAM sequence: CGG
tagagggagcttctaagaaa

SEQ ID NO: 79915 - DNA, 20 bp, Artificial Sequence
  Description of Artificial Sequence: Synthetic oligonucleotide
  Target: ATXN1; (-) strand; PAM type: NRG; PAM sequence: AAG
actcactagagggagcttct

SEQ ID NO: 79916 - DNA, 20 bp, Artificial Sequence
  Description of Artificial Sequence: Synthetic oligonucleotide
  Target: ATXN1; (-) strand; PAM type: NRG; PAM sequence: GAG
taaaagtaactcactagagg

SEQ ID NO: 79917 - DNA, 20 bp, Artificial Sequence
  Description of Artificial Sequence: Synthetic oligonucleotide
  Target: ATXN1; (-) strand; PAM type: NRG; PAM sequence: GGG
agtaaaagtaactcactaga

SEQ ID NO: 79918 - DNA, 20 bp, Artificial Sequence
  Description of Artificial Sequence: Synthetic oligonucleotide
  Target: ATXN1; (-) strand; PAM type: NRG; PAM sequence: AGG
cagtaaaagtaactcactag

SEQ ID NO: 79919 - DNA, 20 bp, Artificial Sequence
  Description of Artificial Sequence: Synthetic oligonucleotide
  Target: ATXN1; (-) strand; PAM type: NRG; PAM sequence: GAG
ccagtaaaagtaactcacta

SEQ ID NO: 79920 - DNA, 20 bp, Artificial Sequence
  Description of Artificial Sequence: Synthetic oligonucleotide
  Target: ATXN1; (-) strand; PAM type: NRG; PAM sequence: TAG
tgccagtaaaagtaactcac

SEQ ID NO: 79921 - DNA, 20 bp, Artificial Sequence
  Description of Artificial Sequence: Synthetic oligonucleotide
  Target: ATXN1; (-) strand; PAM type: NRG; PAM sequence: AAG
gtattctttattgccagtaa

SEQ ID NO: 79922 - DNA, 20 bp, Artificial Sequence
  Description of Artificial Sequence: Synthetic oligonucleotide
  Target: ATXN1; (-) strand; PAM type: NRG; PAM sequence: CAG
taattagtattctttattgc

SEQ ID NO: 79923 - DNA, 20 bp, Artificial Sequence
  Description of Artificial Sequence: Synthetic oligonucleotide
  Target: ATXN1; (-) strand; PAM type: NRG; PAM sequence: TAG
tgaaatatggttttgctaat

SEQ ID NO: 79924 - DNA, 20 bp, Artificial Sequence
  Description of Artificial Sequence: Synthetic oligonucleotide
  Target: ATXN1; (-) strand; PAM type: NRG; PAM sequence: TGG
atttgtttgtgtgtgaaata

SEQ ID NO: 79925 - DNA, 20 bp, Artificial Sequence
  Description of Artificial Sequence: Synthetic oligonucleotide
  Target: ATXN1; (-) strand; PAM type: NRG; PAM sequence: AAG
ttaagaaataggttatttta

SEQ ID NO: 79926 - DNA, 20 bp, Artificial Sequence
  Description of Artificial Sequence: Synthetic oligonucleotide
  Target: ATXN1; (-) strand; PAM type: NRG; PAM sequence: AGG
aaaataaaagcttaagaaat

SEQ ID NO: 79927 - DNA, 20 bp, Artificial Sequence
  Description of Artificial Sequence: Synthetic oligonucleotide
  Target: ATXN1; (-) strand; PAM type: NRG; PAM sequence: TAG
taaaataaaagcttaagaaa

SEQ ID NO: 79928 - DNA, 20 bp, Artificial Sequence
  Description of Artificial Sequence: Synthetic oligonucleotide
  Target: ATXN1; (-) strand; PAM type: NRG; PAM sequence: AAG
tgaacctaaaataaaagctt

SEQ ID NO: 79929 - DNA, 20 bp, Artificial Sequence
  Description of Artificial Sequence: Synthetic oligonucleotide
  Target: ATXN1; (-) strand; PAM type: NRG; PAM sequence: AAG
tacccctgaacctaaaataa

SEQ ID NO: 79930 - DNA, 20 bp, Artificial Sequence
  Description of Artificial Sequence: Synthetic oligonucleotide
  Target: ATXN1; (-) strand; PAM type: NRG; PAM sequence: GAG
acaacaaacccccatggcat

SEQ ID NO: 79931 - DNA, 20 bp, Artificial Sequence
  Description of Artificial Sequence: Synthetic oligonucleotide
  Target: ATXN1; (-) strand; PAM type: NRG; PAM sequence: TGG
atctgtacaacaaaccccca

SEQ ID NO: 79932 - DNA, 20 bp, Artificial Sequence
  Description of Artificial Sequence: Synthetic oligonucleotide
  Target: ATXN1; (-) strand; PAM type: NRG; PAM sequence: GGG
gggtactaggcttagtatct

SEQ ID NO: 79933 - DNA, 20 bp, Artificial Sequence
  Description of Artificial Sequence: Synthetic oligonucleotide
  Target: ATXN1; (-) strand; PAM type: NRG; PAM sequence: TGG
tgggtactaggcttagtatc

SEQ ID NO: 79934 - DNA, 20 bp, Artificial Sequence
  Description of Artificial Sequence: Synthetic oligonucleotide
  Target: ATXN1; (-) strand; PAM type: NRG; PAM sequence: TAG
caattattgggtactaggct

SEQ ID NO: 79935 - DNA, 20 bp, Artificial Sequence
  Description of Artificial Sequence: Synthetic oligonucleotide
  Target: ATXN1; (-) strand; PAM type: NRG; PAM sequence: AGG
aaaaacaattattgggtact

SEQ ID NO: 79936 - DNA, 20 bp, Artificial Sequence
  Description of Artificial Sequence: Synthetic oligonucleotide
  Target: ATXN1; (-) strand; PAM type: NRG; PAM sequence: TAG
aaaaaacaattattgggtac

SEQ ID NO: 79937 - DNA, 20 bp, Artificial Sequence
  Description of Artificial Sequence: Synthetic oligonucleotide
  Target: ATXN1; (-) strand; PAM type: NRG; PAM sequence: GGG
gagcagaaaaaacaattatt

SEQ ID NO: 79938 - DNA, 20 bp, Artificial Sequence
  Description of Artificial Sequence: Synthetic oligonucleotide
  Target: ATXN1; (-) strand; PAM type: NRG; PAM sequence: TGG
ggagcagaaaaaacaattat

SEQ ID NO: 79939 - DNA, 20 bp, Artificial Sequence
  Description of Artificial Sequence: Synthetic oligonucleotide
  Target: ATXN1; (-) strand; PAM type: NRG; PAM sequence: CAG
gggtggaggaggaagaggag

SEQ ID NO: 79940 - DNA, 20 bp, Artificial Sequence
  Description of Artificial Sequence: Synthetic oligonucleotide
  Target: ATXN1; (-) strand; PAM type: NRG; PAM sequence: GAG
agagggtggaggaggaagag

SEQ ID NO: 79941 - DNA, 20 bp, Artificial Sequence
  Description of Artificial Sequence: Synthetic oligonucleotide
  Target: ATXN1; (-) strand; PAM type: NRG; PAM sequence: AGG
gtagagggtggaggaggaag

SEQ ID NO: 79942 - DNA, 20 bp, Artificial Sequence
  Description of Artificial Sequence: Synthetic oligonucleotide
  Target: ATXN1; (-) strand; PAM type: NRG; PAM sequence: GAG
ggtagagggtggaggaggaa

SEQ ID NO: 79943 - DNA, 20 bp, Artificial Sequence
  Description of Artificial Sequence: Synthetic oligonucleotide
  Target: ATXN1; (-) strand; PAM type: NRG; PAM sequence: AAG
agggtagagggtggaggagg

SEQ ID NO: 79944 - DNA, 20 bp, Artificial Sequence
  Description of Artificial Sequence: Synthetic oligonucleotide
  Target: ATXN1; (-) strand; PAM type: NRG; PAM sequence: AGG
ttgagggtagagggtggagg

SEQ ID NO: 79945 - DNA, 20 bp, Artificial Sequence
  Description of Artificial Sequence: Synthetic oligonucleotide
  Target: ATXN1; (-) strand; PAM type: NRG; PAM sequence: GAG
cttgagggtagagggtggag

SEQ ID NO: 79946 - DNA, 20 bp, Artificial Sequence
  Description of Artificial Sequence: Synthetic oligonucleotide
  Target: ATXN1; (-) strand; PAM type: NRG; PAM sequence: AGG
tacttgagggtagagggtgg

SEQ ID NO: 79947 - DNA, 20 bp, Artificial Sequence
  Description of Artificial Sequence: Synthetic oligonucleotide
  Target: ATXN1; (-) strand; PAM type: NRG; PAM sequence: GAG
ctacttgagggtagagggtg

SEQ ID NO: 79948 - DNA, 20 bp, Artificial Sequence
  Description of Artificial Sequence: Synthetic oligonucleotide
  Target: ATXN1; (-) strand; PAM type: NRG; PAM sequence: TGG
tcctacttgagggtagaggg

SEQ ID NO: 79949 - DNA, 20 bp, Artificial Sequence
  Description of Artificial Sequence: Synthetic oligonucleotide
  Target: ATXN1; (-) strand; PAM type: NRG; PAM sequence: GGG
gggtcctacttgagggtaga

SEQ ID NO: 79950 - DNA, 20 bp, Artificial Sequence
  Description of Artificial Sequence: Synthetic oligonucleotide
  Target: ATXN1; (-) strand; PAM type: NRG; PAM sequence: AGG
tgggtcctacttgagggtag

SEQ ID NO: 79951 - DNA, 20 bp, Artificial Sequence
  Description of Artificial Sequence: Synthetic oligonucleotide
  Target: ATXN1; (-) strand; PAM type: NRG; PAM sequence: GAG
ctgggtcctacttgagggta

SEQ ID NO: 79952 - DNA, 20 bp, Artificial Sequence
  Description of Artificial Sequence: Synthetic oligonucleotide
  Target: ATXN1; (-) strand; PAM type: NRG; PAM sequence: TAG
cactgggtcctacttgaggg

SEQ ID NO: 79953 - DNA, 20 bp, Artificial Sequence
  Description of Artificial Sequence: Synthetic oligonucleotide
  Target: ATXN1; (-) strand; PAM type: NRG; PAM sequence: GGG
agacactgggtcctacttga

SEQ ID NO: 79954 - DNA, 20 bp, Artificial Sequence
  Description of Artificial Sequence: Synthetic oligonucleotide
  Target: ATXN1; (-) strand; PAM type: NRG; PAM sequence: AGG
cagacactgggtcctacttg

SEQ ID NO: 79955 - DNA, 20 bp, Artificial Sequence
  Description of Artificial Sequence: Synthetic oligonucleotide
  Target: ATXN1; (-) strand; PAM type: NRG; PAM sequence: GAG
gcagacactgggtcctactt

SEQ ID NO: 79956 - DNA, 20 bp, Artificial Sequence
  Description of Artificial Sequence: Synthetic oligonucleotide
  Target: ATXN1; (-) strand; PAM type: NRG; PAM sequence: GGG
agaagggaacagcagacact

SEQ ID NO: 79957 - DNA, 20 bp, Artificial Sequence
  Description of Artificial Sequence: Synthetic oligonucleotide
  Target: ATXN1; (-) strand; PAM type: NRG; PAM sequence: TGG
aagaagggaacagcagacac

SEQ ID NO: 79958 - DNA, 20 bp, Artificial Sequence
  Description of Artificial Sequence: Synthetic oligonucleotide
  Target: ATXN1; (-) strand; PAM type: NRG; PAM sequence: CAG
ggacacaaagaagggaacag

SEQ ID NO: 79959 - DNA, 20 bp, Artificial Sequence
  Description of Artificial Sequence: Synthetic oligonucleotide
  Target: ATXN1; (-) strand; PAM type: NRG; PAM sequence: CAG
catggacacaaagaagggaa

SEQ ID NO: 79960 - DNA, 20 bp, Artificial Sequence
  Description of Artificial Sequence: Synthetic oligonucleotide
  Target: ATXN1; (-) strand; PAM type: NRG; PAM sequence: GGG
gaactcatggacacaaagaa

SEQ ID NO: 79961 - DNA, 20 bp, Artificial Sequence
  Description of Artificial Sequence: Synthetic oligonucleotide
  Target: ATXN1; (-) strand; PAM type: NRG; PAM sequence: AGG
agaactcatggacacaaaga

SEQ ID NO: 79962 - DNA, 20 bp, Artificial Sequence
  Description of Artificial Sequence: Synthetic oligonucleotide
  Target: ATXN1; (-) strand; PAM type: NRG; PAM sequence: AAG
gagaactcatggacacaaag

SEQ ID NO: 79963 - DNA, 20 bp, Artificial Sequence
  Description of Artificial Sequence: Synthetic oligonucleotide
  Target: ATXN1; (-) strand; PAM type: NRG; PAM sequence: AAG
gatgagaactcatggacaca

SEQ ID NO: 79964 - DNA, 20 bp, Artificial Sequence
  Description of Artificial Sequence: Synthetic oligonucleotide
  Target: ATXN1; (-) strand; PAM type: NRG; PAM sequence: TGG
agctaaatgatgagaactca

SEQ ID NO: 79965 - DNA, 20 bp, Artificial Sequence
  Description of Artificial Sequence: Synthetic oligonucleotide
  Target: ATXN1; (-) strand; PAM type: NRG; PAM sequence: GAG
acaagtgggagctaaatgat

SEQ ID NO: 79966 - DNA, 20 bp, Artificial Sequence
  Description of Artificial Sequence: Synthetic oligonucleotide
  Target: ATXN1; (-) strand; PAM type: NRG; PAM sequence: GAG
atgttctcacttacaagtgg

SEQ ID NO: 79967 - DNA, 20 bp, Artificial Sequence
  Description of Artificial Sequence: Synthetic oligonucleotide
  Target: ATXN1; (-) strand; PAM type: NRG; PAM sequence: GGG
gcatgttctcacttacaagt

SEQ ID NO: 79968 - DNA, 20 bp, Artificial Sequence
  Description of Artificial Sequence: Synthetic oligonucleotide
  Target: ATXN1; (-) strand; PAM type: NRG; PAM sequence: TGG
tgcatgttctcacttacaag

SEQ ID NO: 79969 - DNA, 20 bp, Artificial Sequence
  Description of Artificial Sequence: Synthetic oligonucleotide
  Target: ATXN1; (-) strand; PAM type: NRG; PAM sequence: AAG
tactgcatgttctcacttac

SEQ ID NO: 79970 - DNA, 20 bp, Artificial Sequence
  Description of Artificial Sequence: Synthetic oligonucleotide
  Target: ATXN1; (-) strand; PAM type: NRG; PAM sequence: AGG
tatccttagcaaactatcac

SEQ ID NO: 79971 - DNA, 20 bp, Artificial Sequence
  Description of Artificial Sequence: Synthetic oligonucleotide
  Target: ATXN1; (-) strand; PAM type: NRG; PAM sequence: CAG
ttatccttagcaaactatca

SEQ ID NO: 79972 - DNA, 20 bp, Artificial Sequence
  Description of Artificial Sequence: Synthetic oligonucleotide
  Target: ATXN1; (-) strand; PAM type: NRG; PAM sequence: TAG
gagctggaggccattatcct

SEQ ID NO: 79973 - DNA, 20 bp, Artificial Sequence
  Description of Artificial Sequence: Synthetic oligonucleotide
  Target: ATXN1; (-) strand; PAM type: NRG; PAM sequence: AGG
aggagtatggaaggagctgg

SEQ ID NO: 79974 - DNA, 20 bp, Artificial Sequence
  Description of Artificial Sequence: Synthetic oligonucleotide
  Target: ATXN1; (-) strand; PAM type: NRG; PAM sequence: GAG
caggagtatggaaggagctg

SEQ ID NO: 79975 - DNA, 20 bp, Artificial Sequence
  Description of Artificial Sequence: Synthetic oligonucleotide
  Target: ATXN1; (-) strand; PAM type: NRG; PAM sequence: TGG
tgcaggagtatggaaggagc

SEQ ID NO: 79976 - DNA, 20 bp, Artificial Sequence
  Description of Artificial Sequence: Synthetic oligonucleotide
  Target: ATXN1; (-) strand; PAM type: NRG; PAM sequence: GAG
cttttgcaggagtatggaag

SEQ ID NO: 79977 - DNA, 20 bp, Artificial Sequence
  Description of Artificial Sequence: Synthetic oligonucleotide
  Target: ATXN1; (-) strand; PAM type: NRG; PAM sequence: AGG
gtcttttgcaggagtatgga

SEQ ID NO: 79978 - DNA, 20 bp, Artificial Sequence
  Description of Artificial Sequence: Synthetic oligonucleotide
  Target: ATXN1; (-) strand; PAM type: NRG; PAM sequence: AAG
tgtcttttgcaggagtatgg

SEQ ID NO: 79979 - DNA, 20 bp, Artificial Sequence
  Description of Artificial Sequence: Synthetic oligonucleotide
  Target: ATXN1; (-) strand; PAM type: NRG; PAM sequence: TGG
tcatgtcttttgcaggagta

SEQ ID NO: 79980 - DNA, 20 bp, Artificial Sequence
  Description of Artificial Sequence: Synthetic oligonucleotide
  Target: ATXN1; (-) strand; PAM type: NRG; PAM sequence: GAG
tgagatcatgtcttttgcag

SEQ ID NO: 79981 - DNA, 20 bp, Artificial Sequence
  Description of Artificial Sequence: Synthetic oligonucleotide
  Target: ATXN1; (-) strand; PAM type: NRG; PAM sequence: AGG
aatgagatcatgtcttttgc

SEQ ID NO: 79982 - DNA, 20 bp, Artificial Sequence
  Description of Artificial Sequence: Synthetic oligonucleotide
  Target: ATXN1; (-) strand; PAM type: NRG; PAM sequence: CAG
gaatgagatcatgtcttttg

SEQ ID NO: 79983 - DNA, 20 bp, Artificial Sequence
  Description of Artificial Sequence: Synthetic oligonucleotide
  Target: ATXN1; (-) strand; PAM type: NRG; PAM sequence: GAG
tgcagccataaaaaaggaat

SEQ ID NO: 79984 - DNA, 20 bp, Artificial Sequence
  Description of Artificial Sequence: Synthetic oligonucleotide
  Target: ATXN1; (-) strand; PAM type: NRG; PAM sequence: AGG
atactatgcagccataaaaa

SEQ ID NO: 79985 - DNA, 20 bp, Artificial Sequence
  Description of Artificial Sequence: Synthetic oligonucleotide
  Target: ATXN1; (-) strand; PAM type: NRG; PAM sequence: AAG
aatactatgcagccataaaa

SEQ ID NO: 79986 - DNA, 20 bp, Artificial Sequence
  Description of Artificial Sequence: Synthetic oligonucleotide
  Target: ATXN1; (-) strand; PAM type: NRG; PAM sequence: CAG
tattaccatggaatactatg

SEQ ID NO: 79987 - DNA, 20 bp, Artificial Sequence
  Description of Artificial Sequence: Synthetic oligonucleotide
  Target: ATXN1; (-) strand; PAM type: NRG; PAM sequence: TGG
aaatgtggtacatattacca

SEQ ID NO: 79988 - DNA, 20 bp, Artificial Sequence
  Description of Artificial Sequence: Synthetic oligonucleotide
  Target: ATXN1; (-) strand; PAM type: NRG; PAM sequence: TGG
cagattggacaaaaaaaatg

SEQ ID NO: 79989 - DNA, 20 bp, Artificial Sequence
  Description of Artificial Sequence: Synthetic oligonucleotide
  Target: ATXN1; (-) strand; PAM type: NRG; PAM sequence: TGG
aatgcccatcaatgacagat

SEQ ID NO: 79990 - DNA, 20 bp, Artificial Sequence
  Description of Artificial Sequence: Synthetic oligonucleotide
  Target: ATXN1; (-) strand; PAM type: NRG; PAM sequence: CAG
acctaaatgcccatcaatga

SEQ ID NO: 79991 - DNA, 20 bp, Artificial Sequence
  Description of Artificial Sequence: Synthetic oligonucleotide
  Target: ATXN1; (-) strand; PAM type: NRG; PAM sequence: CAG
tattcacagtagcaaagaca

SEQ ID NO: 79992 - DNA, 20 bp, Artificial Sequence
  Description of Artificial Sequence: Synthetic oligonucleotide
  Target: ATXN1; (-) strand; PAM type: NRG; PAM sequence: AAG
cagcactattcacagtagca

SEQ ID NO: 79993 - DNA, 20 bp, Artificial Sequence
  Description of Artificial Sequence: Synthetic oligonucleotide
  Target: ATXN1; (-) strand; PAM type: NRG; PAM sequence: TAG
cattgcagcactattcacag

SEQ ID NO: 79994 - DNA, 20 bp, Artificial Sequence
  Description of Artificial Sequence: Synthetic oligonucleotide
  Target: ATXN1; (-) strand; PAM type: NRG; PAM sequence: CAG
gttcattgcagcactattca

SEQ ID NO: 79995 - DNA, 20 bp, Artificial Sequence
  Description of Artificial Sequence: Synthetic oligonucleotide
  Target: ATXN1; (-) strand; PAM type: NRG; PAM sequence: CAG
atgcacgcaaatgttcattg

SEQ ID NO: 79996 - DNA, 20 bp, Artificial Sequence
  Description of Artificial Sequence: Synthetic oligonucleotide
  Target: ATXN1; (-) strand; PAM type: NRG; PAM sequence: TAG
aaatcattctaccataaatt

SEQ ID NO: 79997 - DNA, 20 bp, Artificial Sequence
  Description of Artificial Sequence: Synthetic oligonucleotide
  Target: ATXN1; (-) strand; PAM type: NRG; PAM sequence: AGG
attactgggtatctacccag

SEQ ID NO: 79998 - DNA, 20 bp, Artificial Sequence
  Description of Artificial Sequence: Synthetic oligonucleotide
  Target: ATXN1; (-) strand; PAM type: NRG; PAM sequence: GAG
cattactgggtatctaccca

SEQ ID NO: 79999 - DNA, 20 bp, Artificial Sequence
  Description of Artificial Sequence: Synthetic oligonucleotide
  Target: ATXN1; (-) strand; PAM type: NRG; PAM sequence: CAG
cccattactgggtatctacc

SEQ ID NO: 80000 - DNA, 20 bp, Artificial Sequence
  Description of Artificial Sequence: Synthetic oligonucleotide
  Target: ATXN1; (-) strand; PAM type: NRG; PAM sequence: GGG
gacccagcaatcccattact

SEQ ID NO: 80001 - DNA, 20 bp, Artificial Sequence
  Description of Artificial Sequence: Synthetic oligonucleotide
  Target: ATXN1; (-) strand; PAM type: NRG; PAM sequence: TGG
cgacccagcaatcccattac

SEQ ID NO: 80002 - DNA, 20 bp, Artificial Sequence
  Description of Artificial Sequence: Synthetic oligonucleotide
  Target: ATXN1; (-) strand; PAM type: NRG; PAM sequence: CAG
agcagaactaccattcgacc

SEQ ID NO: 80003 - DNA, 20 bp, Artificial Sequence
  Description of Artificial Sequence: Synthetic oligonucleotide
  Target: ATXN1; (-) strand; PAM type: NRG; PAM sequence: CAG
attctgcaaagagctaaaag

SEQ ID NO: 80004 - DNA, 20 bp, Artificial Sequence
  Description of Artificial Sequence: Synthetic oligonucleotide
  Target: ATXN1; (-) strand; PAM type: NRG; PAM sequence: AAG
gcaattctgcaaagagctaa

SEQ ID NO: 80005 - DNA, 20 bp, Artificial Sequence
  Description of Artificial Sequence: Synthetic oligonucleotide
  Target: ATXN1; (-) strand; PAM type: NRG; PAM sequence: GAG
cagtgtggcaattctgcaaa

SEQ ID NO: 80006 - DNA, 20 bp, Artificial Sequence
  Description of Artificial Sequence: Synthetic oligonucleotide
  Target: ATXN1; (-) strand; PAM type: NRG; PAM sequence: AAG
ggcagtgtggcaattctgca

SEQ ID NO: 80007 - DNA, 20 bp, Artificial Sequence
  Description of Artificial Sequence: Synthetic oligonucleotide
  Target: ATXN1; (-) strand; PAM type: NRG; PAM sequence: TGG
agccattgtggaaggcagtg

SEQ ID NO: 80008 - DNA, 20 bp, Artificial Sequence
  Description of Artificial Sequence: Synthetic oligonucleotide
  Target: ATXN1; (-) strand; PAM type: NRG; PAM sequence: CAG
agttcagccattgtggaagg

SEQ ID NO: 80009 - DNA, 20 bp, Artificial Sequence
  Description of Artificial Sequence: Synthetic oligonucleotide
  Target: ATXN1; (-) strand; PAM type: NRG; PAM sequence: AGG
attagttcagccattgtgga

SEQ ID NO: 80010 - DNA, 20 bp, Artificial Sequence
  Description of Artificial Sequence: Synthetic oligonucleotide
  Target: ATXN1; (-) strand; PAM type: NRG; PAM sequence: AAG
aattagttcagccattgtgg

SEQ ID NO: 80011 - DNA, 20 bp, Artificial Sequence
  Description of Artificial Sequence: Synthetic oligonucleotide
  Target: ATXN1; (-) strand; PAM type: NRG; PAM sequence: TGG
acaaattagttcagccattg

SEQ ID NO: 80012 - DNA, 20 bp, Artificial Sequence
  Description of Artificial Sequence: Synthetic oligonucleotide
  Target: ATXN1; (-) strand; PAM type: NRG; PAM sequence: CAG
ggtgagtgtacaaattagtt

SEQ ID NO: 80013 - DNA, 20 bp, Artificial Sequence
  Description of Artificial Sequence: Synthetic oligonucleotide
  Target: ATXN1; (-) strand; PAM type: NRG; PAM sequence: TAG
ctgttggtgagtgtacaaat

SEQ ID NO: 80014 - DNA, 20 bp, Artificial Sequence
  Description of Artificial Sequence: Synthetic oligonucleotide
  Target: ATXN1; (-) strand; PAM type: NRG; PAM sequence: GAG
aacacttatacactgttggt

SEQ ID NO: 80015 - DNA, 20 bp, Artificial Sequence
  Description of Artificial Sequence: Synthetic oligonucleotide
  Target: ATXN1; (-) strand; PAM type: NRG; PAM sequence: TGG
agggaacacttatacactgt

SEQ ID NO: 80016 - DNA, 20 bp, Artificial Sequence
  Description of Artificial Sequence: Synthetic oligonucleotide
  Target: ATXN1; (-) strand; PAM type: NRG; PAM sequence: GGG
ctgatgaggttgcggagaaa

SEQ ID NO: 80017 - DNA, 20 bp, Artificial Sequence
  Description of Artificial Sequence: Synthetic oligonucleotide
  Target: ATXN1; (-) strand; PAM type: NRG; PAM sequence: AGG
gctgatgaggttgcggagaa

SEQ ID NO: 80018 - DNA, 20 bp, Artificial Sequence
  Description of Artificial Sequence: Synthetic oligonucleotide
  Target: ATXN1; (-) strand; PAM type: NRG; PAM sequence: AAG
tgctgatgaggttgcggaga

SEQ ID NO: 80019 - DNA, 20 bp, Artificial Sequence
  Description of Artificial Sequence: Synthetic oligonucleotide
  Target: ATXN1; (-) strand; PAM type: NRG; PAM sequence: GAG
tggatgctgatgaggttgcg

SEQ ID NO: 80020 - DNA, 20 bp, Artificial Sequence
  Description of Artificial Sequence: Synthetic oligonucleotide
  Target: ATXN1; (-) strand; PAM type: NRG; PAM sequence: CGG
gttggatgctgatgaggttg

SEQ ID NO: 80021 - DNA, 20 bp, Artificial Sequence
  Description of Artificial Sequence: Synthetic oligonucleotide
  Target: ATXN1; (-) strand; PAM type: NRG; PAM sequence: AGG
taaccagttggatgctgatg

SEQ ID NO: 80022 - DNA, 20 bp, Artificial Sequence
  Description of Artificial Sequence: Synthetic oligonucleotide
  Target: ATXN1; (-) strand; PAM type: NRG; PAM sequence: GAG
ataaccagttggatgctgat

SEQ ID NO: 80023 - DNA, 20 bp, Artificial Sequence
  Description of Artificial Sequence: Synthetic oligonucleotide
  Target: ATXN1; (-) strand; PAM type: NRG; PAM sequence: TGG
aaagtcaaaaaataaccagt

SEQ ID NO: 80024 - DNA, 20 bp, Artificial Sequence
  Description of Artificial Sequence: Synthetic oligonucleotide
  Target: ATXN1; (-) strand; PAM type: NRG; PAM sequence: CAG
ttaaaaagtcaaaaaataac

SEQ ID NO: 80025 - DNA, 20 bp, Artificial Sequence
  Description of Artificial Sequence: Synthetic oligonucleotide
  Target: ATXN1; (-) strand; PAM type: NRG; PAM sequence: AAG
tcagaatggctgttgttaaa

SEQ ID NO: 80026 - DNA, 20 bp, Artificial Sequence
  Description of Artificial Sequence: Synthetic oligonucleotide
  Target: ATXN1; (-) strand; PAM type: NRG; PAM sequence: TGG
ctatctcataccagtcagaa

SEQ ID NO: 80027 - DNA, 20 bp, Artificial Sequence
  Description of Artificial Sequence: Synthetic oligonucleotide
  Target: ATXN1; (-) strand; PAM type: NRG; PAM sequence: CAG
agatactatctcataccagt

SEQ ID NO: 80028 - DNA, 20 bp, Artificial Sequence
  Description of Artificial Sequence: Synthetic oligonucleotide
  Target: ATXN1; (-) strand; PAM type: NRG; PAM sequence: CAG
aatgagatactatctcatac

SEQ ID NO: 80029 - DNA, 20 bp, Artificial Sequence
  Description of Artificial Sequence: Synthetic oligonucleotide
  Target: ATXN1; (-) strand; PAM type: NRG; PAM sequence: GAG
acgcaaatcaaaagcacaat

SEQ ID NO: 80030 - DNA, 20 bp, Artificial Sequence
  Description of Artificial Sequence: Synthetic oligonucleotide
  Target: ATXN1; (-) strand; PAM type: NRG; PAM sequence: AAG
attagagcaacgcaaatcaa

SEQ ID NO: 80031 - DNA, 20 bp, Artificial Sequence
  Description of Artificial Sequence: Synthetic oligonucleotide
  Target: ATXN1; (-) strand; PAM type: NRG; PAM sequence: GAG
ctcaatatcgctggtcatta

SEQ ID NO: 80032 - DNA, 20 bp, Artificial Sequence
  Description of Artificial Sequence: Synthetic oligonucleotide
  Target: ATXN1; (-) strand; PAM type: NRG; PAM sequence: TAG
agctcaatatcgctggtcat

SEQ ID NO: 80033 - DNA, 20 bp, Artificial Sequence
  Description of Artificial Sequence: Synthetic oligonucleotide
  Target: ATXN1; (-) strand; PAM type: NRG; PAM sequence: TGG
gaaaagcagctcaatatcgc

SEQ ID NO: 80034 - DNA, 20 bp, Artificial Sequence
  Description of Artificial Sequence: Synthetic oligonucleotide
  Target: ATXN1; (-) strand; PAM type: NRG; PAM sequence: CAG
gccaataagaatatgaaaag

SEQ ID NO: 80035 - DNA, 20 bp, Artificial Sequence
  Description of Artificial Sequence: Synthetic oligonucleotide
  Target: ATXN1; (-) strand; PAM type: NRG; PAM sequence: AAG
atggccaataagaatatgaa

SEQ ID NO: 80036 - DNA, 20 bp, Artificial Sequence
  Description of Artificial Sequence: Synthetic oligonucleotide
  Target: ATXN1; (-) strand; PAM type: NRG; PAM sequence: AAG
aaagaagacatatggccaat

SEQ ID NO: 80037 - DNA, 20 bp, Artificial Sequence
  Description of Artificial Sequence: Synthetic oligonucleotide
  Target: ATXN1; (-) strand; PAM type: NRG; PAM sequence: TGG
acttttcaaaagaagacata

SEQ ID NO: 80038 - DNA, 20 bp, Artificial Sequence
  Description of Artificial Sequence: Synthetic oligonucleotide
  Target: ATXN1; (-) strand; PAM type: NRG; PAM sequence: AAG
gaacagacacttttcaaaag

SEQ ID NO: 80039 - DNA, 20 bp, Artificial Sequence
  Description of Artificial Sequence: Synthetic oligonucleotide
  Target: ATXN1; (-) strand; PAM type: NRG; PAM sequence: AAG
catgaacagacacttttcaa

SEQ ID NO: 80040 - DNA, 20 bp, Artificial Sequence
  Description of Artificial Sequence: Synthetic oligonucleotide
  Target: ATXN1; (-) strand; PAM type: NRG; PAM sequence: CAG
aagtgagcaaaggacatgaa

SEQ ID NO: 80041 - DNA, 20 bp, Artificial Sequence
  Description of Artificial Sequence: Synthetic oligonucleotide
  Target: ATXN1; (-) strand; PAM type: NRG; PAM sequence: AGG
ccccatgaaaaagtgagcaa

SEQ ID NO: 80042 - DNA, 20 bp, Artificial Sequence
  Description of Artificial Sequence: Synthetic oligonucleotide
  Target: ATXN1; (-) strand; PAM type: NRG; PAM sequence: AAG
accccatgaaaaagtgagca

SEQ ID NO: 80043 - DNA, 20 bp, Artificial Sequence
  Description of Artificial Sequence: Synthetic oligonucleotide
  Target: ATXN1; (-) strand; PAM type: NRG; PAM sequence: GAG
tttcaaccccatgaaaaagt

SEQ ID NO: 80044 - DNA, 20 bp, Artificial Sequence
  Description of Artificial Sequence: Synthetic oligonucleotide
  Target: ATXN1; (-) strand; PAM type: NRG; PAM sequence: AAG
ttactttcaaccccatgaaa

SEQ ID NO: 80045 - DNA, 20 bp, Artificial Sequence
  Description of Artificial Sequence: Synthetic oligonucleotide
  Target: ATXN1; (-) strand; PAM type: NRG; PAM sequence: AGG
ctcagggggaggcggggaga

SEQ ID NO: 80046 - DNA, 20 bp, Artificial Sequence
  Description of Artificial Sequence: Synthetic oligonucleotide
  Target: ATXN1; (-) strand; PAM type: NRG; PAM sequence: AAG
cctcagggggaggcggggag

SEQ ID NO: 80047 - DNA, 20 bp, Artificial Sequence
  Description of Artificial Sequence: Synthetic oligonucleotide
  Target: ATXN1; (-) strand; PAM type: NRG; PAM sequence: GAG
ctgcctcagggggaggcggg

SEQ ID NO: 80048 - DNA, 20 bp, Artificial Sequence
  Description of Artificial Sequence: Synthetic oligonucleotide
  Target: ATXN1; (-) strand; PAM type: NRG; PAM sequence: GGG
ctctgcctcagggggaggcg

SEQ ID NO: 80049 - DNA, 20 bp, Artificial Sequence
  Description of Artificial Sequence: Synthetic oligonucleotide
  Target: ATXN1; (-) strand; PAM type: NRG; PAM sequence: GGG
actctgcctcagggggaggc

SEQ ID NO: 80050 - DNA, 20 bp, Artificial Sequence
  Description of Artificial Sequence: Synthetic oligonucleotide
  Target: ATXN1; (-) strand; PAM type: NRG; PAM sequence: CGG
gactctgcctcagggggagg

SEQ ID NO: 80051 - DNA, 20 bp, Artificial Sequence
  Description of Artificial Sequence: Synthetic oligonucleotide
  Target: ATXN1; (-) strand; PAM type: NRG; PAM sequence: AGG
catgactctgcctcaggggg

SEQ ID NO: 80052 - DNA, 20 bp, Artificial Sequence
  Description of Artificial Sequence: Synthetic oligonucleotide
  Target: ATXN1; (-) strand; PAM type: NRG; PAM sequence: GAG
gcatgactctgcctcagggg

SEQ ID NO: 80053 - DNA, 20 bp, Artificial Sequence
  Description of Artificial Sequence: Synthetic oligonucleotide
  Target: ATXN1; (-) strand; PAM type: NRG; PAM sequence: GGG
gagcatgactctgcctcagg

SEQ ID NO: 80054 - DNA, 20 bp, Artificial Sequence
  Description of Artificial Sequence: Synthetic oligonucleotide
  Target: ATXN1; (-) strand; PAM type: NRG; PAM sequence: GGG
agagcatgactctgcctcag

SEQ ID NO: 80055 - DNA, 20 bp, Artificial Sequence
  Description of Artificial Sequence: Synthetic oligonucleotide
  Target: ATXN1; (-) strand; PAM type: NRG; PAM sequence: GGG
cagagcatgactctgcctca

SEQ ID NO: 80056 - DNA, 20 bp, Artificial Sequence
  Description of Artificial Sequence: Synthetic oligonucleotide
  Target: ATXN1; (-) strand; PAM type: NRG; PAM sequence: AGG
acagagcatgactctgcctc

SEQ ID NO: 80057 - DNA, 20 bp, Artificial Sequence
  Description of Artificial Sequence: Synthetic oligonucleotide
  Target: ATXN1; (-) strand; PAM type: NRG; PAM sequence: CAG
gacagagcatgactctgcct

SEQ ID NO: 80058 - DNA, 20 bp, Artificial Sequence
  Description of Artificial Sequence: Synthetic oligonucleotide
  Target: ATXN1; (-) strand; PAM type: NRG; PAM sequence: GAG
atgctccagcctgggtgaca

SEQ ID NO: 80059 - DNA, 20 bp, Artificial Sequence
  Description of Artificial Sequence: Synthetic oligonucleotide
  Target: ATXN1; (-) strand; PAM type: NRG; PAM sequence: CAG
ctatgctccagcctgggtga

SEQ ID NO: 80060 - DNA, 20 bp, Artificial Sequence
  Description of Artificial Sequence: Synthetic oligonucleotide
  Target: ATXN1; (-) strand; PAM type: NRG; PAM sequence: GGG
gcaccactatgctccagcct

SEQ ID NO: 80061 - DNA, 20 bp, Artificial Sequence
  Description of Artificial Sequence: Synthetic oligonucleotide
  Target: ATXN1; (-) strand; PAM type: NRG; PAM sequence: TGG
tgcaccactatgctccagcc

SEQ ID NO: 80062 - DNA, 20 bp, Artificial Sequence
  Description of Artificial Sequence: Synthetic oligonucleotide
  Target: ATXN1; (-) strand; PAM type: NRG; PAM sequence: CAG
gagattgcaccactatgctc

SEQ ID NO: 80063 - DNA, 20 bp, Artificial Sequence
  Description of Artificial Sequence: Synthetic oligonucleotide
  Target: ATXN1; (-) strand; PAM type: NRG; PAM sequence: GAG
ggcgaaggttgcagtgagcc

SEQ ID NO: 80064 - DNA, 20 bp, Artificial Sequence
  Description of Artificial Sequence: Synthetic oligonucleotide
  Target: ATXN1; (-) strand; PAM type: NRG; PAM sequence: GAG
tgggaggcgaaggttgcagt

SEQ ID NO: 80065 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcgaaggttg

SEQ ID NO: 80066 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctgggaggcga

SEQ ID NO: 80067 - DNA, 20 bp, Artificial Sequence
  Description of Artificial Sequence: Synthetic oligonucleotide
  Target: ATXN1; (-) strand; PAM type: NRG; PAM sequence: AAG
ttgcttgaacctgggaggcg

SEQ ID NO: 80068 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacctggg

SEQ ID NO: 80069 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcttgaacctgg

SEQ ID NO: 80070 - DNA, 20 bp, Artificial Sequence
  Description of Artificial Sequence: Synthetic oligonucleotide
  Target: ATXN1; (-) strand; PAM type: NRG; PAM sequence: GGG
caggagaattgcttgaacct

SEQ ID NO: 80071 - DNA, 20 bp, Artificial Sequence
  Description of Artificial Sequence: Synthetic oligonucleotide
  Target: ATXN1; (-) strand; PAM type: NRG; PAM sequence: TGG
gcaggagaattgcttgaacc

SEQ ID NO: 80072 - DNA, 20 bp, Artificial Sequence
  Description of Artificial Sequence: Synthetic oligonucleotide
  Target: ATXN1; (-) strand; PAM type: NRG; PAM sequence: GAG
tacgcgggaggctgaggcag

SEQ ID NO: 80073 - DNA, 20 bp, Artificial Sequence
  Description of Artificial Sequence: Synthetic oligonucleotide
  Target: ATXN1; (-) strand; PAM type: NRG; PAM sequence: AGG
gctacgcgggaggctgaggc

SEQ ID NO: 80074 - DNA, 20 bp, Artificial Sequence
  Description of Artificial Sequence: Synthetic oligonucleotide
  Target: ATXN1; (-) strand; PAM type: NRG; PAM sequence: CAG
agctacgcgggaggctgagg

SEQ ID NO: 80075 - DNA, 20 bp, Artificial Sequence
  Description of Artificial Sequence: Synthetic oligonucleotide
  Target: ATXN1; (-) strand; PAM type: NRG; PAM sequence: AGG
cccagctacgcgggaggctg

SEQ ID NO: 80076 - DNA, 20 bp, Artificial Sequence
  Description of Artificial Sequence: Synthetic oligonucleotide
  Target: ATXN1; (-) strand; PAM type: NRG; PAM sequence: GAG
tcccagctacgcgggaggct

SEQ ID NO: 80077 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacgcggg

SEQ ID NO: 80078 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacgcgg

SEQ ID NO: 80079 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagctacgc

SEQ ID NO: 80080 - DNA, 20 bp, Artificial Sequence
  Description of Artificial Sequence: Synthetic oligonucleotide
  Target: ATXN1; (-) strand; PAM type: NRG; PAM sequence: CGG
tgcctgtaatcccagctacg

SEQ ID NO: 80081 - DNA, 20 bp, Artificial Sequence
  Description of Artificial Sequence: Synthetic oligonucleotide
  Target: ATXN1; (-) strand; PAM type: NRG; PAM sequence: CAG
gtggcgagtgcctgtaatcc

SEQ ID NO: 80082 - DNA, 20 bp, Artificial Sequence
  Description of Artificial Sequence: Synthetic oligonucleotide
  Target: ATXN1; (-) strand; PAM type: NRG; PAM sequence: GAG
caattagctgggctggtggc

SEQ ID NO: 80083 - DNA, 20 bp, Artificial Sequence
  Description of Artificial Sequence: Synthetic oligonucleotide
  Target: ATXN1; (-) strand; PAM type: NRG; PAM sequence: TGG
aaaacaattagctgggctgg

SEQ ID NO: 80084 - DNA, 20 bp, Artificial Sequence
  Description of Artificial Sequence: Synthetic oligonucleotide
  Target: ATXN1; (-) strand; PAM type: NRG; PAM sequence: TGG
acaaaaacaattagctgggc

SEQ ID NO: 80085 - DNA, 20 bp, Artificial Sequence
  Description of Artificial Sequence: Synthetic oligonucleotide
  Target: ATXN1; (-) strand; PAM type: NRG; PAM sequence: GGG
aaatacaaaaacaattagct

SEQ ID NO: 80086 - DNA, 20 bp, Artificial Sequence
  Description of Artificial Sequence: Synthetic oligonucleotide
  Target: ATXN1; (-) strand; PAM type: NRG; PAM sequence: TGG
aaaatacaaaaacaattagc

SEQ ID NO: 80087 - DNA, 20 bp, Artificial Sequence
  Description of Artificial Sequence: Synthetic oligonucleotide
  Target: ATXN1; (-) strand; PAM type: NRG; PAM sequence: TAG
ctaaaaaatacaaaaacaat

SEQ ID NO: 80088 - DNA, 20 bp, Artificial Sequence
  Description of Artificial Sequence: Synthetic oligonucleotide
  Target: ATXN1; (-) strand; PAM type: NRG; PAM sequence: TGG
agagaccagccttgcaaaca

SEQ ID NO: 80089 - DNA, 20 bp, Artificial Sequence
  Description of Artificial Sequence: Synthetic oligonucleotide
  Target: ATXN1; (-) strand; PAM type: NRG; PAM sequence: CAG
caaagtcaggagttagagac

SEQ ID NO: 80090 - DNA, 20 bp, Artificial Sequence
  Description of Artificial Sequence: Synthetic oligonucleotide
  Target: ATXN1; (-) strand; PAM type: NRG; PAM sequence: GAG
gatcacaaagtcaggagtta

SEQ ID NO: 80091 - DNA, 20 bp, Artificial Sequence
  Description of Artificial Sequence: Synthetic oligonucleotide
  Target: ATXN1; (-) strand; PAM type: NRG; PAM sequence: TAG
cagatcacaaagtcaggagt

SEQ ID NO: 80092 - DNA, 20 bp, Artificial Sequence
  Description of Artificial Sequence: Synthetic oligonucleotide
  Target: ATXN1; (-) strand; PAM type: NRG; PAM sequence: GAG
tgggcagatcacaaagtcag

SEQ ID NO: 80093 - DNA, 20 bp, Artificial Sequence
  Description of Artificial Sequence: Synthetic oligonucleotide
  Target: ATXN1; (-) strand; PAM type: NRG; PAM sequence: AGG
ggtgggcagatcacaaagtc

SEQ ID NO: 80094 - DNA, 20 bp, Artificial Sequence
  Description of Artificial Sequence: Synthetic oligonucleotide
  Target: ATXN1; (-) strand; PAM type: NRG; PAM sequence: CAG
aggtgggcagatcacaaagt

SEQ ID NO: 80095 - DNA, 20 bp, Artificial Sequence
  Description of Artificial Sequence: Synthetic oligonucleotide
  Target: ATXN1; (-) strand; PAM type: NRG; PAM sequence: AAG
gccaaggtgggcagatcaca

SEQ ID NO: 80096 - DNA, 20 bp, Artificial Sequence
  Description of Artificial Sequence: Synthetic oligonucleotide
  Target: ATXN1; (-) strand; PAM type: NRG; PAM sequence: CAG
ctttgaaaggccaaggtggg

SEQ ID NO: 80097 - DNA, 20 bp, Artificial Sequence
  Description of Artificial Sequence: Synthetic oligonucleotide
  Target: ATXN1; (-) strand; PAM type: NRG; PAM sequence: GGG
gcactttgaaaggccaaggt

SEQ ID NO: 80098 - DNA, 20 bp, Artificial Sequence
  Description of Artificial Sequence: Synthetic oligonucleotide
  Target: ATXN1; (-) strand; PAM type: NRG; PAM sequence: TGG
agcactttgaaaggccaagg

SEQ ID NO: 80099 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgaaaggcca

SEQ ID NO: 80100 - DNA, 20 bp, Artificial Sequence
  Description of Artificial Sequence: Synthetic oligonucleotide
  Target: ATXN1; (-) strand; PAM type: NRG; PAM sequence: AAG
tcccagcactttgaaaggcc

SEQ ID NO: 80101 - DNA, 20 bp, Artificial Sequence
  Description of Artificial Sequence: Synthetic oligonucleotide
  Target: ATXN1; (-) strand; PAM type: NRG; PAM sequence: AGG
tttcatcccagcactttgaa

SEQ ID NO: 80102 - DNA, 20 bp, Artificial Sequence
  Description of Artificial Sequence: Synthetic oligonucleotide
  Target: ATXN1; (-) strand; PAM type: NRG; PAM sequence: AAG
ttttcatcccagcactttga

SEQ ID NO: 80103 - DNA, 20 bp, Artificial Sequence
  Description of Artificial Sequence: Synthetic oligonucleotide
  Target: ATXN1; (-) strand; PAM type: NRG; PAM sequence: CAG
taaaaaggttattttcatcc

SEQ ID NO: 80104 - DNA, 20 bp, Artificial Sequence
  Description of Artificial Sequence: Synthetic oligonucleotide
  Target: ATXN1; (-) strand; PAM type: NRG; PAM sequence: AGG
aaatatatatatttttaaaa

SEQ ID NO: 80105 - DNA, 20 bp, Artificial Sequence
  Description of Artificial Sequence: Synthetic oligonucleotide
  Target: ATXN1; (-) strand; PAM type: NRG; PAM sequence: AAG
gaaatatatatatttttaaa

SEQ ID NO: 80106 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccaccttgcc

SEQ ID NO: 80107 - DNA, 20 bp, Artificial Sequence
  Description of Artificial Sequence: Synthetic oligonucleotide
  Target: ATXN1; (-) strand; PAM type: NRG; PAM sequence: GAG
agtgcagggattacaggcat

SEQ ID NO: 80108 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgcagggattac

SEQ ID NO: 80109 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgcagggatta

SEQ ID NO: 80110 - DNA, 20 bp, Artificial Sequence
  Description of Artificial Sequence: Synthetic oligonucleotide
  Target: ATXN1; (-) strand; PAM type: NRG; PAM sequence: GGG
cttcagcctcccaaagtgca

SEQ ID NO: 80111 - DNA, 20 bp, Artificial Sequence
  Description of Artificial Sequence: Synthetic oligonucleotide
  Target: ATXN1; (-) strand; PAM type: NRG; PAM sequence: AGG
acttcagcctcccaaagtgc

SEQ ID NO: 80112 - DNA, 20 bp, Artificial Sequence
  Description of Artificial Sequence: Synthetic oligonucleotide
  Target: ATXN1; (-) strand; PAM type: NRG; PAM sequence: CAG
cacttcagcctcccaaagtg

SEQ ID NO: 80113 - DNA, 20 bp, Artificial Sequence
  Description of Artificial Sequence: Synthetic oligonucleotide
  Target: ATXN1; (-) strand; PAM type: NRG; PAM sequence: AAG
ccacccacttcagcctccca

SEQ ID NO: 80114 - DNA, 20 bp, Artificial Sequence
  Description of Artificial Sequence: Synthetic oligonucleotide
  Target: ATXN1; (-) strand; PAM type: NRG; PAM sequence: CAG
ctcaggggatccacccactt

SEQ ID NO: 80115 - DNA, 20 bp, Artificial Sequence
  Description of Artificial Sequence: Synthetic oligonucleotide
  Target: ATXN1; (-) strand; PAM type: NRG; PAM sequence: GGG
tctcgaactcctgacctcag

SEQ ID NO: 80116 - DNA, 20 bp, Artificial Sequence
  Description of Artificial Sequence: Synthetic oligonucleotide
  Target: ATXN1; (-) strand; PAM type: NRG; PAM sequence: GGG
gtctcgaactcctgacctca

SEQ ID NO: 80117 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacctc

SEQ ID NO: 80118 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgacct

SEQ ID NO: 80119 - DNA, 20 bp, Artificial Sequence
  Description of Artificial Sequence: Synthetic oligonucleotide
  Target: ATXN1; (-) strand; PAM type: NRG; PAM sequence: TGG
tttcatcatgttggccagga

SEQ ID NO: 80120 - DNA, 20 bp, Artificial Sequence
  Description of Artificial Sequence: Synthetic oligonucleotide
  Target: ATXN1; (-) strand; PAM type: NRG; PAM sequence: AGG
agggtttcatcatgttggcc

SEQ ID NO: 80121 - DNA, 20 bp, Artificial Sequence
  Description of Artificial Sequence: Synthetic oligonucleotide
  Target: ATXN1; (-) strand; PAM type: NRG; PAM sequence: CAG
cagggtttcatcatgttggc

SEQ ID NO: 80122 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcatcatgt

SEQ ID NO: 80123 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagaca

SEQ ID NO: 80124 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 80125 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 80126 - DNA, 20 bp, Artificial Sequence
  Description of Artificial Sequence: Synthetic oligonucleotide
  Target: ATXN1; (-) strand; PAM type: NRG; PAM sequence: GAG
agttttttgtatttttagta

SEQ ID NO: 80127 - DNA, 20 bp, Artificial Sequence
  Description of Artificial Sequence: Synthetic oligonucleotide
  Target: ATXN1; (-) strand; PAM type: NRG; PAM sequence: TAG
ctagttttttgtatttttag

SEQ ID NO: 80128 - DNA, 20 bp, Artificial Sequence
  Description of Artificial Sequence: Synthetic oligonucleotide
  Target: ATXN1; (-) strand; PAM type: NRG; PAM sequence: TAG
cagctagttttttgtatttt

SEQ ID NO: 80129 - DNA, 20 bp, Artificial Sequence
  Description of Artificial Sequence: Synthetic oligonucleotide
  Target: ATXN1; (-) strand; PAM type: NRG; PAM sequence: TAG
cgcacaccaccacgtccagc

SEQ ID NO: 80130 - DNA, 20 bp, Artificial Sequence
  Description of Artificial Sequence: Synthetic oligonucleotide
  Target: ATXN1; (-) strand; PAM type: NRG; PAM sequence: CAG
caggcgcacaccaccacgtc

SEQ ID NO: 80131 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 80132 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 80133 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 80134 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 80135 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 80136 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 80137 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcct

SEQ ID NO: 80138 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcctgggttc

SEQ ID NO: 80139 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctgcctcct

SEQ ID NO: 80140 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctctgcctcc

SEQ ID NO: 80141 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggtgtgatct

SEQ ID NO: 80142 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcag

SEQ ID NO: 80143 - DNA, 20 bp, Artificial Sequence
  Description of Artificial Sequence: Synthetic oligonucleotide
  Target: ATXN1; (-) strand; PAM type: NRG; PAM sequence: CAG
ttgttgcccaggctggagtg

SEQ ID NO: 80144 - DNA, 20 bp, Artificial Sequence
  Description of Artificial Sequence: Synthetic oligonucleotide
  Target: ATXN1; (-) strand; PAM type: NRG; PAM sequence: GAG
tgcttttgttgcccaggctg

SEQ ID NO: 80145 - DNA, 20 bp, Artificial Sequence
  Description of Artificial Sequence: Synthetic oligonucleotide
  Target: ATXN1; (-) strand; PAM type: NRG; PAM sequence: TGG
tttgcttttgttgcccaggc

SEQ ID NO: 80146 - DNA, 20 bp, Artificial Sequence
  Description of Artificial Sequence: Synthetic oligonucleotide
  Target: ATXN1; (-) strand; PAM type: NRG; PAM sequence: AGG
gagttttgcttttgttgccc

SEQ ID NO: 80147 - DNA, 20 bp, Artificial Sequence
  Description of Artificial Sequence: Synthetic oligonucleotide
  Target: ATXN1; (-) strand; PAM type: NRG; PAM sequence: CAG
ggagttttgcttttgttgcc

SEQ ID NO: 80148 - DNA, 20 bp, Artificial Sequence
  Description of Artificial Sequence: Synthetic oligonucleotide
  Target: ATXN1; (-) strand; PAM type: NRG; PAM sequence: GAG
atttttttttttttgagatg

SEQ ID NO: 80149 - DNA, 20 bp, Artificial Sequence
  Description of Artificial Sequence: Synthetic oligonucleotide
  Target: ATXN1; (-) strand; PAM type: NRG; PAM sequence: TGG
gaatttttttttttttgaga

SEQ ID NO: 80150 - DNA, 20 bp, Artificial Sequence
  Description of Artificial Sequence: Synthetic oligonucleotide
  Target: ATXN1; (-) strand; PAM type: NRG; PAM sequence: GAG
ttttgaattttttttttttt

SEQ ID NO: 80151 - DNA, 20 bp, Artificial Sequence
  Description of Artificial Sequence: Synthetic oligonucleotide
  Target: ATXN1; (-) strand; PAM type: NRG; PAM sequence: AAG
gactctaagaaggcaacatt

SEQ ID NO: 80152 - DNA, 20 bp, Artificial Sequence
  Description of Artificial Sequence: Synthetic oligonucleotide
  Target: ATXN1; (-) strand; PAM type: NRG; PAM sequence: AGG
aggttatacagactctaaga

SEQ ID NO: 80153 - DNA, 20 bp, Artificial Sequence
  Description of Artificial Sequence: Synthetic oligonucleotide
  Target: ATXN1; (-) strand; PAM type: NRG; PAM sequence: AAG
aaggttatacagactctaag

SEQ ID NO: 80154 - DNA, 20 bp, Artificial Sequence
  Description of Artificial Sequence: Synthetic oligonucleotide
  Target: ATXN1; (-) strand; PAM type: NRG; PAM sequence: AAG
aagaaggttatacagactct

SEQ ID NO: 80155 - DNA, 20 bp, Artificial Sequence
  Description of Artificial Sequence: Synthetic oligonucleotide
  Target: ATXN1; (-) strand; PAM type: NRG; PAM sequence: CAG
ctttccagaagaaggttata

SEQ ID NO: 80156 - DNA, 20 bp, Artificial Sequence
  Description of Artificial Sequence: Synthetic oligonucleotide
  Target: ATXN1; (-) strand; PAM type: NRG; PAM sequence: AGG
aaattgccctttccagaaga

SEQ ID NO: 80157 - DNA, 20 bp, Artificial Sequence
  Description of Artificial Sequence: Synthetic oligonucleotide
  Target: ATXN1; (-) strand; PAM type: NRG; PAM sequence: AAG
aaaattgccctttccagaag

SEQ ID NO: 80158 - DNA, 20 bp, Artificial Sequence
  Description of Artificial Sequence: Synthetic oligonucleotide
  Target: ATXN1; (-) strand; PAM type: NRG; PAM sequence: AAG
aaaaaaattgccctttccag

SEQ ID NO: 80159 - DNA, 20 bp, Artificial Sequence
  Description of Artificial Sequence: Synthetic oligonucleotide
  Target: ATXN1; (-) strand; PAM type: NRG; PAM sequence: CAG
ttaaaaaaaattgccctttc

SEQ ID NO: 80160 - DNA, 20 bp, Artificial Sequence
  Description of Artificial Sequence: Synthetic oligonucleotide
  Target: ATXN1; (-) strand; PAM type: NRG; PAM sequence: AAG
ataatatctaataaatgggc

SEQ ID NO: 80161 - DNA, 20 bp, Artificial Sequence
  Description of Artificial Sequence: Synthetic oligonucleotide
  Target: ATXN1; (-) strand; PAM type: NRG; PAM sequence: GGG
ctttataatatctaataaat

SEQ ID NO: 80162 - DNA, 20 bp, Artificial Sequence
  Description of Artificial Sequence: Synthetic oligonucleotide
  Target: ATXN1; (-) strand; PAM type: NRG; PAM sequence: TGG
cctttataatatctaataaa

SEQ ID NO: 80163 - DNA, 20 bp, Artificial Sequence
  Description of Artificial Sequence: Synthetic oligonucleotide
  Target: ATXN1; (-) strand; PAM type: NRG; PAM sequence: AAG
aaacatggcaggcccttggg

SEQ ID NO: 80164 - DNA, 20 bp, Artificial Sequence
  Description of Artificial Sequence: Synthetic oligonucleotide
  Target: ATXN1; (-) strand; PAM type: NRG; PAM sequence: GGG
gaaaaacatggcaggccctt

SEQ ID NO: 80165 - DNA, 20 bp, Artificial Sequence
  Description of Artificial Sequence: Synthetic oligonucleotide
  Target: ATXN1; (-) strand; PAM type: NRG; PAM sequence: TGG
ggaaaaacatggcaggccct

SEQ ID NO: 80166 - DNA, 20 bp, Artificial Sequence
  Description of Artificial Sequence: Synthetic oligonucleotide
  Target: ATXN1; (-) strand; PAM type: NRG; PAM sequence: AGG
tatgacaggaaaaacatggc

SEQ ID NO: 80167 - DNA, 20 bp, Artificial Sequence
  Description of Artificial Sequence: Synthetic oligonucleotide
  Target: ATXN1; (-) strand; PAM type: NRG; PAM sequence: CAG
atatgacaggaaaaacatgg

SEQ ID NO: 80168 - DNA, 20 bp, Artificial Sequence
  Description of Artificial Sequence: Synthetic oligonucleotide
  Target: ATXN1; (-) strand; PAM type: NRG; PAM sequence: TGG
tttatatgacaggaaaaaca

SEQ ID NO: 80169 - DNA, 20 bp, Artificial Sequence
  Description of Artificial Sequence: Synthetic oligonucleotide
  Target: ATXN1; (-) strand; PAM type: NRG; PAM sequence: AGG
acagacatgatttatatgac

SEQ ID NO: 80170 - DNA, 20 bp, Artificial Sequence
  Description of Artificial Sequence: Synthetic oligonucleotide
  Target: ATXN1; (-) strand; PAM type: NRG; PAM sequence: CAG
tacagacatgatttatatga

SEQ ID NO: 80171 - DNA, 20 bp, Artificial Sequence
  Description of Artificial Sequence: Synthetic oligonucleotide
  Target: ATXN1; (-) strand; PAM type: NRG; PAM sequence: CAG
gctttgtgattctgcccgta

SEQ ID NO: 80172 - DNA, 20 bp, Artificial Sequence
  Description of Artificial Sequence: Synthetic oligonucleotide
  Target: ATXN1; (-) strand; PAM type: NRG; PAM sequence: TAG
aggagtcctcagacccattc

SEQ ID NO: 80173 - DNA, 20 bp, Artificial Sequence
  Description of Artificial Sequence: Synthetic oligonucleotide
  Target: ATXN1; (-) strand; PAM type: NRG; PAM sequence: CAG
tgcctgagaggaggagtcct

SEQ ID NO: 80174 - DNA, 20 bp, Artificial Sequence
  Description of Artificial Sequence: Synthetic oligonucleotide
  Target: ATXN1; (-) strand; PAM type: NRG; PAM sequence: GAG
aggaagttgcctgagaggag

SEQ ID NO: 80175 - DNA, 20 bp, Artificial Sequence
  Description of Artificial Sequence: Synthetic oligonucleotide
  Target: ATXN1; (-) strand; PAM type: NRG; PAM sequence: AGG
gaaggaagttgcctgagagg

SEQ ID NO: 80176 - DNA, 20 bp, Artificial Sequence
  Description of Artificial Sequence: Synthetic oligonucleotide
  Target: ATXN1; (-) strand; PAM type: NRG; PAM sequence: GAG
ggaaggaagttgcctgagag

SEQ ID NO: 80177 - DNA, 20 bp, Artificial Sequence
  Description of Artificial Sequence: Synthetic oligonucleotide
  Target: ATXN1; (-) strand; PAM type: NRG; PAM sequence: AGG
ttggaaggaagttgcctgag

SEQ ID NO: 80178 - DNA, 20 bp, Artificial Sequence
  Description of Artificial Sequence: Synthetic oligonucleotide
  Target: ATXN1; (-) strand; PAM type: NRG; PAM sequence: GAG
gttggaaggaagttgcctga

SEQ ID NO: 80179 - DNA, 20 bp, Artificial Sequence
  Description of Artificial Sequence: Synthetic oligonucleotide
  Target: ATXN1; (-) strand; PAM type: NRG; PAM sequence: GAG
cagttggaaggaagttgcct

SEQ ID NO: 80180 - DNA, 20 bp, Artificial Sequence
  Description of Artificial Sequence: Synthetic oligonucleotide
  Target: ATXN1; (-) strand; PAM type: NRG; PAM sequence: AAG
gaatgcccacagttggaagg

SEQ ID NO: 80181 - DNA, 20 bp, Artificial Sequence
  Description of Artificial Sequence: Synthetic oligonucleotide
  Target: ATXN1; (-) strand; PAM type: NRG; PAM sequence: AGG
agggaatgcccacagttgga

SEQ ID NO: 80182 - DNA, 20 bp, Artificial Sequence
  Description of Artificial Sequence: Synthetic oligonucleotide
  Target: ATXN1; (-) strand; PAM type: NRG; PAM sequence: AAG
aagggaatgcccacagttgg

SEQ ID NO: 80183 - DNA, 20 bp, Artificial Sequence
  Description of Artificial Sequence: Synthetic oligonucleotide
  Target: ATXN1; (-) strand; PAM type: NRG; PAM sequence: TGG
cccaagggaatgcccacagt

SEQ ID NO: 80184 - DNA, 20 bp, Artificial Sequence
  Description of Artificial Sequence: Synthetic oligonucleotide
  Target: ATXN1; (-) strand; PAM type: NRG; PAM sequence: CAG
ggcacccaagggaatgccca

SEQ ID NO: 80185 - DNA, 20 bp, Artificial Sequence
  Description of Artificial Sequence: Synthetic oligonucleotide
  Target: ATXN1; (-) strand; PAM type: NRG; PAM sequence: GGG
gagtgtaagagggcacccaa

SEQ ID NO: 80186 - DNA, 20 bp, Artificial Sequence
  Description of Artificial Sequence: Synthetic oligonucleotide
  Target: ATXN1; (-) strand; PAM type: NRG; PAM sequence: AGG
tgagtgtaagagggcaccca

SEQ ID NO: 80187 - DNA, 20 bp, Artificial Sequence
  Description of Artificial Sequence: Synthetic oligonucleotide
  Target: ATXN1; (-) strand; PAM type: NRG; PAM sequence: AAG
gtgagtgtaagagggcaccc

SEQ ID NO: 80188 - DNA, 20 bp, Artificial Sequence
  Description of Artificial Sequence: Synthetic oligonucleotide
  Target: ATXN1; (-) strand; PAM type: NRG; PAM sequence: GGG
gtgaatcagtgagtgtaaga

SEQ ID NO: 80189 - DNA, 20 bp, Artificial Sequence
  Description of Artificial Sequence: Synthetic oligonucleotide
  Target: ATXN1; (-) strand; PAM type: NRG; PAM sequence: AGG
ggtgaatcagtgagtgtaag

SEQ ID NO: 80190 - DNA, 20 bp, Artificial Sequence
  Description of Artificial Sequence: Synthetic oligonucleotide
  Target: ATXN1; (-) strand; PAM type: NRG; PAM sequence: GAG
gggtgaatcagtgagtgtaa

SEQ ID NO: 80191 - DNA, 20 bp, Artificial Sequence
  Description of Artificial Sequence: Synthetic oligonucleotide
  Target: ATXN1; (-) strand; PAM type: NRG; PAM sequence: AAG
ttgggtgaatcagtgagtgt

SEQ ID NO: 80192 - DNA, 20 bp, Artificial Sequence
  Description of Artificial Sequence: Synthetic oligonucleotide
  Target: ATXN1; (-) strand; PAM type: NRG; PAM sequence: GAG
tgaatgttgggtgaatcagt

SEQ ID NO: 80193 - DNA, 20 bp, Artificial Sequence
  Description of Artificial Sequence: Synthetic oligonucleotide
  Target: ATXN1; (-) strand; PAM type: NRG; PAM sequence: CAG
caagtgaatgttgggtgaat

SEQ ID NO: 80194 - DNA, 20 bp, Artificial Sequence
  Description of Artificial Sequence: Synthetic oligonucleotide
  Target: ATXN1; (-) strand; PAM type: NRG; PAM sequence: GGG
gaagtgcccaagtgaatgtt

SEQ ID NO: 80195 - DNA, 20 bp, Artificial Sequence
  Description of Artificial Sequence: Synthetic oligonucleotide
  Target: ATXN1; (-) strand; PAM type: NRG; PAM sequence: TGG
agaagtgcccaagtgaatgt

SEQ ID NO: 80196 - DNA, 20 bp, Artificial Sequence
  Description of Artificial Sequence: Synthetic oligonucleotide
  Target: ATXN1; (-) strand; PAM type: NRG; PAM sequence: AAG
catacaatgcagaagtgccc

SEQ ID NO: 80197 - DNA, 20 bp, Artificial Sequence
  Description of Artificial Sequence: Synthetic oligonucleotide
  Target: ATXN1; (-) strand; PAM type: NRG; PAM sequence: AAG
aagagagtcatacaatgcag

SEQ ID NO: 80198 - DNA, 20 bp, Artificial Sequence
  Description of Artificial Sequence: Synthetic oligonucleotide
  Target: ATXN1; (-) strand; PAM type: NRG; PAM sequence: CAG
ctcaagagagtcatacaatg

SEQ ID NO: 80199 - DNA, 20 bp, Artificial Sequence
  Description of Artificial Sequence: Synthetic oligonucleotide
  Target: ATXN1; (-) strand; PAM type: NRG; PAM sequence: GAG
ttttcctgtttgcctcaaga

SEQ ID NO: 80200 - DNA, 20 bp, Artificial Sequence
  Description of Artificial Sequence: Synthetic oligonucleotide
  Target: ATXN1; (-) strand; PAM type: NRG; PAM sequence: GAG
gtttttcctgtttgcctcaa

SEQ ID NO: 80201 - DNA, 20 bp, Artificial Sequence
  Description of Artificial Sequence: Synthetic oligonucleotide
  Target: ATXN1; (-) strand; PAM type: NRG; PAM sequence: AAG
aggtttttcctgtttgcctc

SEQ ID NO: 80202 - DNA, 20 bp, Artificial Sequence
  Description of Artificial Sequence: Synthetic oligonucleotide
  Target: ATXN1; (-) strand; PAM type: NRG; PAM sequence: AGG
ctccccttgagggcagatac

SEQ ID NO: 80203 - DNA, 20 bp, Artificial Sequence
  Description of Artificial Sequence: Synthetic oligonucleotide
  Target: ATXN1; (-) strand; PAM type: NRG; PAM sequence: CAG
actccccttgagggcagata

SEQ ID NO: 80204 - DNA, 20 bp, Artificial Sequence
  Description of Artificial Sequence: Synthetic oligonucleotide
  Target: ATXN1; (-) strand; PAM type: NRG; PAM sequence: CAG
ggagggactccccttgaggg

SEQ ID NO: 80205 - DNA, 20 bp, Artificial Sequence
  Description of Artificial Sequence: Synthetic oligonucleotide
  Target: ATXN1; (-) strand; PAM type: NRG; PAM sequence: GGG
ctaggagggactccccttga

SEQ ID NO: 80206 - DNA, 20 bp, Artificial Sequence
  Description of Artificial Sequence: Synthetic oligonucleotide
  Target: ATXN1; (-) strand; PAM type: NRG; PAM sequence: AGG
tctaggagggactccccttg

SEQ ID NO: 80207 - DNA, 20 bp, Artificial Sequence
  Description of Artificial Sequence: Synthetic oligonucleotide
  Target: ATXN1; (-) strand; PAM type: NRG; PAM sequence: GAG
ctctaggagggactcccctt

SEQ ID NO: 80208 - DNA, 20 bp, Artificial Sequence
  Description of Artificial Sequence: Synthetic oligonucleotide
  Target: ATXN1; (-) strand; PAM type: NRG; PAM sequence: GGG
gctagtgtcctcctctagga

SEQ ID NO: 80209 - DNA, 20 bp, Artificial Sequence
  Description of Artificial Sequence: Synthetic oligonucleotide
  Target: ATXN1; (-) strand; PAM type: NRG; PAM sequence: AGG
ggctagtgtcctcctctagg

SEQ ID NO: 80210 - DNA, 20 bp, Artificial Sequence
  Description of Artificial Sequence: Synthetic oligonucleotide
  Target: ATXN1; (-) strand; PAM type: NRG; PAM sequence: GAG
tggctagtgtcctcctctag

SEQ ID NO: 80211 - DNA, 20 bp, Artificial Sequence
  Description of Artificial Sequence: Synthetic oligonucleotide
  Target: ATXN1; (-) strand; PAM type: NRG; PAM sequence: AGG
tatggctagtgtcctcctct

SEQ ID NO: 80212 - DNA, 20 bp, Artificial Sequence
  Description of Artificial Sequence: Synthetic oligonucleotide
  Target: ATXN1; (-) strand; PAM type: NRG; PAM sequence: TAG
gtatggctagtgtcctcctc

SEQ ID NO: 80213 - DNA, 20 bp, Artificial Sequence
  Description of Artificial Sequence: Synthetic oligonucleotide
  Target: ATXN1; (-) strand; PAM type: NRG; PAM sequence: TAG
cagcataacaacggtatggc

SEQ ID NO: 80214 - DNA, 20 bp, Artificial Sequence
  Description of Artificial Sequence: Synthetic oligonucleotide
  Target: ATXN1; (-) strand; PAM type: NRG; PAM sequence: TGG
acttcagcataacaacggta

SEQ ID NO: 80215 - DNA, 20 bp, Artificial Sequence
  Description of Artificial Sequence: Synthetic oligonucleotide
  Target: ATXN1; (-) strand; PAM type: NRG; PAM sequence: CGG
tcgcaacttcagcataacaa

SEQ ID NO: 80216 - DNA, 20 bp, Artificial Sequence
  Description of Artificial Sequence: Synthetic oligonucleotide
  Target: ATXN1; (-) strand; PAM type: NRG; PAM sequence: CAG
gtaaatggacctcgcaactt

SEQ ID NO: 80217 - DNA, 20 bp, Artificial Sequence
  Description of Artificial Sequence: Synthetic oligonucleotide
  Target: ATXN1; (-) strand; PAM type: NRG; PAM sequence: TGG
gataaggctggttctgtaaa

SEQ ID NO: 80218 - DNA, 20 bp, Artificial Sequence
  Description of Artificial Sequence: Synthetic oligonucleotide
  Target: ATXN1; (-) strand; PAM type: NRG; PAM sequence: TGG
atattgctaagtgataaggc

SEQ ID NO: 80219 - DNA, 20 bp, Artificial Sequence
  Description of Artificial Sequence: Synthetic oligonucleotide
  Target: ATXN1; (-) strand; PAM type: NRG; PAM sequence: AGG
ggctatattgctaagtgata

SEQ ID NO: 80220 - DNA, 20 bp, Artificial Sequence
  Description of Artificial Sequence: Synthetic oligonucleotide
  Target: ATXN1; (-) strand; PAM type: NRG; PAM sequence: AAG
gggctatattgctaagtgat

SEQ ID NO: 80221 - DNA, 20 bp, Artificial Sequence
  Description of Artificial Sequence: Synthetic oligonucleotide
  Target: ATXN1; (-) strand; PAM type: NRG; PAM sequence: AAG
ggtatgtgggctatattgct

SEQ ID NO: 80222 - DNA, 20 bp, Artificial Sequence
  Description of Artificial Sequence: Synthetic oligonucleotide
  Target: ATXN1; (-) strand; PAM type: NRG; PAM sequence: GGG
gaatttttttatgggtatgt

SEQ ID NO: 80223 - DNA, 20 bp, Artificial Sequence
  Description of Artificial Sequence: Synthetic oligonucleotide
  Target: ATXN1; (-) strand; PAM type: NRG; PAM sequence: TGG
tgaatttttttatgggtatg

SEQ ID NO: 80224 - DNA, 20 bp, Artificial Sequence
  Description of Artificial Sequence: Synthetic oligonucleotide
  Target: ATXN1; (-) strand; PAM type: NRG; PAM sequence: GGG
aggcccttgaatttttttat

SEQ ID NO: 80225 - DNA, 20 bp, Artificial Sequence
  Description of Artificial Sequence: Synthetic oligonucleotide
  Target: ATXN1; (-) strand; PAM type: NRG; PAM sequence: TGG
taggcccttgaattttttta

SEQ ID NO: 80226 - DNA, 20 bp, Artificial Sequence
  Description of Artificial Sequence: Synthetic oligonucleotide
  Target: ATXN1; (-) strand; PAM type: NRG; PAM sequence: AGG
acattatcatccactcactt

SEQ ID NO: 80227 - DNA, 20 bp, Artificial Sequence
  Description of Artificial Sequence: Synthetic oligonucleotide
  Target: ATXN1; (-) strand; PAM type: NRG; PAM sequence: TAG
cacattatcatccactcact

SEQ ID NO: 80228 - DNA, 20 bp, Artificial Sequence
  Description of Artificial Sequence: Synthetic oligonucleotide
  Target: ATXN1; (-) strand; PAM type: NRG; PAM sequence: TGG
catatgtctgtgcacacctt

SEQ ID NO: 80229 - DNA, 20 bp, Artificial Sequence
  Description of Artificial Sequence: Synthetic oligonucleotide
  Target: ATXN1; (-) strand; PAM type: NRG; PAM sequence: CAG
gatcagcccactaagtgact

SEQ ID NO: 80230 - DNA, 20 bp, Artificial Sequence
  Description of Artificial Sequence: Synthetic oligonucleotide
  Target: ATXN1; (-) strand; PAM type: NRG; PAM sequence: AAG
cccctgttgatcagcccact

SEQ ID NO: 80231 - DNA, 20 bp, Artificial Sequence
  Description of Artificial Sequence: Synthetic oligonucleotide
  Target: ATXN1; (-) strand; PAM type: NRG; PAM sequence: CAG
tccatgaatcccctgttgat

SEQ ID NO: 80232 - DNA, 20 bp, Artificial Sequence
  Description of Artificial Sequence: Synthetic oligonucleotide
  Target: ATXN1; (-) strand; PAM type: NRG; PAM sequence: TAG
attggagtggtcacttctgt

SEQ ID NO: 80233 - DNA, 20 bp, Artificial Sequence
  Description of Artificial Sequence: Synthetic oligonucleotide
  Target: ATXN1; (-) strand; PAM type: NRG; PAM sequence: TGG
atatcatcaatgcattggag

SEQ ID NO: 80234 - DNA, 20 bp, Artificial Sequence
  Description of Artificial Sequence: Synthetic oligonucleotide
  Target: ATXN1; (-) strand; PAM type: NRG; PAM sequence: GAG
ctgatatcatcaatgcattg

SEQ ID NO: 80235 - DNA, 20 bp, Artificial Sequence
  Description of Artificial Sequence: Synthetic oligonucleotide
  Target: ATXN1; (-) strand; PAM type: NRG; PAM sequence: TGG
ctctgatatcatcaatgcat

SEQ ID NO: 80236 - DNA, 20 bp, Artificial Sequence
  Description of Artificial Sequence: Synthetic oligonucleotide
  Target: ATXN1; (-) strand; PAM type: NRG; PAM sequence: AGG
agcagatgatgacttgcagg

SEQ ID NO: 80237 - DNA, 20 bp, Artificial Sequence
  Description of Artificial Sequence: Synthetic oligonucleotide
  Target: ATXN1; (-) strand; PAM type: NRG; PAM sequence: GAG
gagcagatgatgacttgcag

SEQ ID NO: 80238 - DNA, 20 bp, Artificial Sequence
  Description of Artificial Sequence: Synthetic oligonucleotide
  Target: ATXN1; (-) strand; PAM type: NRG; PAM sequence: AGG
ttgagcagatgatgacttgc

SEQ ID NO: 80239 - DNA, 20 bp, Artificial Sequence
  Description of Artificial Sequence: Synthetic oligonucleotide
  Target: ATXN1; (-) strand; PAM type: NRG; PAM sequence: CAG
gttgagcagatgatgacttg

SEQ ID NO: 80240 - DNA, 20 bp, Artificial Sequence
  Description of Artificial Sequence: Synthetic oligonucleotide
  Target: ATXN1; (-) strand; PAM type: NRG; PAM sequence: CAG
gatgccgattcacagttgag

SEQ ID NO: 80241 - DNA, 20 bp, Artificial Sequence
  Description of Artificial Sequence: Synthetic oligonucleotide
  Target: ATXN1; (-) strand; PAM type: NRG; PAM sequence: GAG
tcagatgccgattcacagtt

SEQ ID NO: 80242 - DNA, 20 bp, Artificial Sequence
  Description of Artificial Sequence: Synthetic oligonucleotide
  Target: ATXN1; (-) strand; PAM type: NRG; PAM sequence: CAG
ttttctcagatgccgattca

SEQ ID NO: 80243 - DNA, 20 bp, Artificial Sequence
  Description of Artificial Sequence: Synthetic oligonucleotide
  Target: ATXN1; (-) strand; PAM type: NRG; PAM sequence: CAG
aaggttgttgcttattttct

SEQ ID NO: 80244 - DNA, 20 bp, Artificial Sequence
  Description of Artificial Sequence: Synthetic oligonucleotide
  Target: ATXN1; (-) strand; PAM type: NRG; PAM sequence: AGG
atgttggtgtttgggaggta

SEQ ID NO: 80245 - DNA, 20 bp, Artificial Sequence
  Description of Artificial Sequence: Synthetic oligonucleotide
  Target: ATXN1; (-) strand; PAM type: NRG; PAM sequence: AAG
aatgttggtgtttgggaggt

SEQ ID NO: 80246 - DNA, 20 bp, Artificial Sequence
  Description of Artificial Sequence: Synthetic oligonucleotide
  Target: ATXN1; (-) strand; PAM type: NRG; PAM sequence: AGG
ctttaatgttggtgtttggg

SEQ ID NO: 80247 - DNA, 20 bp, Artificial Sequence
  Description of Artificial Sequence: Synthetic oligonucleotide
  Target: ATXN1; (-) strand; PAM type: NRG; PAM sequence: GAG
gctttaatgttggtgtttgg

SEQ ID NO: 80248 - DNA, 20 bp, Artificial Sequence
  Description of Artificial Sequence: Synthetic oligonucleotide
  Target: ATXN1; (-) strand; PAM type: NRG; PAM sequence: GGG
ttgctttaatgttggtgttt

SEQ ID NO: 80249 - DNA, 20 bp, Artificial Sequence
  Description of Artificial Sequence: Synthetic oligonucleotide
  Target: ATXN1; (-) strand; PAM type: NRG; PAM sequence: TGG
attgctttaatgttggtgtt

SEQ ID NO: 80250 - DNA, 20 bp, Artificial Sequence
  Description of Artificial Sequence: Synthetic oligonucleotide
  Target: ATXN1; (-) strand; PAM type: NRG; PAM sequence: TGG
ataatgcattgctttaatgt

SEQ ID NO: 80251 - DNA, 20 bp, Artificial Sequence
  Description of Artificial Sequence: Synthetic oligonucleotide
  Target: ATXN1; (-) strand; PAM type: NRG; PAM sequence: GAG
aaagtgttcatttactacct

SEQ ID NO: 80252 - DNA, 20 bp, Artificial Sequence
  Description of Artificial Sequence: Synthetic oligonucleotide
  Target: ATXN1; (-) strand; PAM type: NRG; PAM sequence: AAG
ttatgattgcatgagtttta

SEQ ID NO: 80253 - DNA, 20 bp, Artificial Sequence
  Description of Artificial Sequence: Synthetic oligonucleotide
  Target: ATXN1; (-) strand; PAM type: NRG; PAM sequence: GAG
tctaatgtttatgattgcat

SEQ ID NO: 80254 - DNA, 20 bp, Artificial Sequence
  Description of Artificial Sequence: Synthetic oligonucleotide
  Target: ATXN1; (-) strand; PAM type: NRG; PAM sequence: AAG
tcgtcttaatatcttctgac

SEQ ID NO: 80255 - DNA, 20 bp, Artificial Sequence
  Description of Artificial Sequence: Synthetic oligonucleotide
  Target: ATXN1; (-) strand; PAM type: NRG; PAM sequence: CAG
agaatcattctctctgtgaa

SEQ ID NO: 80256 - DNA, 20 bp, Artificial Sequence
  Description of Artificial Sequence: Synthetic oligonucleotide
  Target: ATXN1; (-) strand; PAM type: NRG; PAM sequence: TAG
caatctgaccattttgtatt

SEQ ID NO: 80257 - DNA, 20 bp, Artificial Sequence
  Description of Artificial Sequence: Synthetic oligonucleotide
  Target: ATXN1; (-) strand; PAM type: NRG; PAM sequence: GAG
ctattaatagcaatacttct

SEQ ID NO: 80258 - DNA, 20 bp, Artificial Sequence
  Description of Artificial Sequence: Synthetic oligonucleotide
  Target: ATXN1; (-) strand; PAM type: NRG; PAM sequence: TAG
tctaatattatttctattaa

SEQ ID NO: 80259 - DNA, 20 bp, Artificial Sequence
  Description of Artificial Sequence: Synthetic oligonucleotide
  Target: ATXN1; (-) strand; PAM type: NRG; PAM sequence: GAG
tacatttctggcagacacat

SEQ ID NO: 80260 - DNA, 20 bp, Artificial Sequence
  Description of Artificial Sequence: Synthetic oligonucleotide
  Target: ATXN1; (-) strand; PAM type: NRG; PAM sequence: CAG
attactgggtacatttctgg

SEQ ID NO: 80261 - DNA, 20 bp, Artificial Sequence
  Description of Artificial Sequence: Synthetic oligonucleotide
  Target: ATXN1; (-) strand; PAM type: NRG; PAM sequence: TGG
attattactgggtacatttc

SEQ ID NO: 80262 - DNA, 20 bp, Artificial Sequence
  Description of Artificial Sequence: Synthetic oligonucleotide
  Target: ATXN1; (-) strand; PAM type: NRG; PAM sequence: GGG
cagaaatgcaaattattact

SEQ ID NO: 80263 - DNA, 20 bp, Artificial Sequence
  Description of Artificial Sequence: Synthetic oligonucleotide
  Target: ATXN1; (-) strand; PAM type: NRG; PAM sequence: TGG
gcagaaatgcaaattattac

SEQ ID NO: 80264 - DNA, 20 bp, Artificial Sequence
  Description of Artificial Sequence: Synthetic oligonucleotide
  Target: ATXN1; (-) strand; PAM type: NRG; PAM sequence: CAG
ccctgaaattttcactatag

SEQ ID NO: 80265 - DNA, 20 bp, Artificial Sequence
  Description of Artificial Sequence: Synthetic oligonucleotide
  Target: ATXN1; (-) strand; PAM type: NRG; PAM sequence: TAG
catccctgaaattttcacta

SEQ ID NO: 80266 - DNA, 20 bp, Artificial Sequence
  Description of Artificial Sequence: Synthetic oligonucleotide
  Target: ATXN1; (-) strand; PAM type: NRG; PAM sequence: GAG
gtccttcataagccaacaaa

SEQ ID NO: 80267 - DNA, 20 bp, Artificial Sequence
  Description of Artificial Sequence: Synthetic oligonucleotide
  Target: ATXN1; (-) strand; PAM type: NRG; PAM sequence: AAG
gggtccttcataagccaaca

SEQ ID NO: 80268 - DNA, 20 bp, Artificial Sequence
  Description of Artificial Sequence: Synthetic oligonucleotide
  Target: ATXN1; (-) strand; PAM type: NRG; PAM sequence: AAG
ccaatgaaagggtccttcat

SEQ ID NO: 80269 - DNA, 20 bp, Artificial Sequence
  Description of Artificial Sequence: Synthetic oligonucleotide
  Target: ATXN1; (-) strand; PAM type: NRG; PAM sequence: GGG
actgtggcttaccaatgaaa

SEQ ID NO: 80270 - DNA, 20 bp, Artificial Sequence
  Description of Artificial Sequence: Synthetic oligonucleotide
  Target: ATXN1; (-) strand; PAM type: NRG; PAM sequence: AGG
aactgtggcttaccaatgaa

SEQ ID NO: 80271 - DNA, 20 bp, Artificial Sequence
  Description of Artificial Sequence: Synthetic oligonucleotide
  Target: ATXN1; (-) strand; PAM type: NRG; PAM sequence: AAG
aaactgtggcttaccaatga

SEQ ID NO: 80272 - DNA, 20 bp, Artificial Sequence
  Description of Artificial Sequence: Synthetic oligonucleotide
  Target: ATXN1; (-) strand; PAM type: NRG; PAM sequence: TGG
tatcatgattataaaaactg

SEQ ID NO: 80273 - DNA, 20 bp, Artificial Sequence
  Description of Artificial Sequence: Synthetic oligonucleotide
  Target: ATXN1; (-) strand; PAM type: NRG; PAM sequence: AGG
ttattatcaacaaagagcat

SEQ ID NO: 80274 - DNA, 20 bp, Artificial Sequence
  Description of Artificial Sequence: Synthetic oligonucleotide
  Target: ATXN1; (-) strand; PAM type: NRG; PAM sequence: TAG
attattatcaacaaagagca

SEQ ID NO: 80275 - DNA, 20 bp, Artificial Sequence
  Description of Artificial Sequence: Synthetic oligonucleotide
  Target: ATXN1; (-) strand; PAM type: NRG; PAM sequence: GAG
ttattattattatcaacaaa

SEQ ID NO: 80276 - DNA, 20 bp, Artificial Sequence
  Description of Artificial Sequence: Synthetic oligonucleotide
  Target: ATXN1; (-) strand; PAM type: NRG; PAM sequence: AAG
agttattattattatcaaca

SEQ ID NO: 80277 - DNA, 20 bp, Artificial Sequence
  Description of Artificial Sequence: Synthetic oligonucleotide
  Target: ATXN1; (-) strand; PAM type: NRG; PAM sequence: TAG
ggcacacacgagtgtcttat

SEQ ID NO: 80278 - DNA, 20 bp, Artificial Sequence
  Description of Artificial Sequence: Synthetic oligonucleotide
  Target: ATXN1; (-) strand; PAM type: NRG; PAM sequence: GAG
gcgcagtgccaggcacacac

SEQ ID NO: 80279 - DNA, 20 bp, Artificial Sequence
  Description of Artificial Sequence: Synthetic oligonucleotide
  Target: ATXN1; (-) strand; PAM type: NRG; PAM sequence: AGG
acggcagtcagcgcagtgcc

SEQ ID NO: 80280 - DNA, 20 bp, Artificial Sequence
  Description of Artificial Sequence: Synthetic oligonucleotide
  Target: ATXN1; (-) strand; PAM type: NRG; PAM sequence: CAG
tacggcagtcagcgcagtgc

SEQ ID NO: 80281 - DNA, 20 bp, Artificial Sequence
  Description of Artificial Sequence: Synthetic oligonucleotide
  Target: ATXN1; (-) strand; PAM type: NRG; PAM sequence: CAG
tgcacatacggcagtcagcg

SEQ ID NO: 80282 - DNA, 20 bp, Artificial Sequence
  Description of Artificial Sequence: Synthetic oligonucleotide
  Target: ATXN1; (-) strand; PAM type: NRG; PAM sequence: CAG
actgctgcacatacggcagt

SEQ ID NO: 80283 - DNA, 20 bp, Artificial Sequence
  Description of Artificial Sequence: Synthetic oligonucleotide
  Target: ATXN1; (-) strand; PAM type: NRG; PAM sequence: CAG
caggactgctgcacatacgg

SEQ ID NO: 80284 - DNA, 20 bp, Artificial Sequence
  Description of Artificial Sequence: Synthetic oligonucleotide
  Target: ATXN1; (-) strand; PAM type: NRG; PAM sequence: CGG
tcacaggactgctgcacata

SEQ ID NO: 80285 - DNA, 20 bp, Artificial Sequence
  Description of Artificial Sequence: Synthetic oligonucleotide
  Target: ATXN1; (-) strand; PAM type: NRG; PAM sequence: AGG
gaataataatcctgcctcac

SEQ ID NO: 80286 - DNA, 20 bp, Artificial Sequence
  Description of Artificial Sequence: Synthetic oligonucleotide
  Target: ATXN1; (-) strand; PAM type: NRG; PAM sequence: CAG
tgaataataatcctgcctca

SEQ ID NO: 80287 - DNA, 20 bp, Artificial Sequence
  Description of Artificial Sequence: Synthetic oligonucleotide
  Target: ATXN1; (-) strand; PAM type: NRG; PAM sequence: CAG
gacctaagcctctgttttct

SEQ ID NO: 80288 - DNA, 20 bp, Artificial Sequence
  Description of Artificial Sequence: Synthetic oligonucleotide
  Target: ATXN1; (-) strand; PAM type: NRG; PAM sequence: AAG
gaccctgggaaagttgacct

SEQ ID NO: 80289 - DNA, 20 bp, Artificial Sequence
  Description of Artificial Sequence: Synthetic oligonucleotide
  Target: ATXN1; (-) strand; PAM type: NRG; PAM sequence: AAG
tcgtctttaagaccctggga

SEQ ID NO: 80290 - DNA, 20 bp, Artificial Sequence
  Description of Artificial Sequence: Synthetic oligonucleotide
  Target: ATXN1; (-) strand; PAM type: NRG; PAM sequence: GGG
tttatcgtctttaagaccct

SEQ ID NO: 80291 - DNA, 20 bp, Artificial Sequence
  Description of Artificial Sequence: Synthetic oligonucleotide
  Target: ATXN1; (-) strand; PAM type: NRG; PAM sequence: TGG
atttatcgtctttaagaccc

SEQ ID NO: 80292 - DNA, 20 bp, Artificial Sequence
  Description of Artificial Sequence: Synthetic oligonucleotide
  Target: ATXN1; (-) strand; PAM type: NRG; PAM sequence: AAG
ctccataatttatcgtcttt

SEQ ID NO: 80293 - DNA, 20 bp, Artificial Sequence
  Description of Artificial Sequence: Synthetic oligonucleotide
  Target: ATXN1; (-) strand; PAM type: NRG; PAM sequence: CAG
gaaagactcaagttcaaatc

SEQ ID NO: 80294 - DNA, 20 bp, Artificial Sequence
  Description of Artificial Sequence: Synthetic oligonucleotide
  Target: ATXN1; (-) strand; PAM type: NRG; PAM sequence: AAG
gcatggagtcagaaagactc

SEQ ID NO: 80295 - DNA, 20 bp, Artificial Sequence
  Description of Artificial Sequence: Synthetic oligonucleotide
  Target: ATXN1; (-) strand; PAM type: NRG; PAM sequence: AAG
agagtgggcatggagtcaga

SEQ ID NO: 80296 - DNA, 20 bp, Artificial Sequence
  Description of Artificial Sequence: Synthetic oligonucleotide
  Target: ATXN1; (-) strand; PAM type: NRG; PAM sequence: CAG
aaggagagtgggcatggagt

SEQ ID NO: 80297 - DNA, 20 bp, Artificial Sequence
  Description of Artificial Sequence: Synthetic oligonucleotide
  Target: ATXN1; (-) strand; PAM type: NRG; PAM sequence: GAG
gtggaaggagagtgggcatg

SEQ ID NO: 80298 - DNA, 20 bp, Artificial Sequence
  Description of Artificial Sequence: Synthetic oligonucleotide
  Target: ATXN1; (-) strand; PAM type: NRG; PAM sequence: TGG
aagtggaaggagagtgggca

SEQ ID NO: 80299 - DNA, 20 bp, Artificial Sequence
  Description of Artificial Sequence: Synthetic oligonucleotide
  Target: ATXN1; (-) strand; PAM type: NRG; PAM sequence: GGG
gctgcaagtggaaggagagt

SEQ ID NO: 80300 - DNA, 20 bp, Artificial Sequence
  Description of Artificial Sequence: Synthetic oligonucleotide
  Target: ATXN1; (-) strand; PAM type: NRG; PAM sequence: TGG
cgctgcaagtggaaggagag

SEQ ID NO: 80301 - DNA, 20 bp, Artificial Sequence
  Description of Artificial Sequence: Synthetic oligonucleotide
  Target: ATXN1; (-) strand; PAM type: NRG; PAM sequence: GAG
ttacgctgcaagtggaagga

SEQ ID NO: 80302 - DNA, 20 bp, Artificial Sequence
  Description of Artificial Sequence: Synthetic oligonucleotide
  Target: ATXN1; (-) strand; PAM type: NRG; PAM sequence: GAG
gtttacgctgcaagtggaag

SEQ ID NO: 80303 - DNA, 20 bp, Artificial Sequence
  Description of Artificial Sequence: Synthetic oligonucleotide
  Target: ATXN1; (-) strand; PAM type: NRG; PAM sequence: AGG
gtgtttacgctgcaagtgga

SEQ ID NO: 80304 - DNA, 20 bp, Artificial Sequence
  Description of Artificial Sequence: Synthetic oligonucleotide
  Target: ATXN1; (-) strand; PAM type: NRG; PAM sequence: AAG
tgtgtttacgctgcaagtgg

SEQ ID NO: 80305 - DNA, 20 bp, Artificial Sequence
  Description of Artificial Sequence: Synthetic oligonucleotide
  Target: ATXN1; (-) strand; PAM type: NRG; PAM sequence: TGG
cactgtgtttacgctgcaag

SEQ ID NO: 80306 - DNA, 20 bp, Artificial Sequence
  Description of Artificial Sequence: Synthetic oligonucleotide
  Target: ATXN1; (-) strand; PAM type: NRG; PAM sequence: AAG
agccactgtgtttacgctgc

SEQ ID NO: 80307 - DNA, 20 bp, Artificial Sequence
  Description of Artificial Sequence: Synthetic oligonucleotide
  Target: ATXN1; (-) strand; PAM type: NRG; PAM sequence: GAG
ttcatgaagccacagagttt

SEQ ID NO: 80308 - DNA, 20 bp, Artificial Sequence
  Description of Artificial Sequence: Synthetic oligonucleotide
  Target: ATXN1; (-) strand; PAM type: NRG; PAM sequence: GAG
attatattcatgaagccaca

SEQ ID NO: 80309 - DNA, 20 bp, Artificial Sequence
  Description of Artificial Sequence: Synthetic oligonucleotide
  Target: ATXN1; (-) strand; PAM type: NRG; PAM sequence: CAG
acattatattcatgaagcca

SEQ ID NO: 80310 - DNA, 20 bp, Artificial Sequence
  Description of Artificial Sequence: Synthetic oligonucleotide
  Target: ATXN1; (-) strand; PAM type: NRG; PAM sequence: AAG
tgtgaaacattatattcatg

SEQ ID NO: 80311 - DNA, 20 bp, Artificial Sequence
  Description of Artificial Sequence: Synthetic oligonucleotide
  Target: ATXN1; (-) strand; PAM type: NRG; PAM sequence: AAG
ctagacccatttctacttat

SEQ ID NO: 80312 - DNA, 20 bp, Artificial Sequence
  Description of Artificial Sequence: Synthetic oligonucleotide
  Target: ATXN1; (-) strand; PAM type: NRG; PAM sequence: TAG
tccaggagtgtccatctttc

SEQ ID NO: 80313 - DNA, 20 bp, Artificial Sequence
  Description of Artificial Sequence: Synthetic oligonucleotide
  Target: ATXN1; (-) strand; PAM type: NRG; PAM sequence: GAG
atttgcaatgcagtgtccag

SEQ ID NO: 80314 - DNA, 20 bp, Artificial Sequence
  Description of Artificial Sequence: Synthetic oligonucleotide
  Target: ATXN1; (-) strand; PAM type: NRG; PAM sequence: AGG
agatttgcaatgcagtgtcc

SEQ ID NO: 80315 - DNA, 20 bp, Artificial Sequence
  Description of Artificial Sequence: Synthetic oligonucleotide
  Target: ATXN1; (-) strand; PAM type: NRG; PAM sequence: CAG
gagatttgcaatgcagtgtc

SEQ ID NO: 80316 - DNA, 20 bp, Artificial Sequence
  Description of Artificial Sequence: Synthetic oligonucleotide
  Target: ATXN1; (-) strand; PAM type: NRG; PAM sequence: CAG
agatagcgagatttgcaatg

SEQ ID NO: 80317 - DNA, 20 bp, Artificial Sequence
  Description of Artificial Sequence: Synthetic oligonucleotide
  Target: ATXN1; (-) strand; PAM type: NRG; PAM sequence: GAG
agtgagtgaaagcagatagc

SEQ ID NO: 80318 - DNA, 20 bp, Artificial Sequence
  Description of Artificial Sequence: Synthetic oligonucleotide
  Target: ATXN1; (-) strand; PAM type: NRG; PAM sequence: TAG
tgtcagtgagtgaaagcaga

SEQ ID NO: 80319 - DNA, 20 bp, Artificial Sequence
  Description of Artificial Sequence: Synthetic oligonucleotide
  Target: ATXN1; (-) strand; PAM type: NRG; PAM sequence: CAG
taggtgtcagtgagtgaaag

SEQ ID NO: 80320 - DNA, 20 bp, Artificial Sequence
  Description of Artificial Sequence: Synthetic oligonucleotide
  Target: ATXN1; (-) strand; PAM type: NRG; PAM sequence: AAG
atataggtgtcagtgagtga

SEQ ID NO: 80321 - DNA, 20 bp, Artificial Sequence
  Description of Artificial Sequence: Synthetic oligonucleotide
  Target: ATXN1; (-) strand; PAM type: NRG; PAM sequence: GAG
gggcaaatataggtgtcagt

SEQ ID NO: 80322 - DNA, 20 bp, Artificial Sequence
  Description of Artificial Sequence: Synthetic oligonucleotide
  Target: ATXN1; (-) strand; PAM type: NRG; PAM sequence: CAG
caaggggcaaatataggtgt

SEQ ID NO: 80323 - DNA, 20 bp, Artificial Sequence
  Description of Artificial Sequence: Synthetic oligonucleotide
  Target: ATXN1; (-) strand; PAM type: NRG; PAM sequence: AGG
gggactcaaggggcaaatat

SEQ ID NO: 80324 - DNA, 20 bp, Artificial Sequence
  Description of Artificial Sequence: Synthetic oligonucleotide
  Target: ATXN1; (-) strand; PAM type: NRG; PAM sequence: TAG
agggactcaaggggcaaata

SEQ ID NO: 80325 - DNA, 20 bp, Artificial Sequence
  Description of Artificial Sequence: Synthetic oligonucleotide
  Target: ATXN1; (-) strand; PAM type: NRG; PAM sequence: GGG
caatattcaagggactcaag

SEQ ID NO: 80326 - DNA, 20 bp, Artificial Sequence
  Description of Artificial Sequence: Synthetic oligonucleotide
  Target: ATXN1; (-) strand; PAM type: NRG; PAM sequence: GGG
ccaatattcaagggactcaa

SEQ ID NO: 80327 - DNA, 20 bp, Artificial Sequence
  Description of Artificial Sequence: Synthetic oligonucleotide
  Target: ATXN1; (-) strand; PAM type: NRG; PAM sequence: AGG
accaatattcaagggactca

SEQ ID NO: 80328 - DNA, 20 bp, Artificial Sequence
  Description of Artificial Sequence: Synthetic oligonucleotide
  Target: ATXN1; (-) strand; PAM type: NRG; PAM sequence: AAG
caccaatattcaagggactc

SEQ ID NO: 80329 - DNA, 20 bp, Artificial Sequence
  Description of Artificial Sequence: Synthetic oligonucleotide
  Target: ATXN1; (-) strand; PAM type: NRG; PAM sequence: GGG
agtgtggcaccaatattcaa

SEQ ID NO: 80330 - DNA, 20 bp, Artificial Sequence
  Description of Artificial Sequence: Synthetic oligonucleotide
  Target: ATXN1; (-) strand; PAM type: NRG; PAM sequence: AGG
gagtgtggcaccaatattca

SEQ ID NO: 80331 - DNA, 20 bp, Artificial Sequence
  Description of Artificial Sequence: Synthetic oligonucleotide
  Target: ATXN1; (-) strand; PAM type: NRG; PAM sequence: AAG
agagtgtggcaccaatattc

SEQ ID NO: 80332 - DNA, 20 bp, Artificial Sequence
  Description of Artificial Sequence: Synthetic oligonucleotide
  Target: ATXN1; (-) strand; PAM type: NRG; PAM sequence: TGG
atcaagagctgagcagagtg

SEQ ID NO: 80333 - DNA, 20 bp, Artificial Sequence
  Description of Artificial Sequence: Synthetic oligonucleotide
  Target: ATXN1; (-) strand; PAM type: NRG; PAM sequence: GAG
accatatcaagagctgagca

SEQ ID NO: 80334 - DNA, 20 bp, Artificial Sequence
  Description of Artificial Sequence: Synthetic oligonucleotide
  Target: ATXN1; (-) strand; PAM type: NRG; PAM sequence: CAG
gcaccatatcaagagctgag

SEQ ID NO: 80335 - DNA, 20 bp, Artificial Sequence
  Description of Artificial Sequence: Synthetic oligonucleotide
  Target: ATXN1; (-) strand; PAM type: NRG; PAM sequence: GAG
tttgcaccatatcaagagct

SEQ ID NO: 80336 - DNA, 20 bp, Artificial Sequence
  Description of Artificial Sequence: Synthetic oligonucleotide
  Target: ATXN1; (-) strand; PAM type: NRG; PAM sequence: GAG
agtgctttgcaccatatcaa

SEQ ID NO: 80337 - DNA, 20 bp, Artificial Sequence
  Description of Artificial Sequence: Synthetic oligonucleotide
  Target: ATXN1; (-) strand; PAM type: NRG; PAM sequence: AAG
ttagtgctttgcaccatatc

SEQ ID NO: 80338 - DNA, 20 bp, Artificial Sequence
  Description of Artificial Sequence: Synthetic oligonucleotide
  Target: ATXN1; (-) strand; PAM type: NRG; PAM sequence: TAG
ctgtgacacctgtgtgattt

SEQ ID NO: 80339 - DNA, 20 bp, Artificial Sequence
  Description of Artificial Sequence: Synthetic oligonucleotide
  Target: ATXN1; (-) strand; PAM type: NRG; PAM sequence: TGG
ttggaatgatacagaatttt

SEQ ID NO: 80340 - DNA, 20 bp, Artificial Sequence
  Description of Artificial Sequence: Synthetic oligonucleotide
  Target: ATXN1; (-) strand; PAM type: NRG; PAM sequence: CAG
aagtcagctttggaatgata

SEQ ID NO: 80341 - DNA, 20 bp, Artificial Sequence
  Description of Artificial Sequence: Synthetic oligonucleotide
  Target: ATXN1; (-) strand; PAM type: NRG; PAM sequence: TGG
gatgggggacaagtcagctt

SEQ ID NO: 80342 - DNA, 20 bp, Artificial Sequence
  Description of Artificial Sequence: Synthetic oligonucleotide
  Target: ATXN1; (-) strand; PAM type: NRG; PAM sequence: CAG
gggactgatgggggacaagt

SEQ ID NO: 80343 - DNA, 20 bp, Artificial Sequence
  Description of Artificial Sequence: Synthetic oligonucleotide
  Target: ATXN1; (-) strand; PAM type: NRG; PAM sequence: AAG
agttgggactgatgggggac

SEQ ID NO: 80344 - DNA, 20 bp, Artificial Sequence
  Description of Artificial Sequence: Synthetic oligonucleotide
  Target: ATXN1; (-) strand; PAM type: NRG; PAM sequence: GGG
ggcagagttgggactgatgg

SEQ ID NO: 80345 - DNA, 20 bp, Artificial Sequence
  Description of Artificial Sequence: Synthetic oligonucleotide
  Target: ATXN1; (-) strand; PAM type: NRG; PAM sequence: GGG
gggcagagttgggactgatg

SEQ ID NO: 80346 - DNA, 20 bp, Artificial Sequence
  Description of Artificial Sequence: Synthetic oligonucleotide
  Target: ATXN1; (-) strand; PAM type: NRG; PAM sequence: GGG
ggggcagagttgggactgat

SEQ ID NO: 80347 - DNA, 20 bp, Artificial Sequence
  Description of Artificial Sequence: Synthetic oligonucleotide
  Target: ATXN1; (-) strand; PAM type: NRG; PAM sequence: TGG
tggggcagagttgggactga

SEQ ID NO: 80348 - DNA, 20 bp, Artificial Sequence
  Description of Artificial Sequence: Synthetic oligonucleotide
  Target: ATXN1; (-) strand; PAM type: NRG; PAM sequence: GGG
gagacttctggggcagagtt

SEQ ID NO: 80349 - DNA, 20 bp, Artificial Sequence
  Description of Artificial Sequence: Synthetic oligonucleotide
  Target: ATXN1; (-) strand; PAM type: NRG; PAM sequence: TGG
tgagacttctggggcagagt

SEQ ID NO: 80350 - DNA, 20 bp, Artificial Sequence
  Description of Artificial Sequence: Synthetic oligonucleotide
  Target: ATXN1; (-) strand; PAM type: NRG; PAM sequence: GAG
tcagtgagacttctggggca

SEQ ID NO: 80351 - DNA, 20 bp, Artificial Sequence
  Description of Artificial Sequence: Synthetic oligonucleotide
  Target: ATXN1; (-) strand; PAM type: NRG; PAM sequence: CAG
tttcagtgagacttctgggg

SEQ ID NO: 80352 - DNA, 20 bp, Artificial Sequence
  Description of Artificial Sequence: Synthetic oligonucleotide
  Target: ATXN1; (-) strand; PAM type: NRG; PAM sequence: GGG
ttatttcagtgagacttctg

SEQ ID NO: 80353 - DNA, 20 bp, Artificial Sequence
  Description of Artificial Sequence: Synthetic oligonucleotide
  Target: ATXN1; (-) strand; PAM type: NRG; PAM sequence: GGG
tttatttcagtgagacttct

SEQ ID NO: 80354 - DNA, 20 bp, Artificial Sequence
  Description of Artificial Sequence: Synthetic oligonucleotide
  Target: ATXN1; (-) strand; PAM type: NRG; PAM sequence: TGG
ctttatttcagtgagacttc

SEQ ID NO: 80355 - DNA, 20 bp, Artificial Sequence
  Description of Artificial Sequence: Synthetic oligonucleotide
  Target: ATXN1; (-) strand; PAM type: NRG; PAM sequence: GAG
cctggagactttatttcagt

SEQ ID NO: 80356 - DNA, 20 bp, Artificial Sequence
  Description of Artificial Sequence: Synthetic oligonucleotide
  Target: ATXN1; (-) strand; PAM type: NRG; PAM sequence: CAG
gtatcctggagactttattt

SEQ ID NO: 80357 - DNA, 20 bp, Artificial Sequence
  Description of Artificial Sequence: Synthetic oligonucleotide
  Target: ATXN1; (-) strand; PAM type: NRG; PAM sequence: GAG
gtggcaagacaggtatcctg

SEQ ID NO: 80358 - DNA, 20 bp, Artificial Sequence
  Description of Artificial Sequence: Synthetic oligonucleotide
  Target: ATXN1; (-) strand; PAM type: NRG; PAM sequence: TGG
gagtggcaagacaggtatcc

SEQ ID NO: 80359 - DNA, 20 bp, Artificial Sequence
  Description of Artificial Sequence: Synthetic oligonucleotide
  Target: ATXN1; (-) strand; PAM type: NRG; PAM sequence: AGG
tgaatgaggagtggcaagac

SEQ ID NO: 80360 - DNA, 20 bp, Artificial Sequence
  Description of Artificial Sequence: Synthetic oligonucleotide
  Target: ATXN1; (-) strand; PAM type: NRG; PAM sequence: CAG
gtgaatgaggagtggcaaga

SEQ ID NO: 80361 - DNA, 20 bp, Artificial Sequence
  Description of Artificial Sequence: Synthetic oligonucleotide
  Target: ATXN1; (-) strand; PAM type: NRG; PAM sequence: AAG
ggatgtgaatgaggagtggc

SEQ ID NO: 80362 - DNA, 20 bp, Artificial Sequence
  Description of Artificial Sequence: Synthetic oligonucleotide
  Target: ATXN1; (-) strand; PAM type: NRG; PAM sequence: TGG
ccaaggatgtgaatgaggag

SEQ ID NO: 80363 - DNA, 20 bp, Artificial Sequence
  Description of Artificial Sequence: Synthetic oligonucleotide
  Target: ATXN1; (-) strand; PAM type: NRG; PAM sequence: GAG
aaaccaaggatgtgaatgag

SEQ ID NO: 80364 - DNA, 20 bp, Artificial Sequence
  Description of Artificial Sequence: Synthetic oligonucleotide
  Target: ATXN1; (-) strand; PAM type: NRG; PAM sequence: AGG
taaaaccaaggatgtgaatg

SEQ ID NO: 80365 - DNA, 20 bp, Artificial Sequence
  Description of Artificial Sequence: Synthetic oligonucleotide
  Target: ATXN1; (-) strand; PAM type: NRG; PAM sequence: GAG
ataaaaccaaggatgtgaat

SEQ ID NO: 80366 - DNA, 20 bp, Artificial Sequence
  Description of Artificial Sequence: Synthetic oligonucleotide
  Target: ATXN1; (-) strand; PAM type: NRG; PAM sequence: AGG
aagtgtgggtcataaaacca

SEQ ID NO: 80367 - DNA, 20 bp, Artificial Sequence
  Description of Artificial Sequence: Synthetic oligonucleotide
  Target: ATXN1; (-) strand; PAM type: NRG; PAM sequence: AAG
gaagtgtgggtcataaaacc

SEQ ID NO: 80368 - DNA, 20 bp, Artificial Sequence
  Description of Artificial Sequence: Synthetic oligonucleotide
  Target: ATXN1; (-) strand; PAM type: NRG; PAM sequence: GGG
ggagagtcctatagaagtgt

SEQ ID NO: 80369 - DNA, 20 bp, Artificial Sequence
  Description of Artificial Sequence: Synthetic oligonucleotide
  Target: ATXN1; (-) strand; PAM type: NRG; PAM sequence: TGG
gggagagtcctatagaagtg

SEQ ID NO: 80370 - DNA, 20 bp, Artificial Sequence
  Description of Artificial Sequence: Synthetic oligonucleotide
  Target: ATXN1; (-) strand; PAM type: NRG; PAM sequence: AAG
aagaagggagagtcctatag

SEQ ID NO: 80371 - DNA, 20 bp, Artificial Sequence
  Description of Artificial Sequence: Synthetic oligonucleotide
  Target: ATXN1; (-) strand; PAM type: NRG; PAM sequence: TAG
ctaaagaagggagagtccta

SEQ ID NO: 80372 - DNA, 20 bp, Artificial Sequence
  Description of Artificial Sequence: Synthetic oligonucleotide
  Target: ATXN1; (-) strand; PAM type: NRG; PAM sequence: GAG
aattagaactaaagaaggga

SEQ ID NO: 80373 - DNA, 20 bp, Artificial Sequence
  Description of Artificial Sequence: Synthetic oligonucleotide
  Target: ATXN1; (-) strand; PAM type: NRG; PAM sequence: GAG
ataattagaactaaagaagg

SEQ ID NO: 80374 - DNA, 20 bp, Artificial Sequence
  Description of Artificial Sequence: Synthetic oligonucleotide
  Target: ATXN1; (-) strand; PAM type: NRG; PAM sequence: GGG
taataattagaactaaagaa

SEQ ID NO: 80375 - DNA, 20 bp, Artificial Sequence
  Description of Artificial Sequence: Synthetic oligonucleotide
  Target: ATXN1; (-) strand; PAM type: NRG; PAM sequence: AGG
ttaataattagaactaaaga

SEQ ID NO: 80376 - DNA, 20 bp, Artificial Sequence
  Description of Artificial Sequence: Synthetic oligonucleotide
  Target: ATXN1; (-) strand; PAM type: NRG; PAM sequence: AAG
tttaataattagaactaaag

SEQ ID NO: 80377 - DNA, 20 bp, Artificial Sequence
  Description of Artificial Sequence: Synthetic oligonucleotide
  Target: ATXN1; (-) strand; PAM type: NRG; PAM sequence: AAG
gcttttaataattagaacta

SEQ ID NO: 80378 - DNA, 20 bp, Artificial Sequence
  Description of Artificial Sequence: Synthetic oligonucleotide
  Target: ATXN1; (-) strand; PAM type: NRG; PAM sequence: TAG
agaaccctgcttttaataat

SEQ ID NO: 80379 - DNA, 20 bp, Artificial Sequence
  Description of Artificial Sequence: Synthetic oligonucleotide
  Target: ATXN1; (-) strand; PAM type: NRG; PAM sequence: CAG
ttgcaatcaccttgggattt

SEQ ID NO: 80380 - DNA, 20 bp, Artificial Sequence
  Description of Artificial Sequence: Synthetic oligonucleotide
  Target: ATXN1; (-) strand; PAM type: NRG; PAM sequence: GGG
gggagttttgcaatcacctt

SEQ ID NO: 80381 - DNA, 20 bp, Artificial Sequence
  Description of Artificial Sequence: Synthetic oligonucleotide
  Target: ATXN1; (-) strand; PAM type: NRG; PAM sequence: TGG
tgggagttttgcaatcacct

SEQ ID NO: 80382 - DNA, 20 bp, Artificial Sequence
  Description of Artificial Sequence: Synthetic oligonucleotide
  Target: ATXN1; (-) strand; PAM type: NRG; PAM sequence: GAG
aagatttgtggctgagatgg

SEQ ID NO: 80383 - DNA, 20 bp, Artificial Sequence
  Description of Artificial Sequence: Synthetic oligonucleotide
  Target: ATXN1; (-) strand; PAM type: NRG; PAM sequence: GGG
tgaagatttgtggctgagat

SEQ ID NO: 80384 - DNA, 20 bp, Artificial Sequence
  Description of Artificial Sequence: Synthetic oligonucleotide
  Target: ATXN1; (-) strand; PAM type: NRG; PAM sequence: TGG
atgaagatttgtggctgaga

SEQ ID NO: 80385 - DNA, 20 bp, Artificial Sequence
  Description of Artificial Sequence: Synthetic oligonucleotide
  Target: ATXN1; (-) strand; PAM type: NRG; PAM sequence: GAG
tctaatgaagatttgtggct

SEQ ID NO: 80386 - DNA, 20 bp, Artificial Sequence
  Description of Artificial Sequence: Synthetic oligonucleotide
  Target: ATXN1; (-) strand; PAM type: NRG; PAM sequence: TGG
gccattctaatgaagatttg

SEQ ID NO: 80387 - DNA, 20 bp, Artificial Sequence
  Description of Artificial Sequence: Synthetic oligonucleotide
  Target: ATXN1; (-) strand; PAM type: NRG; PAM sequence: AAG
attgattagccattctaatg

SEQ ID NO: 80388 - DNA, 20 bp, Artificial Sequence
  Description of Artificial Sequence: Synthetic oligonucleotide
  Target: ATXN1; (-) strand; PAM type: NRG; PAM sequence: TAG
gaaacaaaactcttattgat

SEQ ID NO: 80389 - DNA, 20 bp, Artificial Sequence
  Description of Artificial Sequence: Synthetic oligonucleotide
  Target: ATXN1; (-) strand; PAM type: NRG; PAM sequence: GGG
tacagaggaaataaagtggt

SEQ ID NO: 80390 - DNA, 20 bp, Artificial Sequence
  Description of Artificial Sequence: Synthetic oligonucleotide
  Target: ATXN1; (-) strand; PAM type: NRG; PAM sequence: TGG
atacagaggaaataaagtgg

SEQ ID NO: 80391 - DNA, 20 bp, Artificial Sequence
  Description of Artificial Sequence: Synthetic oligonucleotide
  Target: ATXN1; (-) strand; PAM type: NRG; PAM sequence: TGG
aacatacagaggaaataaag

SEQ ID NO: 80392 - DNA, 20 bp, Artificial Sequence
  Description of Artificial Sequence: Synthetic oligonucleotide
  Target: ATXN1; (-) strand; PAM type: NRG; PAM sequence: AAG
aaaaacatacagaggaaata

SEQ ID NO: 80393 - DNA, 20 bp, Artificial Sequence
  Description of Artificial Sequence: Synthetic oligonucleotide
  Target: ATXN1; (-) strand; PAM type: NRG; PAM sequence: AGG
attcttcaaaaaacatacag

SEQ ID NO: 80394 - DNA, 20 bp, Artificial Sequence
  Description of Artificial Sequence: Synthetic oligonucleotide
  Target: ATXN1; (-) strand; PAM type: NRG; PAM sequence: GAG
aattcttcaaaaaacataca

SEQ ID NO: 80395 - DNA, 20 bp, Artificial Sequence
  Description of Artificial Sequence: Synthetic oligonucleotide
  Target: ATXN1; (-) strand; PAM type: NRG; PAM sequence: CAG
aaaattcttcaaaaaacata

SEQ ID NO: 80396 - DNA, 20 bp, Artificial Sequence
  Description of Artificial Sequence: Synthetic oligonucleotide
  Target: ATXN1; (-) strand; PAM type: NRG; PAM sequence: TGG
cttgagttttagttatatca

SEQ ID NO: 80397 - DNA, 20 bp, Artificial Sequence
  Description of Artificial Sequence: Synthetic oligonucleotide
  Target: ATXN1; (-) strand; PAM type: NRG; PAM sequence: TAG
tcctgttgatgcttgagttt

SEQ ID NO: 80398 - DNA, 20 bp, Artificial Sequence
  Description of Artificial Sequence: Synthetic oligonucleotide
  Target: ATXN1; (-) strand; PAM type: NRG; PAM sequence: GAG
cctctttcctgttgatgctt

SEQ ID NO: 80399 - DNA, 20 bp, Artificial Sequence
  Description of Artificial Sequence: Synthetic oligonucleotide
  Target: ATXN1; (-) strand; PAM type: NRG; PAM sequence: GAG
agcactagtggcttatttct

SEQ ID NO: 80400 - DNA, 20 bp, Artificial Sequence
  Description of Artificial Sequence: Synthetic oligonucleotide
  Target: ATXN1; (-) strand; PAM type: NRG; PAM sequence: TGG
gccctattttcgagcactag

SEQ ID NO: 80401 - DNA, 20 bp, Artificial Sequence
  Description of Artificial Sequence: Synthetic oligonucleotide
  Target: ATXN1; (-) strand; PAM type: NRG; PAM sequence: TAG
catgccctattttcgagcac

SEQ ID NO: 80402 - DNA, 20 bp, Artificial Sequence
  Description of Artificial Sequence: Synthetic oligonucleotide
  Target: ATXN1; (-) strand; PAM type: NRG; PAM sequence: GAG
acatcacatgccctattttc

SEQ ID NO: 80403 - DNA, 20 bp, Artificial Sequence
  Description of Artificial Sequence: Synthetic oligonucleotide
  Target: ATXN1; (-) strand; PAM type: NRG; PAM sequence: CAG
gtggagcatggattctaaac

SEQ ID NO: 80404 - DNA, 20 bp, Artificial Sequence
  Description of Artificial Sequence: Synthetic oligonucleotide
  Target: ATXN1; (-) strand; PAM type: NRG; PAM sequence: TGG
agctacgatgcagtggagca

SEQ ID NO: 80405 - DNA, 20 bp, Artificial Sequence
  Description of Artificial Sequence: Synthetic oligonucleotide
  Target: ATXN1; (-) strand; PAM type: NRG; PAM sequence: GAG
accatagctacgatgcagtg

SEQ ID NO: 80406 - DNA, 20 bp, Artificial Sequence
  Description of Artificial Sequence: Synthetic oligonucleotide
  Target: ATXN1; (-) strand; PAM type: NRG; PAM sequence: TGG
ccaccatagctacgatgcag

SEQ ID NO: 80407 - DNA, 20 bp, Artificial Sequence
  Description of Artificial Sequence: Synthetic oligonucleotide
  Target: ATXN1; (-) strand; PAM type: NRG; PAM sequence: CAG
gccccaccatagctacgatg

SEQ ID NO: 80408 - DNA, 20 bp, Artificial Sequence
  Description of Artificial Sequence: Synthetic oligonucleotide
  Target: ATXN1; (-) strand; PAM type: NRG; PAM sequence: TAG
taagaatccatgccccacca

SEQ ID NO: 80409 - DNA, 20 bp, Artificial Sequence
  Description of Artificial Sequence: Synthetic oligonucleotide
  Target: ATXN1; (-) strand; PAM type: NRG; PAM sequence: AAG
gaatgagactaattaataat

SEQ ID NO: 80410 - DNA, 20 bp, Artificial Sequence
  Description of Artificial Sequence: Synthetic oligonucleotide
  Target: ATXN1; (-) strand; PAM type: NRG; PAM sequence: GAG
tgagacaaaagtgaaggaat

SEQ ID NO: 80411 - DNA, 20 bp, Artificial Sequence
  Description of Artificial Sequence: Synthetic oligonucleotide
  Target: ATXN1; (-) strand; PAM type: NRG; PAM sequence: AGG
gtggtgtgagacaaaagtga

SEQ ID NO: 80412 - DNA, 20 bp, Artificial Sequence
  Description of Artificial Sequence: Synthetic oligonucleotide
  Target: ATXN1; (-) strand; PAM type: NRG; PAM sequence: AAG
ggtggtgtgagacaaaagtg

SEQ ID NO: 80413 - DNA, 20 bp, Artificial Sequence
  Description of Artificial Sequence: Synthetic oligonucleotide
  Target: ATXN1; (-) strand; PAM type: NRG; PAM sequence: AAG
ttacaggtggtgtgagacaa

SEQ ID NO: 80414 - DNA, 20 bp, Artificial Sequence
  Description of Artificial Sequence: Synthetic oligonucleotide
  Target: ATXN1; (-) strand; PAM type: NRG; PAM sequence: GAG
ttttgttttacaggtggtgt

SEQ ID NO: 80415 - DNA, 20 bp, Artificial Sequence
  Description of Artificial Sequence: Synthetic oligonucleotide
  Target: ATXN1; (-) strand; PAM type: NRG; PAM sequence: TGG
tattgcttttgttttacagg

SEQ ID NO: 80416 - DNA, 20 bp, Artificial Sequence
  Description of Artificial Sequence: Synthetic oligonucleotide
  Target: ATXN1; (-) strand; PAM type: NRG; PAM sequence: AGG
cattattgcttttgttttac

SEQ ID NO: 80417 - DNA, 20 bp, Artificial Sequence
  Description of Artificial Sequence: Synthetic oligonucleotide
  Target: ATXN1; (-) strand; PAM type: NRG; PAM sequence: CAG
gcattattgcttttgtttta

SEQ ID NO: 80418 - DNA, 20 bp, Artificial Sequence
  Description of Artificial Sequence: Synthetic oligonucleotide
  Target: ATXN1; (-) strand; PAM type: NRG; PAM sequence: AAG
tcctcactaccccatgaagt

SEQ ID NO: 80419 - DNA, 20 bp, Artificial Sequence
  Description of Artificial Sequence: Synthetic oligonucleotide
  Target: ATXN1; (-) strand; PAM type: NRG; PAM sequence: AAG
aacctcctcactaccccatg

SEQ ID NO: 80420 - DNA, 20 bp, Artificial Sequence
  Description of Artificial Sequence: Synthetic oligonucleotide
  Target: ATXN1; (-) strand; PAM type: NRG; PAM sequence: TAG
ctcattaagagcattagctg

SEQ ID NO: 80421 - DNA, 20 bp, Artificial Sequence
  Description of Artificial Sequence: Synthetic oligonucleotide
  Target: ATXN1; (-) strand; PAM type: NRG; PAM sequence: TAG
aggcatctcattaagagcat

SEQ ID NO: 80422 - DNA, 20 bp, Artificial Sequence
  Description of Artificial Sequence: Synthetic oligonucleotide
  Target: ATXN1; (-) strand; PAM type: NRG; PAM sequence: GAG
aaaggaaggcatctcattaa

SEQ ID NO: 80423 - DNA, 20 bp, Artificial Sequence
  Description of Artificial Sequence: Synthetic oligonucleotide
  Target: ATXN1; (-) strand; PAM type: NRG; PAM sequence: AAG
gaaaaggaaggcatctcatt

SEQ ID NO: 80424 - DNA, 20 bp, Artificial Sequence
  Description of Artificial Sequence: Synthetic oligonucleotide
  Target: ATXN1; (-) strand; PAM type: NRG; PAM sequence: AGG
ctggccagagaggaaaagga

SEQ ID NO: 80425 - DNA, 20 bp, Artificial Sequence
  Description of Artificial Sequence: Synthetic oligonucleotide
  Target: ATXN1; (-) strand; PAM type: NRG; PAM sequence: AAG
actggccagagaggaaaagg

SEQ ID NO: 80426 - DNA, 20 bp, Artificial Sequence
  Description of Artificial Sequence: Synthetic oligonucleotide
  Target: ATXN1; (-) strand; PAM type: NRG; PAM sequence: AGG
ctcactggccagagaggaaa

SEQ ID NO: 80427 - DNA, 20 bp, Artificial Sequence
  Description of Artificial Sequence: Synthetic oligonucleotide
  Target: ATXN1; (-) strand; PAM type: NRG; PAM sequence: AAG
cctcactggccagagaggaa

SEQ ID NO: 80428 - DNA, 20 bp, Artificial Sequence
  Description of Artificial Sequence: Synthetic oligonucleotide
  Target: ATXN1; (-) strand; PAM type: NRG; PAM sequence: AGG
ccacccctcactggccagag

SEQ ID NO: 80429 - DNA, 20 bp, Artificial Sequence
  Description of Artificial Sequence: Synthetic oligonucleotide
  Target: ATXN1; (-) strand; PAM type: NRG; PAM sequence: GAG
tccacccctcactggccaga

SEQ ID NO: 80430 - DNA, 20 bp, Artificial Sequence
  Description of Artificial Sequence: Synthetic oligonucleotide
  Target: ATXN1; (-) strand; PAM type: NRG; PAM sequence: GAG
gatccacccctcactggcca

SEQ ID NO: 80431 - DNA, 20 bp, Artificial Sequence
  Description of Artificial Sequence: Synthetic oligonucleotide
  Target: ATXN1; (-) strand; PAM type: NRG; PAM sequence: CAG
atgatccacccctcactggc

SEQ ID NO: 80432 - DNA, 20 bp, Artificial Sequence
  Description of Artificial Sequence: Synthetic oligonucleotide
  Target: ATXN1; (-) strand; PAM type: NRG; PAM sequence: TGG
ttacatgatccacccctcac

SEQ ID NO: 80433 - DNA, 20 bp, Artificial Sequence
  Description of Artificial Sequence: Synthetic oligonucleotide
  Target: ATXN1; (-) strand; PAM type: NRG; PAM sequence: AGG
gaagagtgaatagggaaagg

SEQ ID NO: 80434 - DNA, 20 bp, Artificial Sequence
  Description of Artificial Sequence: Synthetic oligonucleotide
  Target: ATXN1; (-) strand; PAM type: NRG; PAM sequence: GAG
agaagagtgaatagggaaag

SEQ ID NO: 80435 - DNA, 20 bp, Artificial Sequence
  Description of Artificial Sequence: Synthetic oligonucleotide
  Target: ATXN1; (-) strand; PAM type: NRG; PAM sequence: AGG
gaagaagagtgaatagggaa

SEQ ID NO: 80436 - DNA, 20 bp, Artificial Sequence
  Description of Artificial Sequence: Synthetic oligonucleotide
  Target: ATXN1; (-) strand; PAM type: NRG; PAM sequence: AAG
ggaagaagagtgaataggga

SEQ ID NO: 80437 - DNA, 20 bp, Artificial Sequence
  Description of Artificial Sequence: Synthetic oligonucleotide
  Target: ATXN1; (-) strand; PAM type: NRG; PAM sequence: GGG
ttggggaagaagagtgaata

SEQ ID NO: 80438 - DNA, 20 bp, Artificial Sequence
  Description of Artificial Sequence: Synthetic oligonucleotide
  Target: ATXN1; (-) strand; PAM type: NRG; PAM sequence: AGG
gttggggaagaagagtgaat

SEQ ID NO: 80439 - DNA, 20 bp, Artificial Sequence
  Description of Artificial Sequence: Synthetic oligonucleotide
  Target: ATXN1; (-) strand; PAM type: NRG; PAM sequence: TAG
agttggggaagaagagtgaa

SEQ ID NO: 80440 - DNA, 20 bp, Artificial Sequence
  Description of Artificial Sequence: Synthetic oligonucleotide
  Target: ATXN1; (-) strand; PAM type: NRG; PAM sequence: GAG
ggggattagttggggaagaa

SEQ ID NO: 80441 - DNA, 20 bp, Artificial Sequence
  Description of Artificial Sequence: Synthetic oligonucleotide
  Target: ATXN1; (-) strand; PAM type: NRG; PAM sequence: AAG
gaggggattagttggggaag

SEQ ID NO: 80442 - DNA, 20 bp, Artificial Sequence
  Description of Artificial Sequence: Synthetic oligonucleotide
  Target: ATXN1; (-) strand; PAM type: NRG; PAM sequence: AAG
gctgaggggattagttgggg

SEQ ID NO: 80443 - DNA, 20 bp, Artificial Sequence
  Description of Artificial Sequence: Synthetic oligonucleotide
  Target: ATXN1; (-) strand; PAM type: NRG; PAM sequence: GGG
gtggctgaggggattagttg

SEQ ID NO: 80444 - DNA, 20 bp, Artificial Sequence
  Description of Artificial Sequence: Synthetic oligonucleotide
  Target: ATXN1; (-) strand; PAM type: NRG; PAM sequence: GGG
agtggctgaggggattagtt

SEQ ID NO: 80445 - DNA, 20 bp, Artificial Sequence
  Description of Artificial Sequence: Synthetic oligonucleotide
  Target: ATXN1; (-) strand; PAM type: NRG; PAM sequence: TGG
cagtggctgaggggattagt

SEQ ID NO: 80446 - DNA, 20 bp, Artificial Sequence
  Description of Artificial Sequence: Synthetic oligonucleotide
  Target: ATXN1; (-) strand; PAM type: NRG; PAM sequence: TAG
gtgccagtggctgaggggat

SEQ ID NO: 80447 - DNA, 20 bp, Artificial Sequence
  Description of Artificial Sequence: Synthetic oligonucleotide
  Target: ATXN1; (-) strand; PAM type: NRG; PAM sequence: GGG
acatggtgccagtggctgag

SEQ ID NO: 80448 - DNA, 20 bp, Artificial Sequence
  Description of Artificial Sequence: Synthetic oligonucleotide
  Target: ATXN1; (-) strand; PAM type: NRG; PAM sequence: GGG
aacatggtgccagtggctga

SEQ ID NO: 80449 - DNA, 20 bp, Artificial Sequence
  Description of Artificial Sequence: Synthetic oligonucleotide
  Target: ATXN1; (-) strand; PAM type: NRG; PAM sequence: AGG
gaacatggtgccagtggctg

SEQ ID NO: 80450 - DNA, 20 bp, Artificial Sequence
  Description of Artificial Sequence: Synthetic oligonucleotide
  Target: ATXN1; (-) strand; PAM type: NRG; PAM sequence: GAG
ggaacatggtgccagtggct

SEQ ID NO: 80451 - DNA, 20 bp, Artificial Sequence
  Description of Artificial Sequence: Synthetic oligonucleotide
  Target: ATXN1; (-) strand; PAM type: NRG; PAM sequence: TGG
catgcggaacatggtgccag

SEQ ID NO: 80452 - DNA, 20 bp, Artificial Sequence
  Description of Artificial Sequence: Synthetic oligonucleotide
  Target: ATXN1; (-) strand; PAM type: NRG; PAM sequence: CAG
taacatgcggaacatggtgc

SEQ ID NO: 80453 - DNA, 20 bp, Artificial Sequence
  Description of Artificial Sequence: Synthetic oligonucleotide
  Target: ATXN1; (-) strand; PAM type: NRG; PAM sequence: TGG
tgcctctaacatgcggaaca

SEQ ID NO: 80454 - DNA, 20 bp, Artificial Sequence
  Description of Artificial Sequence: Synthetic oligonucleotide
  Target: ATXN1; (-) strand; PAM type: NRG; PAM sequence: CGG
ggaaggatgcctctaacatg

SEQ ID NO: 80455 - DNA, 20 bp, Artificial Sequence
  Description of Artificial Sequence: Synthetic oligonucleotide
  Target: ATXN1; (-) strand; PAM type: NRG; PAM sequence: AGG
tgtgtctcactgccccagga

SEQ ID NO: 80456 - DNA, 20 bp, Artificial Sequence
  Description of Artificial Sequence: Synthetic oligonucleotide
  Target: ATXN1; (-) strand; PAM type: NRG; PAM sequence: AAG
atgtgtctcactgccccagg

SEQ ID NO: 80457 - DNA, 20 bp, Artificial Sequence
  Description of Artificial Sequence: Synthetic oligonucleotide
  Target: ATXN1; (-) strand; PAM type: NRG; PAM sequence: AGG
aggatgtgtctcactgcccc

SEQ ID NO: 80458 - DNA, 20 bp, Artificial Sequence
  Description of Artificial Sequence: Synthetic oligonucleotide
  Target: ATXN1; (-) strand; PAM type: NRG; PAM sequence: CAG
caggatgtgtctcactgccc

SEQ ID NO: 80459 - DNA, 20 bp, Artificial Sequence
  Description of Artificial Sequence: Synthetic oligonucleotide
  Target: ATXN1; (-) strand; PAM type: NRG; PAM sequence: AGG
tagggtgacaaggctgattc

SEQ ID NO: 80460 - DNA, 20 bp, Artificial Sequence
  Description of Artificial Sequence: Synthetic oligonucleotide
  Target: ATXN1; (-) strand; PAM type: NRG; PAM sequence: CAG
ttagggtgacaaggctgatt

SEQ ID NO: 80461 - DNA, 20 bp, Artificial Sequence
  Description of Artificial Sequence: Synthetic oligonucleotide
  Target: ATXN1; (-) strand; PAM type: NRG; PAM sequence: AGG
aggtcccctttagggtgaca

SEQ ID NO: 80462 - DNA, 20 bp, Artificial Sequence
  Description of Artificial Sequence: Synthetic oligonucleotide
  Target: ATXN1; (-) strand; PAM type: NRG; PAM sequence: AAG
aaggtcccctttagggtgac

SEQ ID NO: 80463 - DNA, 20 bp, Artificial Sequence
  Description of Artificial Sequence: Synthetic oligonucleotide
  Target: ATXN1; (-) strand; PAM type: NRG; PAM sequence: GGG
acgttgcaaggtccccttta

SEQ ID NO: 80464 - DNA, 20 bp, Artificial Sequence
  Description of Artificial Sequence: Synthetic oligonucleotide
  Target: ATXN1; (-) strand; PAM type: NRG; PAM sequence: AGG
aacgttgcaaggtccccttt

SEQ ID NO: 80465 - DNA, 20 bp, Artificial Sequence
  Description of Artificial Sequence: Synthetic oligonucleotide
  Target: ATXN1; (-) strand; PAM type: NRG; PAM sequence: TAG
aaacgttgcaaggtcccctt

SEQ ID NO: 80466 - DNA, 20 bp, Artificial Sequence
  Description of Artificial Sequence: Synthetic oligonucleotide
  Target: ATXN1; (-) strand; PAM type: NRG; PAM sequence: AGG
acccacgagcaaacgttgca

SEQ ID NO: 80467 - DNA, 20 bp, Artificial Sequence
  Description of Artificial Sequence: Synthetic oligonucleotide
  Target: ATXN1; (-) strand; PAM type: NRG; PAM sequence: AAG
gacccacgagcaaacgttgc

SEQ ID NO: 80468 - DNA, 20 bp, Artificial Sequence
  Description of Artificial Sequence: Synthetic oligonucleotide
  Target: ATXN1; (-) strand; PAM type: NRG; PAM sequence: GAG
gtgtggtgttgtcgacccac

SEQ ID NO: 80469 - DNA, 20 bp, Artificial Sequence
  Description of Artificial Sequence: Synthetic oligonucleotide
  Target: ATXN1; (-) strand; PAM type: NRG; PAM sequence: TGG
atcctcatgtcagctctgtg

SEQ ID NO: 80470 - DNA, 20 bp, Artificial Sequence
  Description of Artificial Sequence: Synthetic oligonucleotide
  Target: ATXN1; (-) strand; PAM type: NRG; PAM sequence: CAG
gtcacatgtcatcctcatgt

SEQ ID NO: 80471 - DNA, 20 bp, Artificial Sequence
  Description of Artificial Sequence: Synthetic oligonucleotide
  Target: ATXN1; (-) strand; PAM type: NRG; PAM sequence: AAG
gtgttcatttagcaggctct

SEQ ID NO: 80472 - DNA, 20 bp, Artificial Sequence
  Description of Artificial Sequence: Synthetic oligonucleotide
  Target: ATXN1; (-) strand; PAM type: NRG; PAM sequence: AGG
agctcatgtgttcatttagc

SEQ ID NO: 80473 - DNA, 20 bp, Artificial Sequence
  Description of Artificial Sequence: Synthetic oligonucleotide
  Target: ATXN1; (-) strand; PAM type: NRG; PAM sequence: CAG
tagctcatgtgttcatttag

SEQ ID NO: 80474 - DNA, 20 bp, Artificial Sequence
  Description of Artificial Sequence: Synthetic oligonucleotide
  Target: ATXN1; (-) strand; PAM type: NRG; PAM sequence: TAG
atttagctcatgtgttcatt

SEQ ID NO: 80475 - DNA, 20 bp, Artificial Sequence
  Description of Artificial Sequence: Synthetic oligonucleotide
  Target: ATXN1; (-) strand; PAM type: NRG; PAM sequence: TAG
gcacagtggtacctagcatt

SEQ ID NO: 80476 - DNA, 20 bp, Artificial Sequence
  Description of Artificial Sequence: Synthetic oligonucleotide
  Target: ATXN1; (-) strand; PAM type: NRG; PAM sequence: TAG
atggaaagcacagtggtacc

SEQ ID NO: 80477 - DNA, 20 bp, Artificial Sequence
  Description of Artificial Sequence: Synthetic oligonucleotide
  Target: ATXN1; (-) strand; PAM type: NRG; PAM sequence: TGG
caatctcatggaaagcacag

SEQ ID NO: 80478 - DNA, 20 bp, Artificial Sequence
  Description of Artificial Sequence: Synthetic oligonucleotide
  Target: ATXN1; (-) strand; PAM type: NRG; PAM sequence: CAG
taacaatctcatggaaagca

SEQ ID NO: 80479 - DNA, 20 bp, Artificial Sequence
  Description of Artificial Sequence: Synthetic oligonucleotide
  Target: ATXN1; (-) strand; PAM type: NRG; PAM sequence: AAG
ctgcctaacaatctcatgga

SEQ ID NO: 80480 - DNA, 20 bp, Artificial Sequence
  Description of Artificial Sequence: Synthetic oligonucleotide
  Target: ATXN1; (-) strand; PAM type: NRG; PAM sequence: TGG
ccttctgcctaacaatctca

SEQ ID NO: 80481 - DNA, 20 bp, Artificial Sequence
  Description of Artificial Sequence: Synthetic oligonucleotide
  Target: ATXN1; (-) strand; PAM type: NRG; PAM sequence: CAG
aactttggagagcaaagatt

SEQ ID NO: 80482 - DNA, 20 bp, Artificial Sequence
  Description of Artificial Sequence: Synthetic oligonucleotide
  Target: ATXN1; (-) strand; PAM type: NRG; PAM sequence: AAG
aatcaaaactttggagagca

SEQ ID NO: 80483 - DNA, 20 bp, Artificial Sequence
  Description of Artificial Sequence: Synthetic oligonucleotide
  Target: ATXN1; (-) strand; PAM type: NRG; PAM sequence: GAG
attcaaatcaaaactttgga

SEQ ID NO: 80484 - DNA, 20 bp, Artificial Sequence
  Description of Artificial Sequence: Synthetic oligonucleotide
  Target: ATXN1; (-) strand; PAM type: NRG; PAM sequence: GAG
gaattcaaatcaaaactttg

SEQ ID NO: 80485 - DNA, 20 bp, Artificial Sequence
  Description of Artificial Sequence: Synthetic oligonucleotide
  Target: ATXN1; (-) strand; PAM type: NRG; PAM sequence: TGG
gtgaattcaaatcaaaactt

SEQ ID NO: 80486 - DNA, 20 bp, Artificial Sequence
  Description of Artificial Sequence: Synthetic oligonucleotide
  Target: ATXN1; (-) strand; PAM type: NRG; PAM sequence: AAG
agtgattctgggtcattgac

SEQ ID NO: 80487 - DNA, 20 bp, Artificial Sequence
  Description of Artificial Sequence: Synthetic oligonucleotide
  Target: ATXN1; (-) strand; PAM type: NRG; PAM sequence: GGG
ctcggggcttaagtgattct

SEQ ID NO: 80488 - DNA, 20 bp, Artificial Sequence
  Description of Artificial Sequence: Synthetic oligonucleotide
  Target: ATXN1; (-) strand; PAM type: NRG; PAM sequence: TGG
cctcggggcttaagtgattc

SEQ ID NO: 80489 - DNA, 20 bp, Artificial Sequence
  Description of Artificial Sequence: Synthetic oligonucleotide
  Target: ATXN1; (-) strand; PAM type: NRG; PAM sequence: AAG
gcatggccccctcggggctt

SEQ ID NO: 80490 - DNA, 20 bp, Artificial Sequence
  Description of Artificial Sequence: Synthetic oligonucleotide
  Target: ATXN1; (-) strand; PAM type: NRG; PAM sequence: GGG
ctggtggcatggccccctcg

SEQ ID NO: 80491 - DNA, 20 bp, Artificial Sequence
  Description of Artificial Sequence: Synthetic oligonucleotide
  Target: ATXN1; (-) strand; PAM type: NRG; PAM sequence: GGG
gctggtggcatggccccctc

SEQ ID NO: 80492 - DNA, 20 bp, Artificial Sequence
  Description of Artificial Sequence: Synthetic oligonucleotide
  Target: ATXN1; (-) strand; PAM type: NRG; PAM sequence: CGG
tgctggtggcatggccccct

SEQ ID NO: 80493 - DNA, 20 bp, Artificial Sequence
  Description of Artificial Sequence: Synthetic oligonucleotide
  Target: ATXN1; (-) strand; PAM type: NRG; PAM sequence: TGG
gccctgctgtgctggtggca

SEQ ID NO: 80494 - DNA, 20 bp, Artificial Sequence
  Description of Artificial Sequence: Synthetic oligonucleotide
  Target: ATXN1; (-) strand; PAM type: NRG; PAM sequence: TGG
atctggccctgctgtgctgg

SEQ ID NO: 80495 - DNA, 20 bp, Artificial Sequence
  Description of Artificial Sequence: Synthetic oligonucleotide
  Target: ATXN1; (-) strand; PAM type: NRG; PAM sequence: TGG
atgatctggccctgctgtgc

SEQ ID NO: 80496 - DNA, 20 bp, Artificial Sequence
  Description of Artificial Sequence: Synthetic oligonucleotide
  Target: ATXN1; (-) strand; PAM type: NRG; PAM sequence: TGG
cccagtggggcttcatgatc

SEQ ID NO: 80497 - DNA, 20 bp, Artificial Sequence
  Description of Artificial Sequence: Synthetic oligonucleotide
  Target: ATXN1; (-) strand; PAM type: NRG; PAM sequence: GGG
cccaaccccgcatcccagtg

SEQ ID NO: 80498 - DNA, 20 bp, Artificial Sequence
  Description of Artificial Sequence: Synthetic oligonucleotide
  Target: ATXN1; (-) strand; PAM type: NRG; PAM sequence: GGG
ccccaaccccgcatcccagt

SEQ ID NO: 80499 - DNA, 20 bp, Artificial Sequence
  Description of Artificial Sequence: Synthetic oligonucleotide
  Target: ATXN1; (-) strand; PAM type: NRG; PAM sequence: TGG
cccccaaccccgcatcccag

SEQ ID NO: 80500 - DNA, 20 bp, Artificial Sequence
  Description of Artificial Sequence: Synthetic oligonucleotide
  Target: ATXN1; (-) strand; PAM type: NRG; PAM sequence: CAG
cagcccccaaccccgcatcc

SEQ ID NO: 80501 - DNA, 20 bp, Artificial Sequence
  Description of Artificial Sequence: Synthetic oligonucleotide
  Target: ATXN1; (-) strand; PAM type: NRG; PAM sequence: CAG
tcttgacagcgagaccctta

SEQ ID NO: 80502 - DNA, 20 bp, Artificial Sequence
  Description of Artificial Sequence: Synthetic oligonucleotide
  Target: ATXN1; (-) strand; PAM type: NRG; PAM sequence: GAG
tggggccacatcttgacagc

SEQ ID NO: 80503 - DNA, 20 bp, Artificial Sequence
  Description of Artificial Sequence: Synthetic oligonucleotide
  Target: ATXN1; (-) strand; PAM type: NRG; PAM sequence: CAG
ctggtggggccacatcttga

SEQ ID NO: 80504 - DNA, 20 bp, Artificial Sequence
  Description of Artificial Sequence: Synthetic oligonucleotide
  Target: ATXN1; (-) strand; PAM type: NRG; PAM sequence: GGG
ctataaacttagcactggtg

SEQ ID NO: 80505 - DNA, 20 bp, Artificial Sequence
  Description of Artificial Sequence: Synthetic oligonucleotide
  Target: ATXN1; (-) strand; PAM type: NRG; PAM sequence: GGG
actataaacttagcactggt

SEQ ID NO: 80506 - DNA, 20 bp, Artificial Sequence
  Description of Artificial Sequence: Synthetic oligonucleotide
  Target: ATXN1; (-) strand; PAM type: NRG; PAM sequence: TGG
cactataaacttagcactgg

SEQ ID NO: 80507 - DNA, 20 bp, Artificial Sequence
  Description of Artificial Sequence: Synthetic oligonucleotide
  Target: ATXN1; (-) strand; PAM type: NRG; PAM sequence: TGG
gagcactataaacttagcac

SEQ ID NO: 80508 - DNA, 20 bp, Artificial Sequence
  Description of Artificial Sequence: Synthetic oligonucleotide
  Target: ATXN1; (-) strand; PAM type: NRG; PAM sequence: TAG
cttttggagcactataaact

SEQ ID NO: 80509 - DNA, 20 bp, Artificial Sequence
  Description of Artificial Sequence: Synthetic oligonucleotide
  Target: ATXN1; (-) strand; PAM type: NRG; PAM sequence: GAG
aacccccctcctggcttttg

SEQ ID NO: 80510 - DNA, 20 bp, Artificial Sequence
  Description of Artificial Sequence: Synthetic oligonucleotide
  Target: ATXN1; (-) strand; PAM type: NRG; PAM sequence: TGG
ttaacccccctcctggcttt

SEQ ID NO: 80511 - DNA, 20 bp, Artificial Sequence
  Description of Artificial Sequence: Synthetic oligonucleotide
  Target: ATXN1; (-) strand; PAM type: NRG; PAM sequence: TGG
ttttttcttaacccccctcc

SEQ ID NO: 80512 - DNA, 20 bp, Artificial Sequence
  Description of Artificial Sequence: Synthetic oligonucleotide
  Target: ATXN1; (-) strand; PAM type: NRG; PAM sequence: TGG
agaggttcatgtttgtggca

SEQ ID NO: 80513 - DNA, 20 bp, Artificial Sequence
  Description of Artificial Sequence: Synthetic oligonucleotide
  Target: ATXN1; (-) strand; PAM type: NRG; PAM sequence: TGG
tctgtagaggttcatgtttg

SEQ ID NO: 80514 - DNA, 20 bp, Artificial Sequence
  Description of Artificial Sequence: Synthetic oligonucleotide
  Target: ATXN1; (-) strand; PAM type: NRG; PAM sequence: AGG
acattttctaggttctgtag

SEQ ID NO: 80515 - DNA, 20 bp, Artificial Sequence
  Description of Artificial Sequence: Synthetic oligonucleotide
  Target: ATXN1; (-) strand; PAM type: NRG; PAM sequence: GAG
cacattttctaggttctgta

SEQ ID NO: 80516 - DNA, 20 bp, Artificial Sequence
  Description of Artificial Sequence: Synthetic oligonucleotide
  Target: ATXN1; (-) strand; PAM type: NRG; PAM sequence: TAG
ttcacattttctaggttctg

SEQ ID NO: 80517 - DNA, 20 bp, Artificial Sequence
  Description of Artificial Sequence: Synthetic oligonucleotide
  Target: ATXN1; (-) strand; PAM type: NRG; PAM sequence: AGG
ggcccaatttcacattttct

SEQ ID NO: 80518 - DNA, 20 bp, Artificial Sequence
  Description of Artificial Sequence: Synthetic oligonucleotide
  Target: ATXN1; (-) strand; PAM type: NRG; PAM sequence: TAG
tggcccaatttcacattttc

SEQ ID NO: 80519 - DNA, 20 bp, Artificial Sequence
  Description of Artificial Sequence: Synthetic oligonucleotide
  Target: ATXN1; (-) strand; PAM type: NRG; PAM sequence: TGG
tgggactacagatgtgagcc

SEQ ID NO: 80520 - DNA, 20 bp, Artificial Sequence
  Description of Artificial Sequence: Synthetic oligonucleotide
  Target: ATXN1; (-) strand; PAM type: NRG; PAM sequence: GAG
agtgctgggactacagatgt

SEQ ID NO: 80521 - DNA, 20 bp, Artificial Sequence
  Description of Artificial Sequence: Synthetic oligonucleotide
  Target: ATXN1; (-) strand; PAM type: NRG; PAM sequence: CAG
ctcctaaagtgctgggacta

SEQ ID NO: 80522 - DNA, 20 bp, Artificial Sequence
  Description of Artificial Sequence: Synthetic oligonucleotide
  Target: ATXN1; (-) strand; PAM type: NRG; PAM sequence: GGG
cctctgcctcctaaagtgct

SEQ ID NO: 80523 - DNA, 20 bp, Artificial Sequence
  Description of Artificial Sequence: Synthetic oligonucleotide
  Target: ATXN1; (-) strand; PAM type: NRG; PAM sequence: TGG
acctctgcctcctaaagtgc

SEQ ID NO: 80524 - DNA, 20 bp, Artificial Sequence
  Description of Artificial Sequence: Synthetic oligonucleotide
  Target: ATXN1; (-) strand; PAM type: NRG; PAM sequence: AAG
ccattcacctctgcctccta

SEQ ID NO: 80525 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactccagacctc

SEQ ID NO: 80526 - DNA, 20 bp, Artificial Sequence
  Description of Artificial Sequence: Synthetic oligonucleotide
  Target: ATXN1; (-) strand; PAM type: NRG; PAM sequence: CAG
aggtctcgaactccagacct

SEQ ID NO: 80527 - DNA, 20 bp, Artificial Sequence
  Description of Artificial Sequence: Synthetic oligonucleotide
  Target: ATXN1; (-) strand; PAM type: NRG; PAM sequence: CAG
agcgacgaggtctcgaactc

SEQ ID NO: 80528 - DNA, 20 bp, Artificial Sequence
  Description of Artificial Sequence: Synthetic oligonucleotide
  Target: ATXN1; (-) strand; PAM type: NRG; PAM sequence: AGG
ttgtgttattagtagcgacg

SEQ ID NO: 80529 - DNA, 20 bp, Artificial Sequence
  Description of Artificial Sequence: Synthetic oligonucleotide
  Target: ATXN1; (-) strand; PAM type: NRG; PAM sequence: GAG
tttgtgttattagtagcgac

SEQ ID NO: 80530 - DNA, 20 bp, Artificial Sequence
  Description of Artificial Sequence: Synthetic oligonucleotide
  Target: ATXN1; (-) strand; PAM type: NRG; PAM sequence: TAG
taatttttttgtgttattag

SEQ ID NO: 80531 - DNA, 20 bp, Artificial Sequence
  Description of Artificial Sequence: Synthetic oligonucleotide
  Target: ATXN1; (-) strand; PAM type: NRG; PAM sequence: TAG
ggctaatttttttgtgttat

SEQ ID NO: 80532 - DNA, 20 bp, Artificial Sequence
  Description of Artificial Sequence: Synthetic oligonucleotide
  Target: ATXN1; (-) strand; PAM type: NRG; PAM sequence: CGG
caggcgcatgccaccacacc

SEQ ID NO: 80533 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 80534 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 80535 - DNA, 20 bp, Artificial Sequence
  Description of Artificial Sequence: Synthetic oligonucleotide
  Target: ATXN1; (-) strand; PAM type: NRG; PAM sequence: GGG
tctcagcctcccaagtagct

SEQ ID NO: 80536 - DNA, 20 bp, Artificial Sequence
  Description of Artificial Sequence: Synthetic oligonucleotide
  Target: ATXN1; (-) strand; PAM type: NRG; PAM sequence: TGG
gtctcagcctcccaagtagc

SEQ ID NO: 80537 - DNA, 20 bp, Artificial Sequence
  Description of Artificial Sequence: Synthetic oligonucleotide
  Target: ATXN1; (-) strand; PAM type: NRG; PAM sequence: TAG
tcctgtctcagcctcccaag

SEQ ID NO: 80538 - DNA, 20 bp, Artificial Sequence
  Description of Artificial Sequence: Synthetic oligonucleotide
  Target: ATXN1; (-) strand; PAM type: NRG; PAM sequence: AAG
ttctcctgtctcagcctccc

SEQ ID NO: 80539 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgtct

SEQ ID NO: 80540 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcccaggttc

SEQ ID NO: 80541 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccacctccc

SEQ ID NO: 80542 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccacctcc

SEQ ID NO: 80543 - DNA, 20 bp, Artificial Sequence
  Description of Artificial Sequence: Synthetic oligonucleotide
  Target: ATXN1; (-) strand; PAM type: NRG; PAM sequence: TGG
agagagcaatgacgtgatct

SEQ ID NO: 80544 - DNA, 20 bp, Artificial Sequence
  Description of Artificial Sequence: Synthetic oligonucleotide
  Target: ATXN1; (-) strand; PAM type: NRG; PAM sequence: GAG
ctcttgttgcccaggctaga

SEQ ID NO: 80545 - DNA, 20 bp, Artificial Sequence
  Description of Artificial Sequence: Synthetic oligonucleotide
  Target: ATXN1; (-) strand; PAM type: NRG; PAM sequence: GAG
tgctcttgttgcccaggcta

SEQ ID NO: 80546 - DNA, 20 bp, Artificial Sequence
  Description of Artificial Sequence: Synthetic oligonucleotide
  Target: ATXN1; (-) strand; PAM type: NRG; PAM sequence: TAG
tttgctcttgttgcccaggc

SEQ ID NO: 80547 - DNA, 20 bp, Artificial Sequence
  Description of Artificial Sequence: Synthetic oligonucleotide
  Target: ATXN1; (-) strand; PAM type: NRG; PAM sequence: AGG
gagttttgctcttgttgccc

SEQ ID NO: 80548 - DNA, 20 bp, Artificial Sequence
  Description of Artificial Sequence: Synthetic oligonucleotide
  Target: ATXN1; (-) strand; PAM type: NRG; PAM sequence: CAG
ggagttttgctcttgttgcc

SEQ ID NO: 80549 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgaggcg

SEQ ID NO: 80550 - DNA, 20 bp, Artificial Sequence
  Description of Artificial Sequence: Synthetic oligonucleotide
  Target: ATXN1; (-) strand; PAM type: NRG; PAM sequence: CGG
tcttttttttttttttgagg

SEQ ID NO: 80551 - DNA, 20 bp, Artificial Sequence
  Description of Artificial Sequence: Synthetic oligonucleotide
  Target: ATXN1; (-) strand; PAM type: NRG; PAM sequence: AGG
ttttcttttttttttttttg

SEQ ID NO: 80552 - DNA, 20 bp, Artificial Sequence
  Description of Artificial Sequence: Synthetic oligonucleotide
  Target: ATXN1; (-) strand; PAM type: NRG; PAM sequence: GAG
cttttctttttttttttttt

SEQ ID NO: 80553 - DNA, 20 bp, Artificial Sequence
  Description of Artificial Sequence: Synthetic oligonucleotide
  Target: ATXN1; (-) strand; PAM type: NRG; PAM sequence: TAG
taacagactgtaacaatgcg

SEQ ID NO: 80554 - DNA, 20 bp, Artificial Sequence
  Description of Artificial Sequence: Synthetic oligonucleotide
  Target: ATXN1; (-) strand; PAM type: NRG; PAM sequence: CAG
aaatgaccatatatcaataa

SEQ ID NO: 80555 - DNA, 20 bp, Artificial Sequence
  Description of Artificial Sequence: Synthetic oligonucleotide
  Target: ATXN1; (-) strand; PAM type: NRG; PAM sequence: AGG
tatgaagtaaacaagttaac

SEQ ID NO: 80556 - DNA, 20 bp, Artificial Sequence
  Description of Artificial Sequence: Synthetic oligonucleotide
  Target: ATXN1; (-) strand; PAM type: NRG; PAM sequence: CAG
ttatgaagtaaacaagttaa

SEQ ID NO: 80557 - DNA, 20 bp, Artificial Sequence
  Description of Artificial Sequence: Synthetic oligonucleotide
  Target: ATXN1; (-) strand; PAM type: NRG; PAM sequence: AAG
gagaatcttatgaagtaaac

SEQ ID NO: 80558 - DNA, 20 bp, Artificial Sequence
  Description of Artificial Sequence: Synthetic oligonucleotide
  Target: ATXN1; (-) strand; PAM type: NRG; PAM sequence: AAG
cccaacaagagaatcttatg

SEQ ID NO: 80559 - DNA, 20 bp, Artificial Sequence
  Description of Artificial Sequence: Synthetic oligonucleotide
  Target: ATXN1; (-) strand; PAM type: NRG; PAM sequence: GAG
tctgtaaatctacccaacaa

SEQ ID NO: 80560 - DNA, 20 bp, Artificial Sequence
  Description of Artificial Sequence: Synthetic oligonucleotide
  Target: ATXN1; (-) strand; PAM type: NRG; PAM sequence: AAG
aatctgtaaatctacccaac

SEQ ID NO: 80561 - DNA, 20 bp, Artificial Sequence
  Description of Artificial Sequence: Synthetic oligonucleotide
  Target: ATXN1; (-) strand; PAM type: NRG; PAM sequence: CAG
tgttttgaaaagatttatgg

SEQ ID NO: 80562 - DNA, 20 bp, Artificial Sequence
  Description of Artificial Sequence: Synthetic oligonucleotide
  Target: ATXN1; (-) strand; PAM type: NRG; PAM sequence: TGG
ccttgttttgaaaagattta

SEQ ID NO: 80563 - DNA, 20 bp, Artificial Sequence
  Description of Artificial Sequence: Synthetic oligonucleotide
  Target: ATXN1; (-) strand; PAM type: NRG; PAM sequence: AAG
ataatcttccttgttttgaa

SEQ ID NO: 80564 - DNA, 20 bp, Artificial Sequence
  Description of Artificial Sequence: Synthetic oligonucleotide
  Target: ATXN1; (-) strand; PAM type: NRG; PAM sequence: GGG
ttttttctaggcttgtcaat

SEQ ID NO: 80565 - DNA, 20 bp, Artificial Sequence
  Description of Artificial Sequence: Synthetic oligonucleotide
  Target: ATXN1; (-) strand; PAM type: NRG; PAM sequence: TGG
tttttttctaggcttgtcaa

SEQ ID NO: 80566 - DNA, 20 bp, Artificial Sequence
  Description of Artificial Sequence: Synthetic oligonucleotide
  Target: ATXN1; (-) strand; PAM type: NRG; PAM sequence: AGG
attgggtggcatttttttct

SEQ ID NO: 80567 - DNA, 20 bp, Artificial Sequence
  Description of Artificial Sequence: Synthetic oligonucleotide
  Target: ATXN1; (-) strand; PAM type: NRG; PAM sequence: TAG
cattgggtggcatttttttc

SEQ ID NO: 80568 - DNA, 20 bp, Artificial Sequence
  Description of Artificial Sequence: Synthetic oligonucleotide
  Target: ATXN1; (-) strand; PAM type: NRG; PAM sequence: TGG
ctgataaaacaaacattggg

SEQ ID NO: 80569 - DNA, 20 bp, Artificial Sequence
  Description of Artificial Sequence: Synthetic oligonucleotide
  Target: ATXN1; (-) strand; PAM type: NRG; PAM sequence: GGG
aaactgataaaacaaacatt

SEQ ID NO: 80570 - DNA, 20 bp, Artificial Sequence
  Description of Artificial Sequence: Synthetic oligonucleotide
  Target: ATXN1; (-) strand; PAM type: NRG; PAM sequence: TGG
aaaactgataaaacaaacat

SEQ ID NO: 80571 - DNA, 20 bp, Artificial Sequence
  Description of Artificial Sequence: Synthetic oligonucleotide
  Target: ATXN1; (-) strand; PAM type: NRG; PAM sequence: AAG
tttcccttccaaaactggaa

SEQ ID NO: 80572 - DNA, 20 bp, Artificial Sequence
  Description of Artificial Sequence: Synthetic oligonucleotide
  Target: ATXN1; (-) strand; PAM type: NRG; PAM sequence: TGG
agggctttcccttccaaaac

SEQ ID NO: 80573 - DNA, 20 bp, Artificial Sequence
  Description of Artificial Sequence: Synthetic oligonucleotide
  Target: ATXN1; (-) strand; PAM type: NRG; PAM sequence: GGG
tgtggtcatgtttgtttcaa

SEQ ID NO: 80574 - DNA, 20 bp, Artificial Sequence
  Description of Artificial Sequence: Synthetic oligonucleotide
  Target: ATXN1; (-) strand; PAM type: NRG; PAM sequence: AGG
gtgtggtcatgtttgtttca

SEQ ID NO: 80575 - DNA, 20 bp, Artificial Sequence
  Description of Artificial Sequence: Synthetic oligonucleotide
  Target: ATXN1; (-) strand; PAM type: NRG; PAM sequence: AAG
cgtgtggtcatgtttgtttc

SEQ ID NO: 80576 - DNA, 20 bp, Artificial Sequence
  Description of Artificial Sequence: Synthetic oligonucleotide
  Target: ATXN1; (-) strand; PAM type: NRG; PAM sequence: TGG
gaggactcatatgggtcgtg

SEQ ID NO: 80577 - DNA, 20 bp, Artificial Sequence
  Description of Artificial Sequence: Synthetic oligonucleotide
  Target: ATXN1; (-) strand; PAM type: NRG; PAM sequence: GGG
attacaatgaggactcatat

SEQ ID NO: 80578 - DNA, 20 bp, Artificial Sequence
  Description of Artificial Sequence: Synthetic oligonucleotide
  Target: ATXN1; (-) strand; PAM type: NRG; PAM sequence: TGG
cattacaatgaggactcata

SEQ ID NO: 80579 - DNA, 20 bp, Artificial Sequence
  Description of Artificial Sequence: Synthetic oligonucleotide
  Target: ATXN1; (-) strand; PAM type: NRG; PAM sequence: AGG
tggggaaaaacattacaatg

SEQ ID NO: 80580 - DNA, 20 bp, Artificial Sequence
  Description of Artificial Sequence: Synthetic oligonucleotide
  Target: ATXN1; (-) strand; PAM type: NRG; PAM sequence: GAG
ttggggaaaaacattacaat

SEQ ID NO: 80581 - DNA, 20 bp, Artificial Sequence
  Description of Artificial Sequence: Synthetic oligonucleotide
  Target: ATXN1; (-) strand; PAM type: NRG; PAM sequence: GGG
cctggaattgtgggtgcttg

SEQ ID NO: 80582 - DNA, 20 bp, Artificial Sequence
  Description of Artificial Sequence: Synthetic oligonucleotide
  Target: ATXN1; (-) strand; PAM type: NRG; PAM sequence: GGG
acctggaattgtgggtgctt

SEQ ID NO: 80583 - DNA, 20 bp, Artificial Sequence
  Description of Artificial Sequence: Synthetic oligonucleotide
  Target: ATXN1; (-) strand; PAM type: NRG; PAM sequence: TGG
gacctggaattgtgggtgct

SEQ ID NO: 80584 - DNA, 20 bp, Artificial Sequence
  Description of Artificial Sequence: Synthetic oligonucleotide
  Target: ATXN1; (-) strand; PAM type: NRG; PAM sequence: GGG
ttgggaggacctggaattgt

SEQ ID NO: 80585 - DNA, 20 bp, Artificial Sequence
  Description of Artificial Sequence: Synthetic oligonucleotide
  Target: ATXN1; (-) strand; PAM type: NRG; PAM sequence: TGG
attgggaggacctggaattg

SEQ ID NO: 80586 - DNA, 20 bp, Artificial Sequence
  Description of Artificial Sequence: Synthetic oligonucleotide
  Target: ATXN1; (-) strand; PAM type: NRG; PAM sequence: TGG
ggaagcaaattgggaggacc

SEQ ID NO: 80587 - DNA, 20 bp, Artificial Sequence
  Description of Artificial Sequence: Synthetic oligonucleotide
  Target: ATXN1; (-) strand; PAM type: NRG; PAM sequence: AGG
agaactggaagcaaattggg

SEQ ID NO: 80588 - DNA, 20 bp, Artificial Sequence
  Description of Artificial Sequence: Synthetic oligonucleotide
  Target: ATXN1; (-) strand; PAM type: NRG; PAM sequence: GAG
aagaactggaagcaaattgg

SEQ ID NO: 80589 - DNA, 20 bp, Artificial Sequence
  Description of Artificial Sequence: Synthetic oligonucleotide
  Target: ATXN1; (-) strand; PAM type: NRG; PAM sequence: GGG
gcaagaactggaagcaaatt

SEQ ID NO: 80590 - DNA, 20 bp, Artificial Sequence
  Description of Artificial Sequence: Synthetic oligonucleotide
  Target: ATXN1; (-) strand; PAM type: NRG; PAM sequence: TGG
ggcaagaactggaagcaaat

SEQ ID NO: 80591 - DNA, 20 bp, Artificial Sequence
  Description of Artificial Sequence: Synthetic oligonucleotide
  Target: ATXN1; (-) strand; PAM type: NRG; PAM sequence: AAG
taaacttgggcaagaactgg

SEQ ID NO: 80592 - DNA, 20 bp, Artificial Sequence
  Description of Artificial Sequence: Synthetic oligonucleotide
  Target: ATXN1; (-) strand; PAM type: NRG; PAM sequence: TGG
gtttaaacttgggcaagaac

SEQ ID NO: 80593 - DNA, 20 bp, Artificial Sequence
  Description of Artificial Sequence: Synthetic oligonucleotide
  Target: ATXN1; (-) strand; PAM type: NRG; PAM sequence: AAG
ttaagagtttaaacttgggc

SEQ ID NO: 80594 - DNA, 20 bp, Artificial Sequence
  Description of Artificial Sequence: Synthetic oligonucleotide
  Target: ATXN1; (-) strand; PAM type: NRG; PAM sequence: GGG
ttggttaagagtttaaactt

SEQ ID NO: 80595 - DNA, 20 bp, Artificial Sequence
  Description of Artificial Sequence: Synthetic oligonucleotide
  Target: ATXN1; (-) strand; PAM type: NRG; PAM sequence: TGG
attggttaagagtttaaact

SEQ ID NO: 80596 - DNA, 20 bp, Artificial Sequence
  Description of Artificial Sequence: Synthetic oligonucleotide
  Target: ATXN1; (-) strand; PAM type: NRG; PAM sequence: GAG
agatagtaggcattggttaa

SEQ ID NO: 80597 - DNA, 20 bp, Artificial Sequence
  Description of Artificial Sequence: Synthetic oligonucleotide
  Target: ATXN1; (-) strand; PAM type: NRG; PAM sequence: AAG
gcagatagtaggcattggtt

SEQ ID NO: 80598 - DNA, 20 bp, Artificial Sequence
  Description of Artificial Sequence: Synthetic oligonucleotide
  Target: ATXN1; (-) strand; PAM type: NRG; PAM sequence: TGG
aggctgcagatagtaggcat

SEQ ID NO: 80599 - DNA, 20 bp, Artificial Sequence
  Description of Artificial Sequence: Synthetic oligonucleotide
  Target: ATXN1; (-) strand; PAM type: NRG; PAM sequence: AGG
cctttgaggctgcagatagt

SEQ ID NO: 80600 - DNA, 20 bp, Artificial Sequence
  Description of Artificial Sequence: Synthetic oligonucleotide
  Target: ATXN1; (-) strand; PAM type: NRG; PAM sequence: TAG
ccctttgaggctgcagatag

SEQ ID NO: 80601 - DNA, 20 bp, Artificial Sequence
  Description of Artificial Sequence: Synthetic oligonucleotide
  Target: ATXN1; (-) strand; PAM type: NRG; PAM sequence: TAG
gctccctttgaggctgcaga

SEQ ID NO: 80602 - DNA, 20 bp, Artificial Sequence
  Description of Artificial Sequence: Synthetic oligonucleotide
  Target: ATXN1; (-) strand; PAM type: NRG; PAM sequence: CAG
ctcagctccctttgaggctg

SEQ ID NO: 80603 - DNA, 20 bp, Artificial Sequence
  Description of Artificial Sequence: Synthetic oligonucleotide
  Target: ATXN1; (-) strand; PAM type: NRG; PAM sequence: AGG
caagtactcagctccctttg

SEQ ID NO: 80604 - DNA, 20 bp, Artificial Sequence
  Description of Artificial Sequence: Synthetic oligonucleotide
  Target: ATXN1; (-) strand; PAM type: NRG; PAM sequence: GAG
gcaagtactcagctcccttt

SEQ ID NO: 80605 - DNA, 20 bp, Artificial Sequence
  Description of Artificial Sequence: Synthetic oligonucleotide
  Target: ATXN1; (-) strand; PAM type: NRG; PAM sequence: CAG
ggtgtctgttggcaagtact

SEQ ID NO: 80606 - DNA, 20 bp, Artificial Sequence
  Description of Artificial Sequence: Synthetic oligonucleotide
  Target: ATXN1; (-) strand; PAM type: NRG; PAM sequence: AAG
aggtggcggtgtctgttggc

SEQ ID NO: 80607 - DNA, 20 bp, Artificial Sequence
  Description of Artificial Sequence: Synthetic oligonucleotide
  Target: ATXN1; (-) strand; PAM type: NRG; PAM sequence: TGG
ggggaggtggcggtgtctgt

SEQ ID NO: 80608 - DNA, 20 bp, Artificial Sequence
  Description of Artificial Sequence: Synthetic oligonucleotide
  Target: ATXN1; (-) strand; PAM type: NRG; PAM sequence: CGG
acctcagggaggggaggtgg

SEQ ID NO: 80609 - DNA, 20 bp, Artificial Sequence
  Description of Artificial Sequence: Synthetic oligonucleotide
  Target: ATXN1; (-) strand; PAM type: NRG; PAM sequence: TGG
ggaacctcagggaggggagg

SEQ ID NO: 80610 - DNA, 20 bp, Artificial Sequence
  Description of Artificial Sequence: Synthetic oligonucleotide
  Target: ATXN1; (-) strand; PAM type: NRG; PAM sequence: AGG
gcaggaacctcagggagggg

SEQ ID NO: 80611 - DNA, 20 bp, Artificial Sequence
  Description of Artificial Sequence: Synthetic oligonucleotide
  Target: ATXN1; (-) strand; PAM type: NRG; PAM sequence: GAG
ggcaggaacctcagggaggg

SEQ ID NO: 80612 - DNA, 20 bp, Artificial Sequence
  Description of Artificial Sequence: Synthetic oligonucleotide
  Target: ATXN1; (-) strand; PAM type: NRG; PAM sequence: GGG
aaggcaggaacctcagggag

SEQ ID NO: 80613 - DNA, 20 bp, Artificial Sequence
  Description of Artificial Sequence: Synthetic oligonucleotide
  Target: ATXN1; (-) strand; PAM type: NRG; PAM sequence: GGG
caaggcaggaacctcaggga

SEQ ID NO: 80614 - DNA, 20 bp, Artificial Sequence
  Description of Artificial Sequence: Synthetic oligonucleotide
  Target: ATXN1; (-) strand; PAM type: NRG; PAM sequence: AGG
gcaaggcaggaacctcaggg

SEQ ID NO: 80615 - DNA, 20 bp, Artificial Sequence
  Description of Artificial Sequence: Synthetic oligonucleotide
  Target: ATXN1; (-) strand; PAM type: NRG; PAM sequence: GAG
cgcaaggcaggaacctcagg

SEQ ID NO: 80616 - DNA, 20 bp, Artificial Sequence
  Description of Artificial Sequence: Synthetic oligonucleotide
  Target: ATXN1; (-) strand; PAM type: NRG; PAM sequence: GGG
ctcgcaaggcaggaacctca

SEQ ID NO: 80617 - DNA, 20 bp, Artificial Sequence
  Description of Artificial Sequence: Synthetic oligonucleotide
  Target: ATXN1; (-) strand; PAM type: NRG; PAM sequence: AGG
tctcgcaaggcaggaacctc

SEQ ID NO: 80618 - DNA, 20 bp, Artificial Sequence
  Description of Artificial Sequence: Synthetic oligonucleotide
  Target: ATXN1; (-) strand; PAM type: NRG; PAM sequence: CAG
ctctcgcaaggcaggaacct

SEQ ID NO: 80619 - DNA, 20 bp, Artificial Sequence
  Description of Artificial Sequence: Synthetic oligonucleotide
  Target: ATXN1; (-) strand; PAM type: NRG; PAM sequence: AGG
atgacacactctcgcaaggc

SEQ ID NO: 80620 - DNA, 20 bp, Artificial Sequence
  Description of Artificial Sequence: Synthetic oligonucleotide
  Target: ATXN1; (-) strand; PAM type: NRG; PAM sequence: CAG
catgacacactctcgcaagg

SEQ ID NO: 80621 - DNA, 20 bp, Artificial Sequence
  Description of Artificial Sequence: Synthetic oligonucleotide
  Target: ATXN1; (-) strand; PAM type: NRG; PAM sequence: AGG
ccacatgacacactctcgca

SEQ ID NO: 80622 - DNA, 20 bp, Artificial Sequence
  Description of Artificial Sequence: Synthetic oligonucleotide
  Target: ATXN1; (-) strand; PAM type: NRG; PAM sequence: AAG
gccacatgacacactctcgc

SEQ ID NO: 80623 - DNA, 20 bp, Artificial Sequence
  Description of Artificial Sequence: Synthetic oligonucleotide
  Target: ATXN1; (-) strand; PAM type: NRG; PAM sequence: CAG
acacttctgccttgccctgg

SEQ ID NO: 80624 - DNA, 20 bp, Artificial Sequence
  Description of Artificial Sequence: Synthetic oligonucleotide
  Target: ATXN1; (-) strand; PAM type: NRG; PAM sequence: TGG
cctacacttctgccttgccc

SEQ ID NO: 80625 - DNA, 20 bp, Artificial Sequence
  Description of Artificial Sequence: Synthetic oligonucleotide
  Target: ATXN1; (-) strand; PAM type: NRG; PAM sequence: GAG
aatcctcctggacaacctgt

SEQ ID NO: 80626 - DNA, 20 bp, Artificial Sequence
  Description of Artificial Sequence: Synthetic oligonucleotide
  Target: ATXN1; (-) strand; PAM type: NRG; PAM sequence: TGG
catatttgctctaatcctcc

SEQ ID NO: 80627 - DNA, 20 bp, Artificial Sequence
  Description of Artificial Sequence: Synthetic oligonucleotide
  Target: ATXN1; (-) strand; PAM type: NRG; PAM sequence: TGG
tagtcaacttgaaactgctc

SEQ ID NO: 80628 - DNA, 20 bp, Artificial Sequence
  Description of Artificial Sequence: Synthetic oligonucleotide
  Target: ATXN1; (-) strand; PAM type: NRG; PAM sequence: TAG
agctcggagccttggttcta

SEQ ID NO: 80629 - DNA, 20 bp, Artificial Sequence
  Description of Artificial Sequence: Synthetic oligonucleotide
  Target: ATXN1; (-) strand; PAM type: NRG; PAM sequence: TGG
tattaattagctcggagcct

SEQ ID NO: 80630 - DNA, 20 bp, Artificial Sequence
  Description of Artificial Sequence: Synthetic oligonucleotide
  Target: ATXN1; (-) strand; PAM type: NRG; PAM sequence: GAG
actttctattaattagctcg

SEQ ID NO: 80631 - DNA, 20 bp, Artificial Sequence
  Description of Artificial Sequence: Synthetic oligonucleotide
  Target: ATXN1; (-) strand; PAM type: NRG; PAM sequence: CGG
tcactttctattaattagct

SEQ ID NO: 80632 - DNA, 20 bp, Artificial Sequence
  Description of Artificial Sequence: Synthetic oligonucleotide
  Target: ATXN1; (-) strand; PAM type: NRG; PAM sequence: TAG
ttgcttcactttctattaat

SEQ ID NO: 80633 - DNA, 20 bp, Artificial Sequence
  Description of Artificial Sequence: Synthetic oligonucleotide
  Target: ATXN1; (-) strand; PAM type: NRG; PAM sequence: GAG
gagcttcacacccttgcctt

SEQ ID NO: 80634 - DNA, 20 bp, Artificial Sequence
  Description of Artificial Sequence: Synthetic oligonucleotide
  Target: ATXN1; (-) strand; PAM type: NRG; PAM sequence: GAG
ctgtctttaccgaatgacat

SEQ ID NO: 80635 - DNA, 20 bp, Artificial Sequence
  Description of Artificial Sequence: Synthetic oligonucleotide
  Target: ATXN1; (-) strand; PAM type: NRG; PAM sequence: TGG
gcgtaaatgtcctttttcct

SEQ ID NO: 80636 - DNA, 20 bp, Artificial Sequence
  Description of Artificial Sequence: Synthetic oligonucleotide
  Target: ATXN1; (-) strand; PAM type: NRG; PAM sequence: AAG
ctgcaaagcaaataaggtgc

SEQ ID NO: 80637 - DNA, 20 bp, Artificial Sequence
  Description of Artificial Sequence: Synthetic oligonucleotide
  Target: ATXN1; (-) strand; PAM type: NRG; PAM sequence: AGG
gttagtctgcaaagcaaata

SEQ ID NO: 80638 - DNA, 20 bp, Artificial Sequence
  Description of Artificial Sequence: Synthetic oligonucleotide
  Target: ATXN1; (-) strand; PAM type: NRG; PAM sequence: AAG
tgttagtctgcaaagcaaat

SEQ ID NO: 80639 - DNA, 20 bp, Artificial Sequence
  Description of Artificial Sequence: Synthetic oligonucleotide
  Target: ATXN1; (-) strand; PAM type: NRG; PAM sequence: AAG
cagaaatgtgttagtctgca

SEQ ID NO: 80640 - DNA, 20 bp, Artificial Sequence
  Description of Artificial Sequence: Synthetic oligonucleotide
  Target: ATXN1; (-) strand; PAM type: NRG; PAM sequence: TAG
tatttctaacagaaatgtgt

SEQ ID NO: 80641 - DNA, 20 bp, Artificial Sequence
  Description of Artificial Sequence: Synthetic oligonucleotide
  Target: ATXN1; (-) strand; PAM type: NRG; PAM sequence: CAG
gtgtaaagacatatttctaa

SEQ ID NO: 80642 - DNA, 20 bp, Artificial Sequence
  Description of Artificial Sequence: Synthetic oligonucleotide
  Target: ATXN1; (-) strand; PAM type: NRG; PAM sequence: AAG
taacatctctctggagtgta

SEQ ID NO: 80643 - DNA, 20 bp, Artificial Sequence
  Description of Artificial Sequence: Synthetic oligonucleotide
  Target: ATXN1; (-) strand; PAM type: NRG; PAM sequence: GAG
caccttgtaacatctctctg

SEQ ID NO: 80644 - DNA, 20 bp, Artificial Sequence
  Description of Artificial Sequence: Synthetic oligonucleotide
  Target: ATXN1; (-) strand; PAM type: NRG; PAM sequence: TGG
gacaccttgtaacatctctc

SEQ ID NO: 80645 - DNA, 20 bp, Artificial Sequence
  Description of Artificial Sequence: Synthetic oligonucleotide
  Target: ATXN1; (-) strand; PAM type: NRG; PAM sequence: AGG
ggcttgctgtaattagtagc

SEQ ID NO: 80646 - DNA, 20 bp, Artificial Sequence
  Description of Artificial Sequence: Synthetic oligonucleotide
  Target: ATXN1; (-) strand; PAM type: NRG; PAM sequence: CAG
gggcttgctgtaattagtag

SEQ ID NO: 80647 - DNA, 20 bp, Artificial Sequence
  Description of Artificial Sequence: Synthetic oligonucleotide
  Target: ATXN1; (-) strand; PAM type: NRG; PAM sequence: TAG
tgcgggcttgctgtaattag

SEQ ID NO: 80648 - DNA, 20 bp, Artificial Sequence
  Description of Artificial Sequence: Synthetic oligonucleotide
  Target: ATXN1; (-) strand; PAM type: NRG; PAM sequence: TAG
tagtgcgggcttgctgtaat

SEQ ID NO: 80649 - DNA, 20 bp, Artificial Sequence
  Description of Artificial Sequence: Synthetic oligonucleotide
  Target: ATXN1; (-) strand; PAM type: NRG; PAM sequence: GGG
tatattgttagctgtagtgc

SEQ ID NO: 80650 - DNA, 20 bp, Artificial Sequence
  Description of Artificial Sequence: Synthetic oligonucleotide
  Target: ATXN1; (-) strand; PAM type: NRG; PAM sequence: CGG
ttatattgttagctgtagtg

SEQ ID NO: 80651 - DNA, 20 bp, Artificial Sequence
  Description of Artificial Sequence: Synthetic oligonucleotide
  Target: ATXN1; (-) strand; PAM type: NRG; PAM sequence: TAG
tagagttatattgttagctg

SEQ ID NO: 80652 - DNA, 20 bp, Artificial Sequence
  Description of Artificial Sequence: Synthetic oligonucleotide
  Target: ATXN1; (-) strand; PAM type: NRG; PAM sequence: TAG
tgaatttagagttatattgt

SEQ ID NO: 80653 - DNA, 20 bp, Artificial Sequence
  Description of Artificial Sequence: Synthetic oligonucleotide
  Target: ATXN1; (-) strand; PAM type: NRG; PAM sequence: GAG
atcagaagcaagtgaattta

SEQ ID NO: 80654 - DNA, 20 bp, Artificial Sequence
  Description of Artificial Sequence: Synthetic oligonucleotide
  Target: ATXN1; (-) strand; PAM type: NRG; PAM sequence: TAG
taatcagaagcaagtgaatt

SEQ ID NO: 80655 - DNA, 20 bp, Artificial Sequence
  Description of Artificial Sequence: Synthetic oligonucleotide
  Target: ATXN1; (-) strand; PAM type: NRG; PAM sequence: AAG
acaggtaggtaatcagaagc

SEQ ID NO: 80656 - DNA, 20 bp, Artificial Sequence
  Description of Artificial Sequence: Synthetic oligonucleotide
  Target: ATXN1; (-) strand; PAM type: NRG; PAM sequence: AAG
tatgacaggtaggtaatcag

SEQ ID NO: 80657 - DNA, 20 bp, Artificial Sequence
  Description of Artificial Sequence: Synthetic oligonucleotide
  Target: ATXN1; (-) strand; PAM type: NRG; PAM sequence: CAG
tcatatgacaggtaggtaat

SEQ ID NO: 80658 - DNA, 20 bp, Artificial Sequence
  Description of Artificial Sequence: Synthetic oligonucleotide
  Target: ATXN1; (-) strand; PAM type: NRG; PAM sequence: AGG
tagcctttcatatgacaggt

SEQ ID NO: 80659 - DNA, 20 bp, Artificial Sequence
  Description of Artificial Sequence: Synthetic oligonucleotide
  Target: ATXN1; (-) strand; PAM type: NRG; PAM sequence: TAG
atagcctttcatatgacagg

SEQ ID NO: 80660 - DNA, 20 bp, Artificial Sequence
  Description of Artificial Sequence: Synthetic oligonucleotide
  Target: ATXN1; (-) strand; PAM type: NRG; PAM sequence: AGG
agaatagcctttcatatgac

SEQ ID NO: 80661 - DNA, 20 bp, Artificial Sequence
  Description of Artificial Sequence: Synthetic oligonucleotide
  Target: ATXN1; (-) strand; PAM type: NRG; PAM sequence: CAG
aagaatagcctttcatatga

SEQ ID NO: 80662 - DNA, 20 bp, Artificial Sequence
  Description of Artificial Sequence: Synthetic oligonucleotide
  Target: ATXN1; (-) strand; PAM type: NRG; PAM sequence: TAG
tgttcaactggagtgaagaa

SEQ ID NO: 80663 - DNA, 20 bp, Artificial Sequence
  Description of Artificial Sequence: Synthetic oligonucleotide
  Target: ATXN1; (-) strand; PAM type: NRG; PAM sequence: AAG
aggtttgttcaactggagtg

SEQ ID NO: 80664 - DNA, 20 bp, Artificial Sequence
  Description of Artificial Sequence: Synthetic oligonucleotide
  Target: ATXN1; (-) strand; PAM type: NRG; PAM sequence: GAG
ctaataggtttgttcaactg

SEQ ID NO: 80665 - DNA, 20 bp, Artificial Sequence
  Description of Artificial Sequence: Synthetic oligonucleotide
  Target: ATXN1; (-) strand; PAM type: NRG; PAM sequence: TGG
atctaataggtttgttcaac

SEQ ID NO: 80666 - DNA, 20 bp, Artificial Sequence
  Description of Artificial Sequence: Synthetic oligonucleotide
  Target: ATXN1; (-) strand; PAM type: NRG; PAM sequence: AGG
caagaaaccagacatctaat

SEQ ID NO: 80667 - DNA, 20 bp, Artificial Sequence
  Description of Artificial Sequence: Synthetic oligonucleotide
  Target: ATXN1; (-) strand; PAM type: NRG; PAM sequence: TAG
tcaagaaaccagacatctaa

SEQ ID NO: 80668 - DNA, 20 bp, Artificial Sequence
  Description of Artificial Sequence: Synthetic oligonucleotide
  Target: ATXN1; (-) strand; PAM type: NRG; PAM sequence: CAG
agagttaaacatcaagaaac

SEQ ID NO: 80669 - DNA, 20 bp, Artificial Sequence
  Description of Artificial Sequence: Synthetic oligonucleotide
  Target: ATXN1; (-) strand; PAM type: NRG; PAM sequence: AAG
gcttgtgagagttaaacatc

SEQ ID NO: 80670 - DNA, 20 bp, Artificial Sequence
  Description of Artificial Sequence: Synthetic oligonucleotide
  Target: ATXN1; (-) strand; PAM type: NRG; PAM sequence: GAG
ctggagataattgcttgtga

SEQ ID NO: 80671 - DNA, 20 bp, Artificial Sequence
  Description of Artificial Sequence: Synthetic oligonucleotide
  Target: ATXN1; (-) strand; PAM type: NRG; PAM sequence: GAG
agctggagataattgcttgt

SEQ ID NO: 80672 - DNA, 20 bp, Artificial Sequence
  Description of Artificial Sequence: Synthetic oligonucleotide
  Target: ATXN1; (-) strand; PAM type: NRG; PAM sequence: GAG
caaaagggcatttcaagctg

SEQ ID NO: 80673 - DNA, 20 bp, Artificial Sequence
  Description of Artificial Sequence: Synthetic oligonucleotide
  Target: ATXN1; (-) strand; PAM type: NRG; PAM sequence: TGG
gacaaaagggcatttcaagc

SEQ ID NO: 80674 - DNA, 20 bp, Artificial Sequence
  Description of Artificial Sequence: Synthetic oligonucleotide
  Target: ATXN1; (-) strand; PAM type: NRG; PAM sequence: AAG
agaagacaaaagggcatttc

SEQ ID NO: 80675 - DNA, 20 bp, Artificial Sequence
  Description of Artificial Sequence: Synthetic oligonucleotide
  Target: ATXN1; (-) strand; PAM type: NRG; PAM sequence: GGG
attgtataaagaagacaaaa

SEQ ID NO: 80676 - DNA, 20 bp, Artificial Sequence
  Description of Artificial Sequence: Synthetic oligonucleotide
  Target: ATXN1; (-) strand; PAM type: NRG; PAM sequence: AGG
gattgtataaagaagacaaa

SEQ ID NO: 80677 - DNA, 20 bp, Artificial Sequence
  Description of Artificial Sequence: Synthetic oligonucleotide
  Target: ATXN1; (-) strand; PAM type: NRG; PAM sequence: AAG
tgattgtataaagaagacaa

SEQ ID NO: 80678 - DNA, 20 bp, Artificial Sequence
  Description of Artificial Sequence: Synthetic oligonucleotide
  Target: ATXN1; (-) strand; PAM type: NRG; PAM sequence: AAG
agagtagtgattgtataaag

SEQ ID NO: 80679 - DNA, 20 bp, Artificial Sequence
  Description of Artificial Sequence: Synthetic oligonucleotide
  Target: ATXN1; (-) strand; PAM type: NRG; PAM sequence: AAG
gaaagagtagtgattgtata

SEQ ID NO: 80680 - DNA, 20 bp, Artificial Sequence
  Description of Artificial Sequence: Synthetic oligonucleotide
  Target: ATXN1; (-) strand; PAM type: NRG; PAM sequence: TAG
tgttttctaagaagaaagag

SEQ ID NO: 80681 - DNA, 20 bp, Artificial Sequence
  Description of Artificial Sequence: Synthetic oligonucleotide
  Target: ATXN1; (-) strand; PAM type: NRG; PAM sequence: GAG
ctgtgttttctaagaagaaa

SEQ ID NO: 80682 - DNA, 20 bp, Artificial Sequence
  Description of Artificial Sequence: Synthetic oligonucleotide
  Target: ATXN1; (-) strand; PAM type: NRG; PAM sequence: AAG
aactgtgttttctaagaaga

SEQ ID NO: 80683 - DNA, 20 bp, Artificial Sequence
  Description of Artificial Sequence: Synthetic oligonucleotide
  Target: ATXN1; (-) strand; PAM type: NRG; PAM sequence: AAG
tttaaactgtgttttctaag

SEQ ID NO: 80684 - DNA, 20 bp, Artificial Sequence
  Description of Artificial Sequence: Synthetic oligonucleotide
  Target: ATXN1; (-) strand; PAM type: NRG; PAM sequence: AAG
tggtttaaactgtgttttct

SEQ ID NO: 80685 - DNA, 20 bp, Artificial Sequence
  Description of Artificial Sequence: Synthetic oligonucleotide
  Target: ATXN1; (-) strand; PAM type: NRG; PAM sequence: TGG
agatggattaagggaggaag

SEQ ID NO: 80686 - DNA, 20 bp, Artificial Sequence
  Description of Artificial Sequence: Synthetic oligonucleotide
  Target: ATXN1; (-) strand; PAM type: NRG; PAM sequence: AAG
tttagatggattaagggagg

SEQ ID NO: 80687 - DNA, 20 bp, Artificial Sequence
  Description of Artificial Sequence: Synthetic oligonucleotide
  Target: ATXN1; (-) strand; PAM type: NRG; PAM sequence: AGG
tagtttagatggattaaggg

SEQ ID NO: 80688 - DNA, 20 bp, Artificial Sequence
  Description of Artificial Sequence: Synthetic oligonucleotide
  Target: ATXN1; (-) strand; PAM type: NRG; PAM sequence: GAG
ttagtttagatggattaagg

SEQ ID NO: 80689 - DNA, 20 bp, Artificial Sequence
  Description of Artificial Sequence: Synthetic oligonucleotide
  Target: ATXN1; (-) strand; PAM type: NRG; PAM sequence: GGG
ggttagtttagatggattaa

SEQ ID NO: 80690 - DNA, 20 bp, Artificial Sequence
  Description of Artificial Sequence: Synthetic oligonucleotide
  Target: ATXN1; (-) strand; PAM type: NRG; PAM sequence: AGG
gggttagtttagatggatta

SEQ ID NO: 80691 - DNA, 20 bp, Artificial Sequence
  Description of Artificial Sequence: Synthetic oligonucleotide
  Target: ATXN1; (-) strand; PAM type: NRG; PAM sequence: AAG
ggggttagtttagatggatt

SEQ ID NO: 80692 - DNA, 20 bp, Artificial Sequence
  Description of Artificial Sequence: Synthetic oligonucleotide
  Target: ATXN1; (-) strand; PAM type: NRG; PAM sequence: TGG
ctagatggggttagtttaga

SEQ ID NO: 80693 - DNA, 20 bp, Artificial Sequence
  Description of Artificial Sequence: Synthetic oligonucleotide
  Target: ATXN1; (-) strand; PAM type: NRG; PAM sequence: TAG
agaactagatggggttagtt

SEQ ID NO: 80694 - DNA, 20 bp, Artificial Sequence
  Description of Artificial Sequence: Synthetic oligonucleotide
  Target: ATXN1; (-) strand; PAM type: NRG; PAM sequence: TAG
atgccagaactagatggggt

SEQ ID NO: 80695 - DNA, 20 bp, Artificial Sequence
  Description of Artificial Sequence: Synthetic oligonucleotide
  Target: ATXN1; (-) strand; PAM type: NRG; PAM sequence: GGG
atggatgccagaactagatg

SEQ ID NO: 80696 - DNA, 20 bp, Artificial Sequence
  Description of Artificial Sequence: Synthetic oligonucleotide
  Target: ATXN1; (-) strand; PAM type: NRG; PAM sequence: GGG
catggatgccagaactagat

SEQ ID NO: 80697 - DNA, 20 bp, Artificial Sequence
  Description of Artificial Sequence: Synthetic oligonucleotide
  Target: ATXN1; (-) strand; PAM type: NRG; PAM sequence: TGG
gcatggatgccagaactaga

SEQ ID NO: 80698 - DNA, 20 bp, Artificial Sequence
  Description of Artificial Sequence: Synthetic oligonucleotide
  Target: ATXN1; (-) strand; PAM type: NRG; PAM sequence: TAG
gattgcatggatgccagaac

SEQ ID NO: 80699 - DNA, 20 bp, Artificial Sequence
  Description of Artificial Sequence: Synthetic oligonucleotide
  Target: ATXN1; (-) strand; PAM type: NRG; PAM sequence: CAG
tctattgattgcatggatgc

SEQ ID NO: 80700 - DNA, 20 bp, Artificial Sequence
  Description of Artificial Sequence: Synthetic oligonucleotide
  Target: ATXN1; (-) strand; PAM type: NRG; PAM sequence: TGG
tgctaaatctattgattgca

SEQ ID NO: 80701 - DNA, 20 bp, Artificial Sequence
  Description of Artificial Sequence: Synthetic oligonucleotide
  Target: ATXN1; (-) strand; PAM type: NRG; PAM sequence: AAG
aatccatggtagtgcttgct

SEQ ID NO: 80702 - DNA, 20 bp, Artificial Sequence
  Description of Artificial Sequence: Synthetic oligonucleotide
  Target: ATXN1; (-) strand; PAM type: NRG; PAM sequence: TAG
cattacagagaaatccatgg

SEQ ID NO: 80703 - DNA, 20 bp, Artificial Sequence
  Description of Artificial Sequence: Synthetic oligonucleotide
  Target: ATXN1; (-) strand; PAM type: NRG; PAM sequence: TGG
tttcattacagagaaatcca

SEQ ID NO: 80704 - DNA, 20 bp, Artificial Sequence
  Description of Artificial Sequence: Synthetic oligonucleotide
  Target: ATXN1; (-) strand; PAM type: NRG; PAM sequence: GAG
ggattaactttttcattaca

SEQ ID NO: 80705 - DNA, 20 bp, Artificial Sequence
  Description of Artificial Sequence: Synthetic oligonucleotide
  Target: ATXN1; (-) strand; PAM type: NRG; PAM sequence: CAG
taggattaactttttcatta

SEQ ID NO: 80706 - DNA, 20 bp, Artificial Sequence
  Description of Artificial Sequence: Synthetic oligonucleotide
  Target: ATXN1; (-) strand; PAM type: NRG; PAM sequence: AGG
attacatataaggcatatgt

SEQ ID NO: 80707 - DNA, 20 bp, Artificial Sequence
  Description of Artificial Sequence: Synthetic oligonucleotide
  Target: ATXN1; (-) strand; PAM type: NRG; PAM sequence: TAG
gattacatataaggcatatg

SEQ ID NO: 80708 - DNA, 20 bp, Artificial Sequence
  Description of Artificial Sequence: Synthetic oligonucleotide
  Target: ATXN1; (-) strand; PAM type: NRG; PAM sequence: AGG
cctgctcaagattacatata

SEQ ID NO: 80709 - DNA, 20 bp, Artificial Sequence
  Description of Artificial Sequence: Synthetic oligonucleotide
  Target: ATXN1; (-) strand; PAM type: NRG; PAM sequence: AAG
acctgctcaagattacatat

SEQ ID NO: 80710 - DNA, 20 bp, Artificial Sequence
  Description of Artificial Sequence: Synthetic oligonucleotide
  Target: ATXN1; (-) strand; PAM type: NRG; PAM sequence: AAG
gaaaagaggagaacctgctc

SEQ ID NO: 80711 - DNA, 20 bp, Artificial Sequence
  Description of Artificial Sequence: Synthetic oligonucleotide
  Target: ATXN1; (-) strand; PAM type: NRG; PAM sequence: GAG
aaccgaggcccagaaaagag

SEQ ID NO: 80712 - DNA, 20 bp, Artificial Sequence
  Description of Artificial Sequence: Synthetic oligonucleotide
  Target: ATXN1; (-) strand; PAM type: NRG; PAM sequence: AGG
aaaaccgaggcccagaaaag

SEQ ID NO: 80713 - DNA, 20 bp, Artificial Sequence
  Description of Artificial Sequence: Synthetic oligonucleotide
  Target: ATXN1; (-) strand; PAM type: NRG; PAM sequence: GAG
gaaaaccgaggcccagaaaa

SEQ ID NO: 80714 - DNA, 20 bp, Artificial Sequence
  Description of Artificial Sequence: Synthetic oligonucleotide
  Target: ATXN1; (-) strand; PAM type: NRG; PAM sequence: AAG
gagaaaaccgaggcccagaa

SEQ ID NO: 80715 - DNA, 20 bp, Artificial Sequence
  Description of Artificial Sequence: Synthetic oligonucleotide
  Target: ATXN1; (-) strand; PAM type: NRG; PAM sequence: CAG
cagatgagaaaaccgaggcc

SEQ ID NO: 80716 - DNA, 20 bp, Artificial Sequence
  Description of Artificial Sequence: Synthetic oligonucleotide
  Target: ATXN1; (-) strand; PAM type: NRG; PAM sequence: AGG
tcctacagatgagaaaaccg

SEQ ID NO: 80717 - DNA, 20 bp, Artificial Sequence
  Description of Artificial Sequence: Synthetic oligonucleotide
  Target: ATXN1; (-) strand; PAM type: NRG; PAM sequence: GAG
ctcctacagatgagaaaacc

SEQ ID NO: 80718 - DNA, 20 bp, Artificial Sequence
  Description of Artificial Sequence: Synthetic oligonucleotide
  Target: ATXN1; (-) strand; PAM type: NRG; PAM sequence: GAG
agtattatcctcctacagat

SEQ ID NO: 80719 - DNA, 20 bp, Artificial Sequence
  Description of Artificial Sequence: Synthetic oligonucleotide
  Target: ATXN1; (-) strand; PAM type: NRG; PAM sequence: CAG
tagggagtattatcctccta

SEQ ID NO: 80720 - DNA, 20 bp, Artificial Sequence
  Description of Artificial Sequence: Synthetic oligonucleotide
  Target: ATXN1; (-) strand; PAM type: NRG; PAM sequence: GAG
aaacaaccctatgaggtagg

SEQ ID NO: 80721 - DNA, 20 bp, Artificial Sequence
  Description of Artificial Sequence: Synthetic oligonucleotide
  Target: ATXN1; (-) strand; PAM type: NRG; PAM sequence: GGG
agaaacaaccctatgaggta

SEQ ID NO: 80722 - DNA, 20 bp, Artificial Sequence
  Description of Artificial Sequence: Synthetic oligonucleotide
  Target: ATXN1; (-) strand; PAM type: NRG; PAM sequence: AGG
cagaaacaaccctatgaggt

SEQ ID NO: 80723 - DNA, 20 bp, Artificial Sequence
  Description of Artificial Sequence: Synthetic oligonucleotide
  Target: ATXN1; (-) strand; PAM type: NRG; PAM sequence: TAG
tcagaaacaaccctatgagg

SEQ ID NO: 80724 - DNA, 20 bp, Artificial Sequence
  Description of Artificial Sequence: Synthetic oligonucleotide
  Target: ATXN1; (-) strand; PAM type: NRG; PAM sequence: AGG
ttctcagaaacaaccctatg

SEQ ID NO: 80725 - DNA, 20 bp, Artificial Sequence
  Description of Artificial Sequence: Synthetic oligonucleotide
  Target: ATXN1; (-) strand; PAM type: NRG; PAM sequence: GAG
attctcagaaacaaccctat

SEQ ID NO: 80726 - DNA, 20 bp, Artificial Sequence
  Description of Artificial Sequence: Synthetic oligonucleotide
  Target: ATXN1; (-) strand; PAM type: NRG; PAM sequence: CAG
aaaaataaatgtttaattct

SEQ ID NO: 80727 - DNA, 20 bp, Artificial Sequence
  Description of Artificial Sequence: Synthetic oligonucleotide
  Target: ATXN1; (-) strand; PAM type: NRG; PAM sequence: AAG
atgtaaattaaatcttaata

SEQ ID NO: 80728 - DNA, 20 bp, Artificial Sequence
  Description of Artificial Sequence: Synthetic oligonucleotide
  Target: ATXN1; (-) strand; PAM type: NRG; PAM sequence: GAG
aacatttgagttatacactt

SEQ ID NO: 80729 - DNA, 20 bp, Artificial Sequence
  Description of Artificial Sequence: Synthetic oligonucleotide
  Target: ATXN1; (-) strand; PAM type: NRG; PAM sequence: GAG
gactatactaaaaaacattt

SEQ ID NO: 80730 - DNA, 20 bp, Artificial Sequence
  Description of Artificial Sequence: Synthetic oligonucleotide
  Target: ATXN1; (-) strand; PAM type: NRG; PAM sequence: CAG
gtgatgttggttttacaaaa

SEQ ID NO: 80731 - DNA, 20 bp, Artificial Sequence
  Description of Artificial Sequence: Synthetic oligonucleotide
  Target: ATXN1; (-) strand; PAM type: NRG; PAM sequence: TGG
ctaaaattagattgtgatgt

SEQ ID NO: 80732 - DNA, 20 bp, Artificial Sequence
  Description of Artificial Sequence: Synthetic oligonucleotide
  Target: ATXN1; (-) strand; PAM type: NRG; PAM sequence: TAG
tggagaagaaaatctaaaat

SEQ ID NO: 80733 - DNA, 20 bp, Artificial Sequence
  Description of Artificial Sequence: Synthetic oligonucleotide
  Target: ATXN1; (-) strand; PAM type: NRG; PAM sequence: AAG
acagggtttcttttttggag

SEQ ID NO: 80734 - DNA, 20 bp, Artificial Sequence
  Description of Artificial Sequence: Synthetic oligonucleotide
  Target: ATXN1; (-) strand; PAM type: NRG; PAM sequence: GAG
tacacagggtttcttttttg

SEQ ID NO: 80735 - DNA, 20 bp, Artificial Sequence
  Description of Artificial Sequence: Synthetic oligonucleotide
  Target: ATXN1; (-) strand; PAM type: NRG; PAM sequence: TGG
tgtacacagggtttcttttt

SEQ ID NO: 80736 - DNA, 20 bp, Artificial Sequence
  Description of Artificial Sequence: Synthetic oligonucleotide
  Target: ATXN1; (-) strand; PAM type: NRG; PAM sequence: GGG
agtgactgctaatgtacaca

SEQ ID NO: 80737 - DNA, 20 bp, Artificial Sequence
  Description of Artificial Sequence: Synthetic oligonucleotide
  Target: ATXN1; (-) strand; PAM type: NRG; PAM sequence: AGG
gagtgactgctaatgtacac

SEQ ID NO: 80738 - DNA, 20 bp, Artificial Sequence
  Description of Artificial Sequence: Synthetic oligonucleotide
  Target: ATXN1; (-) strand; PAM type: NRG; PAM sequence: CAG
agagtgactgctaatgtaca

SEQ ID NO: 80739 - DNA, 20 bp, Artificial Sequence
  Description of Artificial Sequence: Synthetic oligonucleotide
  Target: ATXN1; (-) strand; PAM type: NRG; PAM sequence: GAG
ggaggtgggagaggaatgca

SEQ ID NO: 80740 - DNA, 20 bp, Artificial Sequence
  Description of Artificial Sequence: Synthetic oligonucleotide
  Target: ATXN1; (-) strand; PAM type: NRG; PAM sequence: CAG
ccggaggtgggagaggaatg

SEQ ID NO: 80741 - DNA, 20 bp, Artificial Sequence
  Description of Artificial Sequence: Synthetic oligonucleotide
  Target: ATXN1; (-) strand; PAM type: NRG; PAM sequence: AGG
gcagaggccggaggtgggag

SEQ ID NO: 80742 - DNA, 20 bp, Artificial Sequence
  Description of Artificial Sequence: Synthetic oligonucleotide
  Target: ATXN1; (-) strand; PAM type: NRG; PAM sequence: GAG
tgcagaggccggaggtggga

SEQ ID NO: 80743 - DNA, 20 bp, Artificial Sequence
  Description of Artificial Sequence: Synthetic oligonucleotide
  Target: ATXN1; (-) strand; PAM type: NRG; PAM sequence: GAG
gttgcagaggccggaggtgg

SEQ ID NO: 80744 - DNA, 20 bp, Artificial Sequence
  Description of Artificial Sequence: Synthetic oligonucleotide
  Target: ATXN1; (-) strand; PAM type: NRG; PAM sequence: GGG
gggttgcagaggccggaggt

SEQ ID NO: 80745 - DNA, 20 bp, Artificial Sequence
  Description of Artificial Sequence: Synthetic oligonucleotide
  Target: ATXN1; (-) strand; PAM type: NRG; PAM sequence: TGG
ggggttgcagaggccggagg

SEQ ID NO: 80746 - DNA, 20 bp, Artificial Sequence
  Description of Artificial Sequence: Synthetic oligonucleotide
  Target: ATXN1; (-) strand; PAM type: NRG; PAM sequence: AGG
ttgggggttgcagaggccgg

SEQ ID NO: 80747 - DNA, 20 bp, Artificial Sequence
  Description of Artificial Sequence: Synthetic oligonucleotide
  Target: ATXN1; (-) strand; PAM type: NRG; PAM sequence: GAG
tttgggggttgcagaggccg

SEQ ID NO: 80748 - DNA, 20 bp, Artificial Sequence
  Description of Artificial Sequence: Synthetic oligonucleotide
  Target: ATXN1; (-) strand; PAM type: NRG; PAM sequence: CGG
agtttgggggttgcagaggc

SEQ ID NO: 80749 - DNA, 20 bp, Artificial Sequence
  Description of Artificial Sequence: Synthetic oligonucleotide
  Target: ATXN1; (-) strand; PAM type: NRG; PAM sequence: AGG
agttagtttgggggttgcag

SEQ ID NO: 80750 - DNA, 20 bp, Artificial Sequence
  Description of Artificial Sequence: Synthetic oligonucleotide
  Target: ATXN1; (-) strand; PAM type: NRG; PAM sequence: GAG
aagttagtttgggggttgca

SEQ ID NO: 80751 - DNA, 20 bp, Artificial Sequence
  Description of Artificial Sequence: Synthetic oligonucleotide
  Target: ATXN1; (-) strand; PAM type: NRG; PAM sequence: CAG
agaagttagtttgggggttg

SEQ ID NO: 80752 - DNA, 20 bp, Artificial Sequence
  Description of Artificial Sequence: Synthetic oligonucleotide
  Target: ATXN1; (-) strand; PAM type: NRG; PAM sequence: GGG
agagacagaagttagtttgg

SEQ ID NO: 80753 - DNA, 20 bp, Artificial Sequence
  Description of Artificial Sequence: Synthetic oligonucleotide
  Target: ATXN1; (-) strand; PAM type: NRG; PAM sequence: GGG
tagagacagaagttagtttg

SEQ ID NO: 80754 - DNA, 20 bp, Artificial Sequence
  Description of Artificial Sequence: Synthetic oligonucleotide
  Target: ATXN1; (-) strand; PAM type: NRG; PAM sequence: GGG
atagagacagaagttagttt

SEQ ID NO: 80755 - DNA, 20 bp, Artificial Sequence
  Description of Artificial Sequence: Synthetic oligonucleotide
  Target: ATXN1; (-) strand; PAM type: NRG; PAM sequence: TGG
catagagacagaagttagtt

SEQ ID NO: 80756 - DNA, 20 bp, Artificial Sequence
  Description of Artificial Sequence: Synthetic oligonucleotide
  Target: ATXN1; (-) strand; PAM type: NRG; PAM sequence: TAG
aaatccatagagacagaagt

SEQ ID NO: 80757 - DNA, 20 bp, Artificial Sequence
  Description of Artificial Sequence: Synthetic oligonucleotide
  Target: ATXN1; (-) strand; PAM type: NRG; PAM sequence: AAG
agacaaatccatagagacag

SEQ ID NO: 80758 - DNA, 20 bp, Artificial Sequence
  Description of Artificial Sequence: Synthetic oligonucleotide
  Target: ATXN1; (-) strand; PAM type: NRG; PAM sequence: CAG
aatagacaaatccatagaga

SEQ ID NO: 80759 - DNA, 20 bp, Artificial Sequence
  Description of Artificial Sequence: Synthetic oligonucleotide
  Target: ATXN1; (-) strand; PAM type: NRG; PAM sequence: GAG
ccagaatagacaaatccata

SEQ ID NO: 80760 - DNA, 20 bp, Artificial Sequence
  Description of Artificial Sequence: Synthetic oligonucleotide
  Target: ATXN1; (-) strand; PAM type: NRG; PAM sequence: TAG
gtccagaatagacaaatcca

SEQ ID NO: 80761 - DNA, 20 bp, Artificial Sequence
  Description of Artificial Sequence: Synthetic oligonucleotide
  Target: ATXN1; (-) strand; PAM type: NRG; PAM sequence: TAG
tttatatgaaaggtccagaa

SEQ ID NO: 80762 - DNA, 20 bp, Artificial Sequence
  Description of Artificial Sequence: Synthetic oligonucleotide
  Target: ATXN1; (-) strand; PAM type: NRG; PAM sequence: CAG
tttcatttatatgaaaggtc

SEQ ID NO: 80763 - DNA, 20 bp, Artificial Sequence
  Description of Artificial Sequence: Synthetic oligonucleotide
  Target: ATXN1; (-) strand; PAM type: NRG; PAM sequence: AGG
ttcaatttcatttatatgaa

SEQ ID NO: 80764 - DNA, 20 bp, Artificial Sequence
  Description of Artificial Sequence: Synthetic oligonucleotide
  Target: ATXN1; (-) strand; PAM type: NRG; PAM sequence: AAG
cttcaatttcatttatatga

SEQ ID NO: 80765 - DNA, 20 bp, Artificial Sequence
  Description of Artificial Sequence: Synthetic oligonucleotide
  Target: ATXN1; (-) strand; PAM type: NRG; PAM sequence: GAG
caaaacatcatgtgaattga

SEQ ID NO: 80766 - DNA, 20 bp, Artificial Sequence
  Description of Artificial Sequence: Synthetic oligonucleotide
  Target: ATXN1; (-) strand; PAM type: NRG; PAM sequence: GAG
ctcaaaacatcatgtgaatt

SEQ ID NO: 80767 - DNA, 20 bp, Artificial Sequence
  Description of Artificial Sequence: Synthetic oligonucleotide
  Target: ATXN1; (-) strand; PAM type: NRG; PAM sequence: TAG
tattaatacatgctacaaca

SEQ ID NO: 80768 - DNA, 20 bp, Artificial Sequence
  Description of Artificial Sequence: Synthetic oligonucleotide
  Target: ATXN1; (-) strand; PAM type: NRG; PAM sequence: AAG
aaaaaaacaaccagtaagca

SEQ ID NO: 80769 - DNA, 20 bp, Artificial Sequence
  Description of Artificial Sequence: Synthetic oligonucleotide
  Target: ATXN1; (-) strand; PAM type: NRG; PAM sequence: AAG
tcaggaaaaaaacaaccagt

SEQ ID NO: 80770 - DNA, 20 bp, Artificial Sequence
  Description of Artificial Sequence: Synthetic oligonucleotide
  Target: ATXN1; (-) strand; PAM type: NRG; PAM sequence: CAG
ttgatcaggaaaaaaacaac

SEQ ID NO: 80771 - DNA, 20 bp, Artificial Sequence
  Description of Artificial Sequence: Synthetic oligonucleotide
  Target: ATXN1; (-) strand; PAM type: NRG; PAM sequence: AGG
tgtttaatggaatattgatc

SEQ ID NO: 80772 - DNA, 20 bp, Artificial Sequence
  Description of Artificial Sequence: Synthetic oligonucleotide
  Target: ATXN1; (-) strand; PAM type: NRG; PAM sequence: CAG
atgtttaatggaatattgat

SEQ ID NO: 80773 - DNA, 20 bp, Artificial Sequence
  Description of Artificial Sequence: Synthetic oligonucleotide
  Target: ATXN1; (-) strand; PAM type: NRG; PAM sequence: TGG
cacgcaaaataaatgtttaa

SEQ ID NO: 80774 - DNA, 20 bp, Artificial Sequence
  Description of Artificial Sequence: Synthetic oligonucleotide
  Target: ATXN1; (-) strand; PAM type: NRG; PAM sequence: GAG
gtgtctccaagtactgagct

SEQ ID NO: 80775 - DNA, 20 bp, Artificial Sequence
  Description of Artificial Sequence: Synthetic oligonucleotide
  Target: ATXN1; (-) strand; PAM type: NRG; PAM sequence: GAG
gtgctgtgtctccaagtact

SEQ ID NO: 80776 - DNA, 20 bp, Artificial Sequence
  Description of Artificial Sequence: Synthetic oligonucleotide
  Target: ATXN1; (-) strand; PAM type: NRG; PAM sequence: AAG
tttcagagtgctgtgtctcc

SEQ ID NO: 80777 - DNA, 20 bp, Artificial Sequence
  Description of Artificial Sequence: Synthetic oligonucleotide
  Target: ATXN1; (-) strand; PAM type: NRG; PAM sequence: GAG
gaaagctacagacattttca

SEQ ID NO: 80778 - DNA, 20 bp, Artificial Sequence
  Description of Artificial Sequence: Synthetic oligonucleotide
  Target: ATXN1; (-) strand; PAM type: NRG; PAM sequence: CAG
atgaaagctacagacatttt

SEQ ID NO: 80779 - DNA, 20 bp, Artificial Sequence
  Description of Artificial Sequence: Synthetic oligonucleotide
  Target: ATXN1; (-) strand; PAM type: NRG; PAM sequence: CAG
gccaatggtaatgaaagcta

SEQ ID NO: 80780 - DNA, 20 bp, Artificial Sequence
  Description of Artificial Sequence: Synthetic oligonucleotide
  Target: ATXN1; (-) strand; PAM type: NRG; PAM sequence: AAG
aataatgccaatggtaatga

SEQ ID NO: 80781 - DNA, 20 bp, Artificial Sequence
  Description of Artificial Sequence: Synthetic oligonucleotide
  Target: ATXN1; (-) strand; PAM type: NRG; PAM sequence: TGG
aacgatagtaataatgccaa

SEQ ID NO: 80782 - DNA, 20 bp, Artificial Sequence
  Description of Artificial Sequence: Synthetic oligonucleotide
  Target: ATXN1; (-) strand; PAM type: NRG; PAM sequence: TAG
aaacaaaagtgacaaaacga

SEQ ID NO: 80783 - DNA, 20 bp, Artificial Sequence
  Description of Artificial Sequence: Synthetic oligonucleotide
  Target: ATXN1; (-) strand; PAM type: NRG; PAM sequence: AAG
accagtgcaattgtaaacaa

SEQ ID NO: 80784 - DNA, 20 bp, Artificial Sequence
  Description of Artificial Sequence: Synthetic oligonucleotide
  Target: ATXN1; (-) strand; PAM type: NRG; PAM sequence: CAG
aataatcaactggtggagac

SEQ ID NO: 80785 - DNA, 20 bp, Artificial Sequence
  Description of Artificial Sequence: Synthetic oligonucleotide
  Target: ATXN1; (-) strand; PAM type: NRG; PAM sequence: GAG
agcttaataatcaactggtg

SEQ ID NO: 80786 - DNA, 20 bp, Artificial Sequence
  Description of Artificial Sequence: Synthetic oligonucleotide
  Target: ATXN1; (-) strand; PAM type: NRG; PAM sequence: TGG
agagcttaataatcaactgg

SEQ ID NO: 80787 - DNA, 20 bp, Artificial Sequence
  Description of Artificial Sequence: Synthetic oligonucleotide
  Target: ATXN1; (-) strand; PAM type: NRG; PAM sequence: TGG
tctagagcttaataatcaac

SEQ ID NO: 80788 - DNA, 20 bp, Artificial Sequence
  Description of Artificial Sequence: Synthetic oligonucleotide
  Target: ATXN1; (-) strand; PAM type: NRG; PAM sequence: GAG
ggttgggaacccctgctcta

SEQ ID NO: 80789 - DNA, 20 bp, Artificial Sequence
  Description of Artificial Sequence: Synthetic oligonucleotide
  Target: ATXN1; (-) strand; PAM type: NRG; PAM sequence: TAG
ggggttgggaacccctgctc

SEQ ID NO: 80790 - DNA, 20 bp, Artificial Sequence
  Description of Artificial Sequence: Synthetic oligonucleotide
  Target: ATXN1; (-) strand; PAM type: NRG; PAM sequence: GGG
aggtctgtagcccaggggtt

SEQ ID NO: 80791 - DNA, 20 bp, Artificial Sequence
  Description of Artificial Sequence: Synthetic oligonucleotide
  Target: ATXN1; (-) strand; PAM type: NRG; PAM sequence: TGG
gaggtctgtagcccaggggt

SEQ ID NO: 80792 - DNA, 20 bp, Artificial Sequence
  Description of Artificial Sequence: Synthetic oligonucleotide
  Target: ATXN1; (-) strand; PAM type: NRG; PAM sequence: GGG
gcaggaggtctgtagcccag

SEQ ID NO: 80793 - DNA, 20 bp, Artificial Sequence
  Description of Artificial Sequence: Synthetic oligonucleotide
  Target: ATXN1; (-) strand; PAM type: NRG; PAM sequence: GGG
tgcaggaggtctgtagccca

SEQ ID NO: 80794 - DNA, 20 bp, Artificial Sequence
  Description of Artificial Sequence: Synthetic oligonucleotide
  Target: ATXN1; (-) strand; PAM type: NRG; PAM sequence: AGG
gtgcaggaggtctgtagccc

SEQ ID NO: 80795 - DNA, 20 bp, Artificial Sequence
  Description of Artificial Sequence: Synthetic oligonucleotide
  Target: ATXN1; (-) strand; PAM type: NRG; PAM sequence: CAG
tgtgcaggaggtctgtagcc

SEQ ID NO: 80796 - DNA, 20 bp, Artificial Sequence
  Description of Artificial Sequence: Synthetic oligonucleotide
  Target: ATXN1; (-) strand; PAM type: NRG; PAM sequence: TAG
cctgttgtgcaggaggtctg

SEQ ID NO: 80797 - DNA, 20 bp, Artificial Sequence
  Description of Artificial Sequence: Synthetic oligonucleotide
  Target: ATXN1; (-) strand; PAM type: NRG; PAM sequence: AGG
ctcacctcctgttgtgcagg

SEQ ID NO: 80798 - DNA, 20 bp, Artificial Sequence
  Description of Artificial Sequence: Synthetic oligonucleotide
  Target: ATXN1; (-) strand; PAM type: NRG; PAM sequence: GAG
gctcacctcctgttgtgcag

SEQ ID NO: 80799 - DNA, 20 bp, Artificial Sequence
  Description of Artificial Sequence: Synthetic oligonucleotide
  Target: ATXN1; (-) strand; PAM type: NRG; PAM sequence: AGG
ctgctcacctcctgttgtgc

SEQ ID NO: 80800 - DNA, 20 bp, Artificial Sequence
  Description of Artificial Sequence: Synthetic oligonucleotide
  Target: ATXN1; (-) strand; PAM type: NRG; PAM sequence: CAG
actgctcacctcctgttgtg

SEQ ID NO: 80801 - DNA, 20 bp, Artificial Sequence
  Description of Artificial Sequence: Synthetic oligonucleotide
  Target: ATXN1; (-) strand; PAM type: NRG; PAM sequence: AAG
agtggctgtaaatacagatg

SEQ ID NO: 80802 - DNA, 20 bp, Artificial Sequence
  Description of Artificial Sequence: Synthetic oligonucleotide
  Target: ATXN1; (-) strand; PAM type: NRG; PAM sequence: CAG
atggggagtggctgtaaata

SEQ ID NO: 80803 - DNA, 20 bp, Artificial Sequence
  Description of Artificial Sequence: Synthetic oligonucleotide
  Target: ATXN1; (-) strand; PAM type: NRG; PAM sequence: TGG
gtaatttgaacaatggggag

SEQ ID NO: 80804 - DNA, 20 bp, Artificial Sequence
  Description of Artificial Sequence: Synthetic oligonucleotide
  Target: ATXN1; (-) strand; PAM type: NRG; PAM sequence: GAG
gtggtaatttgaacaatggg

SEQ ID NO: 80805 - DNA, 20 bp, Artificial Sequence
  Description of Artificial Sequence: Synthetic oligonucleotide
  Target: ATXN1; (-) strand; PAM type: NRG; PAM sequence: GGG
aggtggtaatttgaacaatg

SEQ ID NO: 80806 - DNA, 20 bp, Artificial Sequence
  Description of Artificial Sequence: Synthetic oligonucleotide
  Target: ATXN1; (-) strand; PAM type: NRG; PAM sequence: GGG
caggtggtaatttgaacaat

SEQ ID NO: 80807 - DNA, 20 bp, Artificial Sequence
  Description of Artificial Sequence: Synthetic oligonucleotide
  Target: ATXN1; (-) strand; PAM type: NRG; PAM sequence: TGG
tcaggtggtaatttgaacaa

SEQ ID NO: 80808 - DNA, 20 bp, Artificial Sequence
  Description of Artificial Sequence: Synthetic oligonucleotide
  Target: ATXN1; (-) strand; PAM type: NRG; PAM sequence: TGG
gacaggaggcagagctcagg

SEQ ID NO: 80809 - DNA, 20 bp, Artificial Sequence
  Description of Artificial Sequence: Synthetic oligonucleotide
  Target: ATXN1; (-) strand; PAM type: NRG; PAM sequence: AGG
cctgacaggaggcagagctc

SEQ ID NO: 80810 - DNA, 20 bp, Artificial Sequence
  Description of Artificial Sequence: Synthetic oligonucleotide
  Target: ATXN1; (-) strand; PAM type: NRG; PAM sequence: CAG
acctgacaggaggcagagct

SEQ ID NO: 80811 - DNA, 20 bp, Artificial Sequence
  Description of Artificial Sequence: Synthetic oligonucleotide
  Target: ATXN1; (-) strand; PAM type: NRG; PAM sequence: GAG
tgctgacctgacaggaggca

SEQ ID NO: 80812 - DNA, 20 bp, Artificial Sequence
  Description of Artificial Sequence: Synthetic oligonucleotide
  Target: ATXN1; (-) strand; PAM type: NRG; PAM sequence: CAG
gttgctgacctgacaggagg

SEQ ID NO: 80813 - DNA, 20 bp, Artificial Sequence
  Description of Artificial Sequence: Synthetic oligonucleotide
  Target: ATXN1; (-) strand; PAM type: NRG; PAM sequence: AGG
gccgttgctgacctgacagg

SEQ ID NO: 80814 - DNA, 20 bp, Artificial Sequence
  Description of Artificial Sequence: Synthetic oligonucleotide
  Target: ATXN1; (-) strand; PAM type: NRG; PAM sequence: GAG
tgccgttgctgacctgacag

SEQ ID NO: 80815 - DNA, 20 bp, Artificial Sequence
  Description of Artificial Sequence: Synthetic oligonucleotide
  Target: ATXN1; (-) strand; PAM type: NRG; PAM sequence: AGG
catgccgttgctgacctgac

SEQ ID NO: 80816 - DNA, 20 bp, Artificial Sequence
  Description of Artificial Sequence: Synthetic oligonucleotide
  Target: ATXN1; (-) strand; PAM type: NRG; PAM sequence: CAG
tcatgccgttgctgacctga

SEQ ID NO: 80817 - DNA, 20 bp, Artificial Sequence
  Description of Artificial Sequence: Synthetic oligonucleotide
  Target: ATXN1; (-) strand; PAM type: NRG; PAM sequence: GAG
aatagggttcacgctcctat

SEQ ID NO: 80818 - DNA, 20 bp, Artificial Sequence
  Description of Artificial Sequence: Synthetic oligonucleotide
  Target: ATXN1; (-) strand; PAM type: NRG; PAM sequence: GGG
cacatgtgcagttcacaata

SEQ ID NO: 80819 - DNA, 20 bp, Artificial Sequence
  Description of Artificial Sequence: Synthetic oligonucleotide
  Target: ATXN1; (-) strand; PAM type: NRG; PAM sequence: AGG
tcacatgtgcagttcacaat

SEQ ID NO: 80820 - DNA, 20 bp, Artificial Sequence
  Description of Artificial Sequence: Synthetic oligonucleotide
  Target: ATXN1; (-) strand; PAM type: NRG; PAM sequence: TAG
ctcacatgtgcagttcacaa

SEQ ID NO: 80821 - DNA, 20 bp, Artificial Sequence
  Description of Artificial Sequence: Synthetic oligonucleotide
  Target: ATXN1; (-) strand; PAM type: NRG; PAM sequence: CAG
acctacatccctcacatgtg

SEQ ID NO: 80822 - DNA, 20 bp, Artificial Sequence
  Description of Artificial Sequence: Synthetic oligonucleotide
  Target: ATXN1; (-) strand; PAM type: NRG; PAM sequence: GGG
gcattagattctcataaaga

SEQ ID NO: 80823 - DNA, 20 bp, Artificial Sequence
  Description of Artificial Sequence: Synthetic oligonucleotide
  Target: ATXN1; (-) strand; PAM type: NRG; PAM sequence: AGG
ggcattagattctcataaag

SEQ ID NO: 80824 - DNA, 20 bp, Artificial Sequence
  Description of Artificial Sequence: Synthetic oligonucleotide
  Target: ATXN1; (-) strand; PAM type: NRG; PAM sequence: GAG
aggcattagattctcataaa

SEQ ID NO: 80825 - DNA, 20 bp, Artificial Sequence
  Description of Artificial Sequence: Synthetic oligonucleotide
  Target: ATXN1; (-) strand; PAM type: NRG; PAM sequence: AAG
tcaggcattagattctcata

SEQ ID NO: 80826 - DNA, 20 bp, Artificial Sequence
  Description of Artificial Sequence: Synthetic oligonucleotide
  Target: ATXN1; (-) strand; PAM type: NRG; PAM sequence: TAG
agtgacagatcatcaggcat

SEQ ID NO: 80827 - DNA, 20 bp, Artificial Sequence
  Description of Artificial Sequence: Synthetic oligonucleotide
  Target: ATXN1; (-) strand; PAM type: NRG; PAM sequence: AGG
ggagacagtgacagatcatc

SEQ ID NO: 80828 - DNA, 20 bp, Artificial Sequence
  Description of Artificial Sequence: Synthetic oligonucleotide
  Target: ATXN1; (-) strand; PAM type: NRG; PAM sequence: CAG
gggagacagtgacagatcat

SEQ ID NO: 80829 - DNA, 20 bp, Artificial Sequence
  Description of Artificial Sequence: Synthetic oligonucleotide
  Target: ATXN1; (-) strand; PAM type: NRG; PAM sequence: CAG
ggggtgatgggagacagtga

SEQ ID NO: 80830 - DNA, 20 bp, Artificial Sequence
  Description of Artificial Sequence: Synthetic oligonucleotide
  Target: ATXN1; (-) strand; PAM type: NRG; PAM sequence: CAG
catctaggggtgatgggaga

SEQ ID NO: 80831 - DNA, 20 bp, Artificial Sequence
  Description of Artificial Sequence: Synthetic oligonucleotide
  Target: ATXN1; (-) strand; PAM type: NRG; PAM sequence: GAG
gtcccatctaggggtgatgg

SEQ ID NO: 80832 - DNA, 20 bp, Artificial Sequence
  Description of Artificial Sequence: Synthetic oligonucleotide
  Target: ATXN1; (-) strand; PAM type: NRG; PAM sequence: GGG
cggtcccatctaggggtgat

SEQ ID NO: 80833 - DNA, 20 bp, Artificial Sequence
  Description of Artificial Sequence: Synthetic oligonucleotide
  Target: ATXN1; (-) strand; PAM type: NRG; PAM sequence: TGG
acggtcccatctaggggtga

SEQ ID NO: 80834 - DNA, 20 bp, Artificial Sequence
  Description of Artificial Sequence: Synthetic oligonucleotide
  Target: ATXN1; (-) strand; PAM type: NRG; PAM sequence: GGG
aacaaaacggtcccatctag

SEQ ID NO: 80835 - DNA, 20 bp, Artificial Sequence
  Description of Artificial Sequence: Synthetic oligonucleotide
  Target: ATXN1; (-) strand; PAM type: NRG; PAM sequence: GGG
caacaaaacggtcccatcta

SEQ ID NO: 80836 - DNA, 20 bp, Artificial Sequence
  Description of Artificial Sequence: Synthetic oligonucleotide
  Target: ATXN1; (-) strand; PAM type: NRG; PAM sequence: AGG
gcaacaaaacggtcccatct

SEQ ID NO: 80837 - DNA, 20 bp, Artificial Sequence
  Description of Artificial Sequence: Synthetic oligonucleotide
  Target: ATXN1; (-) strand; PAM type: NRG; PAM sequence: TAG
tgcaacaaaacggtcccatc

SEQ ID NO: 80838 - DNA, 20 bp, Artificial Sequence
  Description of Artificial Sequence: Synthetic oligonucleotide
  Target: ATXN1; (-) strand; PAM type: NRG; PAM sequence: CGG
cttgttttcctgcaacaaaa

SEQ ID NO: 80839 - DNA, 20 bp, Artificial Sequence
  Description of Artificial Sequence: Synthetic oligonucleotide
  Target: ATXN1; (-) strand; PAM type: NRG; PAM sequence: GAG
gtagaatcagtgagatcctt

SEQ ID NO: 80840 - DNA, 20 bp, Artificial Sequence
  Description of Artificial Sequence: Synthetic oligonucleotide
  Target: ATXN1; (-) strand; PAM type: NRG; PAM sequence: GAG
caccataatgtagaatcagt

SEQ ID NO: 80841 - DNA, 20 bp, Artificial Sequence
  Description of Artificial Sequence: Synthetic oligonucleotide
  Target: ATXN1; (-) strand; PAM type: NRG; PAM sequence: CAG
aactcaccataatgtagaat

SEQ ID NO: 80842 - DNA, 20 bp, Artificial Sequence
  Description of Artificial Sequence: Synthetic oligonucleotide
  Target: ATXN1; (-) strand; PAM type: NRG; PAM sequence: TAG
ttatgcaactcaccataatg

SEQ ID NO: 80843 - DNA, 20 bp, Artificial Sequence
  Description of Artificial Sequence: Synthetic oligonucleotide
  Target: ATXN1; (-) strand; PAM type: NRG; PAM sequence: GGG
gtggagcgggggatggtttt

SEQ ID NO: 80844 - DNA, 20 bp, Artificial Sequence
  Description of Artificial Sequence: Synthetic oligonucleotide
  Target: ATXN1; (-) strand; PAM type: NRG; PAM sequence: TGG
ggtggagcgggggatggttt

SEQ ID NO: 80845 - DNA, 20 bp, Artificial Sequence
  Description of Artificial Sequence: Synthetic oligonucleotide
  Target: ATXN1; (-) strand; PAM type: NRG; PAM sequence: TGG
gactagggtggagcggggga

SEQ ID NO: 80846 - DNA, 20 bp, Artificial Sequence
  Description of Artificial Sequence: Synthetic oligonucleotide
  Target: ATXN1; (-) strand; PAM type: NRG; PAM sequence: GGG
cacagactagggtggagcgg

SEQ ID NO: 80847 - DNA, 20 bp, Artificial Sequence
  Description of Artificial Sequence: Synthetic oligonucleotide
  Target: ATXN1; (-) strand; PAM type: NRG; PAM sequence: GGG
ccacagactagggtggagcg

SEQ ID NO: 80848 - DNA, 20 bp, Artificial Sequence
  Description of Artificial Sequence: Synthetic oligonucleotide
  Target: ATXN1; (-) strand; PAM type: NRG; PAM sequence: GGG
tccacagactagggtggagc

SEQ ID NO: 80849 - DNA, 20 bp, Artificial Sequence
  Description of Artificial Sequence: Synthetic oligonucleotide
  Target: ATXN1; (-) strand; PAM type: NRG; PAM sequence: CGG
ttccacagactagggtggag

SEQ ID NO: 80850 - DNA, 20 bp, Artificial Sequence
  Description of Artificial Sequence: Synthetic oligonucleotide
  Target: ATXN1; (-) strand; PAM type: NRG; PAM sequence: GAG
tttttccacagactagggtg

SEQ ID NO: 80851 - DNA, 20 bp, Artificial Sequence
  Description of Artificial Sequence: Synthetic oligonucleotide
  Target: ATXN1; (-) strand; PAM type: NRG; PAM sequence: TGG
agtttttccacagactaggg

SEQ ID NO: 80852 - DNA, 20 bp, Artificial Sequence
  Description of Artificial Sequence: Synthetic oligonucleotide
  Target: ATXN1; (-) strand; PAM type: NRG; PAM sequence: GGG
gacagtttttccacagacta

SEQ ID NO: 80853 - DNA, 20 bp, Artificial Sequence
  Description of Artificial Sequence: Synthetic oligonucleotide
  Target: ATXN1; (-) strand; PAM type: NRG; PAM sequence: AGG
agacagtttttccacagact

SEQ ID NO: 80854 - DNA, 20 bp, Artificial Sequence
  Description of Artificial Sequence: Synthetic oligonucleotide
  Target: ATXN1; (-) strand; PAM type: NRG; PAM sequence: TAG
aagacagtttttccacagac

SEQ ID NO: 80855 - DNA, 20 bp, Artificial Sequence
  Description of Artificial Sequence: Synthetic oligonucleotide
  Target: ATXN1; (-) strand; PAM type: NRG; PAM sequence: CAG
catggaagacagtttttcca

SEQ ID NO: 80856 - DNA, 20 bp, Artificial Sequence
  Description of Artificial Sequence: Synthetic oligonucleotide
  Target: ATXN1; (-) strand; PAM type: NRG; PAM sequence: CAG
gggactggtttcatggaaga

SEQ ID NO: 80857 - DNA, 20 bp, Artificial Sequence
  Description of Artificial Sequence: Synthetic oligonucleotide
  Target: ATXN1; (-) strand; PAM type: NRG; PAM sequence: AAG
accagggactggtttcatgg

SEQ ID NO: 80858 - DNA, 20 bp, Artificial Sequence
  Description of Artificial Sequence: Synthetic oligonucleotide
  Target: ATXN1; (-) strand; PAM type: NRG; PAM sequence: TGG
ggcaccagggactggtttca

SEQ ID NO: 80859 - DNA, 20 bp, Artificial Sequence
  Description of Artificial Sequence: Synthetic oligonucleotide
  Target: ATXN1; (-) strand; PAM type: NRG; PAM sequence: TGG
acctttttggcaccagggac

SEQ ID NO: 80860 - DNA, 20 bp, Artificial Sequence
  Description of Artificial Sequence: Synthetic oligonucleotide
  Target: ATXN1; (-) strand; PAM type: NRG; PAM sequence: GGG
ccctaacctttttggcacca

SEQ ID NO: 80861 - DNA, 20 bp, Artificial Sequence
  Description of Artificial Sequence: Synthetic oligonucleotide
  Target: ATXN1; (-) strand; PAM type: NRG; PAM sequence: AGG
tccctaacctttttggcacc

SEQ ID NO: 80862 - DNA, 20 bp, Artificial Sequence
  Description of Artificial Sequence: Synthetic oligonucleotide
  Target: ATXN1; (-) strand; PAM type: NRG; PAM sequence: CAG
gtccctaacctttttggcac

SEQ ID NO: 80863 - DNA, 20 bp, Artificial Sequence
  Description of Artificial Sequence: Synthetic oligonucleotide
  Target: ATXN1; (-) strand; PAM type: NRG; PAM sequence: TGG
ccagtggtccctaacctttt

SEQ ID NO: 80864 - DNA, 20 bp, Artificial Sequence
  Description of Artificial Sequence: Synthetic oligonucleotide
  Target: ATXN1; (-) strand; PAM type: NRG; PAM sequence: TGG
gctccttctctctagaccag

SEQ ID NO: 80865 - DNA, 20 bp, Artificial Sequence
  Description of Artificial Sequence: Synthetic oligonucleotide
  Target: ATXN1; (-) strand; PAM type: NRG; PAM sequence: CAG
agagctccttctctctagac

SEQ ID NO: 80866 - DNA, 20 bp, Artificial Sequence
  Description of Artificial Sequence: Synthetic oligonucleotide
  Target: ATXN1; (-) strand; PAM type: NRG; PAM sequence: TAG
taagaagagctccttctctc

SEQ ID NO: 80867 - DNA, 20 bp, Artificial Sequence
  Description of Artificial Sequence: Synthetic oligonucleotide
  Target: ATXN1; (-) strand; PAM type: NRG; PAM sequence: GAG
ttctgggcagtgtgtaagaa

SEQ ID NO: 80868 - DNA, 20 bp, Artificial Sequence
  Description of Artificial Sequence: Synthetic oligonucleotide
  Target: ATXN1; (-) strand; PAM type: NRG; PAM sequence: AAG
gtttctgggcagtgtgtaag

SEQ ID NO: 80869 - DNA, 20 bp, Artificial Sequence
  Description of Artificial Sequence: Synthetic oligonucleotide
  Target: ATXN1; (-) strand; PAM type: NRG; PAM sequence: AAG
tcagtttctgggcagtgtgt

SEQ ID NO: 80870 - DNA, 20 bp, Artificial Sequence
  Description of Artificial Sequence: Synthetic oligonucleotide
  Target: ATXN1; (-) strand; PAM type: NRG; PAM sequence: CAG
tcacatcctcagtttctggg

SEQ ID NO: 80871 - DNA, 20 bp, Artificial Sequence
  Description of Artificial Sequence: Synthetic oligonucleotide
  Target: ATXN1; (-) strand; PAM type: NRG; PAM sequence: GGG
ctgtcacatcctcagtttct

SEQ ID NO: 80872 - DNA, 20 bp, Artificial Sequence
  Description of Artificial Sequence: Synthetic oligonucleotide
  Target: ATXN1; (-) strand; PAM type: NRG; PAM sequence: TGG
tctgtcacatcctcagtttc

SEQ ID NO: 80873 - DNA, 20 bp, Artificial Sequence
  Description of Artificial Sequence: Synthetic oligonucleotide
  Target: ATXN1; (-) strand; PAM type: NRG; PAM sequence: CAG
ttgaacttctgtcacatcct

SEQ ID NO: 80874 - DNA, 20 bp, Artificial Sequence
  Description of Artificial Sequence: Synthetic oligonucleotide
  Target: ATXN1; (-) strand; PAM type: NRG; PAM sequence: TAG
ttgctacttagttgtttagt

SEQ ID NO: 80875 - DNA, 20 bp, Artificial Sequence
  Description of Artificial Sequence: Synthetic oligonucleotide
  Target: ATXN1; (-) strand; PAM type: NRG; PAM sequence: TAG
caggttgctacttagttgtt

SEQ ID NO: 80876 - DNA, 20 bp, Artificial Sequence
  Description of Artificial Sequence: Synthetic oligonucleotide
  Target: ATXN1; (-) strand; PAM type: NRG; PAM sequence: TAG
gcccttgtcaggttgctact

SEQ ID NO: 80877 - DNA, 20 bp, Artificial Sequence
  Description of Artificial Sequence: Synthetic oligonucleotide
  Target: ATXN1; (-) strand; PAM type: NRG; PAM sequence: AGG
gagctgtctgagcccttgtc

SEQ ID NO: 80878 - DNA, 20 bp, Artificial Sequence
  Description of Artificial Sequence: Synthetic oligonucleotide
  Target: ATXN1; (-) strand; PAM type: NRG; PAM sequence: CAG
ggagctgtctgagcccttgt

SEQ ID NO: 80879 - DNA, 20 bp, Artificial Sequence
  Description of Artificial Sequence: Synthetic oligonucleotide
  Target: ATXN1; (-) strand; PAM type: NRG; PAM sequence: GAG
aggtttagttggagctgtct

SEQ ID NO: 80880 - DNA, 20 bp, Artificial Sequence
  Description of Artificial Sequence: Synthetic oligonucleotide
  Target: ATXN1; (-) strand; PAM type: NRG; PAM sequence: GAG
cagcagtgtaggtttagttg

SEQ ID NO: 80881 - DNA, 20 bp, Artificial Sequence
  Description of Artificial Sequence: Synthetic oligonucleotide
  Target: ATXN1; (-) strand; PAM type: NRG; PAM sequence: TGG
agcagcagtgtaggtttagt

SEQ ID NO: 80882 - DNA, 20 bp, Artificial Sequence
  Description of Artificial Sequence: Synthetic oligonucleotide
  Target: ATXN1; (-) strand; PAM type: NRG; PAM sequence: TAG
cggcagcagcagtgtaggtt

SEQ ID NO: 80883 - DNA, 20 bp, Artificial Sequence
  Description of Artificial Sequence: Synthetic oligonucleotide
  Target: ATXN1; (-) strand; PAM type: NRG; PAM sequence: AGG
gtaagcggcagcagcagtgt

SEQ ID NO: 80884 - DNA, 20 bp, Artificial Sequence
  Description of Artificial Sequence: Synthetic oligonucleotide
  Target: ATXN1; (-) strand; PAM type: NRG; PAM sequence: TAG
tgtaagcggcagcagcagtg

SEQ ID NO: 80885 - DNA, 20 bp, Artificial Sequence
  Description of Artificial Sequence: Synthetic oligonucleotide
  Target: ATXN1; (-) strand; PAM type: NRG; PAM sequence: CAG
gcttttgtaagcggcagcag

SEQ ID NO: 80886 - DNA, 20 bp, Artificial Sequence
  Description of Artificial Sequence: Synthetic oligonucleotide
  Target: ATXN1; (-) strand; PAM type: NRG; PAM sequence: CAG
tgagcttttgtaagcggcag

SEQ ID NO: 80887 - DNA, 20 bp, Artificial Sequence
  Description of Artificial Sequence: Synthetic oligonucleotide
  Target: ATXN1; (-) strand; PAM type: NRG; PAM sequence: CAG
gaatgagcttttgtaagcgg

SEQ ID NO: 80888 - DNA, 20 bp, Artificial Sequence
  Description of Artificial Sequence: Synthetic oligonucleotide
  Target: ATXN1; (-) strand; PAM type: NRG; PAM sequence: CGG
tatgaatgagcttttgtaag

SEQ ID NO: 80889 - DNA, 20 bp, Artificial Sequence
  Description of Artificial Sequence: Synthetic oligonucleotide
  Target: ATXN1; (-) strand; PAM type: NRG; PAM sequence: AAG
acatatgaatgagcttttgt

SEQ ID NO: 80890 - DNA, 20 bp, Artificial Sequence
  Description of Artificial Sequence: Synthetic oligonucleotide
  Target: ATXN1; (-) strand; PAM type: NRG; PAM sequence: GAG
ctgaactcacacatatgaat

SEQ ID NO: 80891 - DNA, 20 bp, Artificial Sequence
  Description of Artificial Sequence: Synthetic oligonucleotide
  Target: ATXN1; (-) strand; PAM type: NRG; PAM sequence: CAG
caatgtcctgcctaaagaat

SEQ ID NO: 80892 - DNA, 20 bp, Artificial Sequence
  Description of Artificial Sequence: Synthetic oligonucleotide
  Target: ATXN1; (-) strand; PAM type: NRG; PAM sequence: AAG
tctggtcaatgtcctgccta

SEQ ID NO: 80893 - DNA, 20 bp, Artificial Sequence
  Description of Artificial Sequence: Synthetic oligonucleotide
  Target: ATXN1; (-) strand; PAM type: NRG; PAM sequence: TGG
ttcagacatatttatttatc

SEQ ID NO: 80894 - DNA, 20 bp, Artificial Sequence
  Description of Artificial Sequence: Synthetic oligonucleotide
  Target: ATXN1; (-) strand; PAM type: NRG; PAM sequence: CAG
aaattatttctctgcagatt

SEQ ID NO: 80895 - DNA, 20 bp, Artificial Sequence
  Description of Artificial Sequence: Synthetic oligonucleotide
  Target: ATXN1; (-) strand; PAM type: NRG; PAM sequence: CAG
cttttgaaattatttctctg

SEQ ID NO: 80896 - DNA, 20 bp, Artificial Sequence
  Description of Artificial Sequence: Synthetic oligonucleotide
  Target: ATXN1; (-) strand; PAM type: NRG; PAM sequence: AAG
ggattttccttctccttctg

SEQ ID NO: 80897 - DNA, 20 bp, Artificial Sequence
  Description of Artificial Sequence: Synthetic oligonucleotide
  Target: ATXN1; (-) strand; PAM type: NRG; PAM sequence: TGG
ttggatgcttctggctacag

SEQ ID NO: 80898 - DNA, 20 bp, Artificial Sequence
  Description of Artificial Sequence: Synthetic oligonucleotide
  Target: ATXN1; (-) strand; PAM type: NRG; PAM sequence: CAG
cttttggatgcttctggcta

SEQ ID NO: 80899 - DNA, 20 bp, Artificial Sequence
  Description of Artificial Sequence: Synthetic oligonucleotide
  Target: ATXN1; (-) strand; PAM type: NRG; PAM sequence: TGG
aggatgcttttggatgcttc

SEQ ID NO: 80900 - DNA, 20 bp, Artificial Sequence
  Description of Artificial Sequence: Synthetic oligonucleotide
  Target: ATXN1; (-) strand; PAM type: NRG; PAM sequence: TGG
tcatgttttcaggatgcttt

SEQ ID NO: 80901 - DNA, 20 bp, Artificial Sequence
  Description of Artificial Sequence: Synthetic oligonucleotide
  Target: ATXN1; (-) strand; PAM type: NRG; PAM sequence: AGG
cttcctccactcatgttttc

SEQ ID NO: 80902 - DNA, 20 bp, Artificial Sequence
  Description of Artificial Sequence: Synthetic oligonucleotide
  Target: ATXN1; (-) strand; PAM type: NRG; PAM sequence: CAG
ccttcctccactcatgtttt

SEQ ID NO: 80903 - DNA, 20 bp, Artificial Sequence
  Description of Artificial Sequence: Synthetic oligonucleotide
  Target: ATXN1; (-) strand; PAM type: NRG; PAM sequence: CAG
ctccccagcccacacctgct

SEQ ID NO: 80904 - DNA, 20 bp, Artificial Sequence
  Description of Artificial Sequence: Synthetic oligonucleotide
  Target: ATXN1; (-) strand; PAM type: NRG; PAM sequence: CAG
tgcggggttgcctgcctccc

SEQ ID NO: 80905 - DNA, 20 bp, Artificial Sequence
  Description of Artificial Sequence: Synthetic oligonucleotide
  Target: ATXN1; (-) strand; PAM type: NRG; PAM sequence: GGG
tttgtgctggctgctgtgcg

SEQ ID NO: 80906 - DNA, 20 bp, Artificial Sequence
  Description of Artificial Sequence: Synthetic oligonucleotide
  Target: ATXN1; (-) strand; PAM type: NRG; PAM sequence: GGG
gtttgtgctggctgctgtgc

SEQ ID NO: 80907 - DNA, 20 bp, Artificial Sequence
  Description of Artificial Sequence: Synthetic oligonucleotide
  Target: ATXN1; (-) strand; PAM type: NRG; PAM sequence: CGG
tgtttgtgctggctgctgtg

SEQ ID NO: 80908 - DNA, 20 bp, Artificial Sequence
  Description of Artificial Sequence: Synthetic oligonucleotide
  Target: ATXN1; (-) strand; PAM type: NRG; PAM sequence: TGG
tcgtcgctttgtgtttgtgc

SEQ ID NO: 80909 - DNA, 20 bp, Artificial Sequence
  Description of Artificial Sequence: Synthetic oligonucleotide
  Target: ATXN1; (-) strand; PAM type: NRG; PAM sequence: GGG
ctgtgcttccccagcacagt

SEQ ID NO: 80910 - DNA, 20 bp, Artificial Sequence
  Description of Artificial Sequence: Synthetic oligonucleotide
  Target: ATXN1; (-) strand; PAM type: NRG; PAM sequence: TGG
cctgtgcttccccagcacag

SEQ ID NO: 80911 - DNA, 20 bp, Artificial Sequence
  Description of Artificial Sequence: Synthetic oligonucleotide
  Target: ATXN1; (-) strand; PAM type: NRG; PAM sequence: CAG
ctgcctgtgcttccccagca

SEQ ID NO: 80912 - DNA, 20 bp, Artificial Sequence
  Description of Artificial Sequence: Synthetic oligonucleotide
  Target: ATXN1; (-) strand; PAM type: NRG; PAM sequence: CAG
ctgtgctgcctgtgcttccc

SEQ ID NO: 80913 - DNA, 20 bp, Artificial Sequence
  Description of Artificial Sequence: Synthetic oligonucleotide
  Target: ATXN1; (-) strand; PAM type: NRG; PAM sequence: CGG
ggagccgcgtttcccttgca

SEQ ID NO: 80914 - DNA, 20 bp, Artificial Sequence
  Description of Artificial Sequence: Synthetic oligonucleotide
  Target: ATXN1; (-) strand; PAM type: NRG; PAM sequence: GAG
ccttgaaaacaccttgtagg

SEQ ID NO: 80915 - DNA, 20 bp, Artificial Sequence
  Description of Artificial Sequence: Synthetic oligonucleotide
  Target: ATXN1; (-) strand; PAM type: NRG; PAM sequence: GGG
aaccttgaaaacaccttgta

SEQ ID NO: 80916 - DNA, 20 bp, Artificial Sequence
  Description of Artificial Sequence: Synthetic oligonucleotide
  Target: ATXN1; (-) strand; PAM type: NRG; PAM sequence: AGG
gaaccttgaaaacaccttgt

SEQ ID NO: 80917 - DNA, 20 bp, Artificial Sequence
  Description of Artificial Sequence: Synthetic oligonucleotide
  Target: ATXN1; (-) strand; PAM type: NRG; PAM sequence: TAG
ggaaccttgaaaacaccttg

SEQ ID NO: 80918 - DNA, 20 bp, Artificial Sequence
  Description of Artificial Sequence: Synthetic oligonucleotide
  Target: ATXN1; (-) strand; PAM type: NRG; PAM sequence: CGG
gggttgtgctctggggaaac

SEQ ID NO: 80919 - DNA, 20 bp, Artificial Sequence
  Description of Artificial Sequence: Synthetic oligonucleotide
  Target: ATXN1; (-) strand; PAM type: NRG; PAM sequence: GGG
gaggttagggttgtgctctg

SEQ ID NO: 80920 - DNA, 20 bp, Artificial Sequence
  Description of Artificial Sequence: Synthetic oligonucleotide
  Target: ATXN1; (-) strand; PAM type: NRG; PAM sequence: GGG
tgaggttagggttgtgctct

SEQ ID NO: 80921 - DNA, 20 bp, Artificial Sequence
  Description of Artificial Sequence: Synthetic oligonucleotide
  Target: ATXN1; (-) strand; PAM type: NRG; PAM sequence: TGG
ctgaggttagggttgtgctc

SEQ ID NO: 80922 - DNA, 20 bp, Artificial Sequence
  Description of Artificial Sequence: Synthetic oligonucleotide
  Target: ATXN1; (-) strand; PAM type: NRG; PAM sequence: GGG
ctgtgcactgcctgaggtta

SEQ ID NO: 80923 - DNA, 20 bp, Artificial Sequence
  Description of Artificial Sequence: Synthetic oligonucleotide
  Target: ATXN1; (-) strand; PAM type: NRG; PAM sequence: AGG
actgtgcactgcctgaggtt

SEQ ID NO: 80924 - DNA, 20 bp, Artificial Sequence
  Description of Artificial Sequence: Synthetic oligonucleotide
  Target: ATXN1; (-) strand; PAM type: NRG; PAM sequence: TAG
aactgtgcactgcctgaggt

SEQ ID NO: 80925 - DNA, 20 bp, Artificial Sequence
  Description of Artificial Sequence: Synthetic oligonucleotide
  Target: ATXN1; (-) strand; PAM type: NRG; PAM sequence: AGG
ggagaactgtgcactgcctg

SEQ ID NO: 80926 - DNA, 20 bp, Artificial Sequence
  Description of Artificial Sequence: Synthetic oligonucleotide
  Target: ATXN1; (-) strand; PAM type: NRG; PAM sequence: GAG
gggagaactgtgcactgcct

SEQ ID NO: 80927 - DNA, 20 bp, Artificial Sequence
  Description of Artificial Sequence: Synthetic oligonucleotide
  Target: ATXN1; (-) strand; PAM type: NRG; PAM sequence: GAG
gggcgagtgacttttattgg

SEQ ID NO: 80928 - DNA, 20 bp, Artificial Sequence
  Description of Artificial Sequence: Synthetic oligonucleotide
  Target: ATXN1; (-) strand; PAM type: NRG; PAM sequence: GGG
acgggcgagtgacttttatt

SEQ ID NO: 80929 - DNA, 20 bp, Artificial Sequence
  Description of Artificial Sequence: Synthetic oligonucleotide
  Target: ATXN1; (-) strand; PAM type: NRG; PAM sequence: TGG
cacgggcgagtgacttttat

SEQ ID NO: 80930 - DNA, 20 bp, Artificial Sequence
  Description of Artificial Sequence: Synthetic oligonucleotide
  Target: ATXN1; (-) strand; PAM type: NRG; PAM sequence: GAG
gttcggtgatctccacgggc

SEQ ID NO: 80931 - DNA, 20 bp, Artificial Sequence
  Description of Artificial Sequence: Synthetic oligonucleotide
  Target: ATXN1; (-) strand; PAM type: NRG; PAM sequence: GGG
aggtgttcggtgatctccac

SEQ ID NO: 80932 - DNA, 20 bp, Artificial Sequence
  Description of Artificial Sequence: Synthetic oligonucleotide
  Target: ATXN1; (-) strand; PAM type: NRG; PAM sequence: CGG
caggtgttcggtgatctcca

SEQ ID NO: 80933 - DNA, 20 bp, Artificial Sequence
  Description of Artificial Sequence: Synthetic oligonucleotide
  Target: ATXN1; (-) strand; PAM type: NRG; PAM sequence: CGG
gtggtgtcaattcaggtgtt

SEQ ID NO: 80934 - DNA, 20 bp, Artificial Sequence
  Description of Artificial Sequence: Synthetic oligonucleotide
  Target: ATXN1; (-) strand; PAM type: NRG; PAM sequence: AGG
agtgcccgtggtgtcaattc

SEQ ID NO: 80935 - DNA, 20 bp, Artificial Sequence
  Description of Artificial Sequence: Synthetic oligonucleotide
  Target: ATXN1; (-) strand; PAM type: NRG; PAM sequence: CAG
aagtgcccgtggtgtcaatt

SEQ ID NO: 80936 - DNA, 20 bp, Artificial Sequence
  Description of Artificial Sequence: Synthetic oligonucleotide
  Target: ATXN1; (-) strand; PAM type: NRG; PAM sequence: TGG
acacaggttggaagtgcccg

SEQ ID NO: 80937 - DNA, 20 bp, Artificial Sequence
  Description of Artificial Sequence: Synthetic oligonucleotide
  Target: ATXN1; (-) strand; PAM type: NRG; PAM sequence: AAG
tggtcaggaacacaggttgg

SEQ ID NO: 80938 - DNA, 20 bp, Artificial Sequence
  Description of Artificial Sequence: Synthetic oligonucleotide
  Target: ATXN1; (-) strand; PAM type: NRG; PAM sequence: TGG
gggtggtcaggaacacaggt

SEQ ID NO: 80939 - DNA, 20 bp, Artificial Sequence
  Description of Artificial Sequence: Synthetic oligonucleotide
  Target: ATXN1; (-) strand; PAM type: NRG; PAM sequence: AGG
gggagggtggtcaggaacac

SEQ ID NO: 80940 - DNA, 20 bp, Artificial Sequence
  Description of Artificial Sequence: Synthetic oligonucleotide
  Target: ATXN1; (-) strand; PAM type: NRG; PAM sequence: CAG
ggggagggtggtcaggaaca

SEQ ID NO: 80941 - DNA, 20 bp, Artificial Sequence
  Description of Artificial Sequence: Synthetic oligonucleotide
  Target: ATXN1; (-) strand; PAM type: NRG; PAM sequence: AGG
aggtcatggggagggtggtc

SEQ ID NO: 80942 - DNA, 20 bp, Artificial Sequence
  Description of Artificial Sequence: Synthetic oligonucleotide
  Target: ATXN1; (-) strand; PAM type: NRG; PAM sequence: CAG
caggtcatggggagggtggt

SEQ ID NO: 80943 - DNA, 20 bp, Artificial Sequence
  Description of Artificial Sequence: Synthetic oligonucleotide
  Target: ATXN1; (-) strand; PAM type: NRG; PAM sequence: TGG
gaggcaggtcatggggaggg

SEQ ID NO: 80944 - DNA, 20 bp, Artificial Sequence
  Description of Artificial Sequence: Synthetic oligonucleotide
  Target: ATXN1; (-) strand; PAM type: NRG; PAM sequence: GGG
agggaggcaggtcatgggga

SEQ ID NO: 80945 - DNA, 20 bp, Artificial Sequence
  Description of Artificial Sequence: Synthetic oligonucleotide
  Target: ATXN1; (-) strand; PAM type: NRG; PAM sequence: AGG
aagggaggcaggtcatgggg

SEQ ID NO: 80946 - DNA, 20 bp, Artificial Sequence
  Description of Artificial Sequence: Synthetic oligonucleotide
  Target: ATXN1; (-) strand; PAM type: NRG; PAM sequence: GAG
taagggaggcaggtcatggg

SEQ ID NO: 80947 - DNA, 20 bp, Artificial Sequence
  Description of Artificial Sequence: Synthetic oligonucleotide
  Target: ATXN1; (-) strand; PAM type: NRG; PAM sequence: GGG
tgtaagggaggcaggtcatg

SEQ ID NO: 80948 - DNA, 20 bp, Artificial Sequence
  Description of Artificial Sequence: Synthetic oligonucleotide
  Target: ATXN1; (-) strand; PAM type: NRG; PAM sequence: GGG
atgtaagggaggcaggtcat

SEQ ID NO: 80949 - DNA, 20 bp, Artificial Sequence
  Description of Artificial Sequence: Synthetic oligonucleotide
  Target: ATXN1; (-) strand; PAM type: NRG; PAM sequence: TGG
gatgtaagggaggcaggtca

SEQ ID NO: 80950 - DNA, 20 bp, Artificial Sequence
  Description of Artificial Sequence: Synthetic oligonucleotide
  Target: ATXN1; (-) strand; PAM type: NRG; PAM sequence: AGG
agaaatgatgtaagggaggc

SEQ ID NO: 80951 - DNA, 20 bp, Artificial Sequence
  Description of Artificial Sequence: Synthetic oligonucleotide
  Target: ATXN1; (-) strand; PAM type: NRG; PAM sequence: CAG
cagaaatgatgtaagggagg

SEQ ID NO: 80952 - DNA, 20 bp, Artificial Sequence
  Description of Artificial Sequence: Synthetic oligonucleotide
  Target: ATXN1; (-) strand; PAM type: NRG; PAM sequence: AGG
aaacagaaatgatgtaaggg

SEQ ID NO: 80953 - DNA, 20 bp, Artificial Sequence
  Description of Artificial Sequence: Synthetic oligonucleotide
  Target: ATXN1; (-) strand; PAM type: NRG; PAM sequence: GAG
aaaacagaaatgatgtaagg

SEQ ID NO: 80954 - DNA, 20 bp, Artificial Sequence
  Description of Artificial Sequence: Synthetic oligonucleotide
  Target: ATXN1; (-) strand; PAM type: NRG; PAM sequence: GGG
ggaaaacagaaatgatgtaa

SEQ ID NO: 80955 - DNA, 20 bp, Artificial Sequence
  Description of Artificial Sequence: Synthetic oligonucleotide
  Target: ATXN1; (-) strand; PAM type: NRG; PAM sequence: AGG
aggaaaacagaaatgatgta

SEQ ID NO: 80956 - DNA, 20 bp, Artificial Sequence
  Description of Artificial Sequence: Synthetic oligonucleotide
  Target: ATXN1; (-) strand; PAM type: NRG; PAM sequence: AAG
aaggaaaacagaaatgatgt

SEQ ID NO: 80957 - DNA, 20 bp, Artificial Sequence
  Description of Artificial Sequence: Synthetic oligonucleotide
  Target: ATXN1; (-) strand; PAM type: NRG; PAM sequence: CAG
aggaccatgggaaaggaaaa

SEQ ID NO: 80958 - DNA, 20 bp, Artificial Sequence
  Description of Artificial Sequence: Synthetic oligonucleotide
  Target: ATXN1; (-) strand; PAM type: NRG; PAM sequence: AGG
aagtcacaggaccatgggaa

SEQ ID NO: 80959 - DNA, 20 bp, Artificial Sequence
  Description of Artificial Sequence: Synthetic oligonucleotide
  Target: ATXN1; (-) strand; PAM type: NRG; PAM sequence: AAG
gaagtcacaggaccatggga

SEQ ID NO: 80960 - DNA, 20 bp, Artificial Sequence
  Description of Artificial Sequence: Synthetic oligonucleotide
  Target: ATXN1; (-) strand; PAM type: NRG; PAM sequence: GGG
aagagaagtcacaggaccat

SEQ ID NO: 80961 - DNA, 20 bp, Artificial Sequence
  Description of Artificial Sequence: Synthetic oligonucleotide
  Target: ATXN1; (-) strand; PAM type: NRG; PAM sequence: TGG
taagagaagtcacaggacca

SEQ ID NO: 80962 - DNA, 20 bp, Artificial Sequence
  Description of Artificial Sequence: Synthetic oligonucleotide
  Target: ATXN1; (-) strand; PAM type: NRG; PAM sequence: AGG
gaaagagtaagagaagtcac

SEQ ID NO: 80963 - DNA, 20 bp, Artificial Sequence
  Description of Artificial Sequence: Synthetic oligonucleotide
  Target: ATXN1; (-) strand; PAM type: NRG; PAM sequence: CAG
tgaaagagtaagagaagtca

SEQ ID NO: 80964 - DNA, 20 bp, Artificial Sequence
  Description of Artificial Sequence: Synthetic oligonucleotide
  Target: ATXN1; (-) strand; PAM type: NRG; PAM sequence: AAG
tgcatttgaaagagtaagag

SEQ ID NO: 80965 - DNA, 20 bp, Artificial Sequence
  Description of Artificial Sequence: Synthetic oligonucleotide
  Target: ATXN1; (-) strand; PAM type: NRG; PAM sequence: GAG
ttttgcatttgaaagagtaa

SEQ ID NO: 80966 - DNA, 20 bp, Artificial Sequence
  Description of Artificial Sequence: Synthetic oligonucleotide
  Target: ATXN1; (-) strand; PAM type: NRG; PAM sequence: AAG
cattttgcatttgaaagagt

SEQ ID NO: 80967 - DNA, 20 bp, Artificial Sequence
  Description of Artificial Sequence: Synthetic oligonucleotide
  Target: ATXN1; (-) strand; PAM type: NRG; PAM sequence: GAG
gtgacattttgcatttgaaa

SEQ ID NO: 80968 - DNA, 20 bp, Artificial Sequence
  Description of Artificial Sequence: Synthetic oligonucleotide
  Target: ATXN1; (-) strand; PAM type: NRG; PAM sequence: AAG
ctgtgacattttgcatttga

SEQ ID NO: 80969 - DNA, 20 bp, Artificial Sequence
  Description of Artificial Sequence: Synthetic oligonucleotide
  Target: ATXN1; (-) strand; PAM type: NRG; PAM sequence: CAG
ccttggaggttccttccctt

SEQ ID NO: 80970 - DNA, 20 bp, Artificial Sequence
  Description of Artificial Sequence: Synthetic oligonucleotide
  Target: ATXN1; (-) strand; PAM type: NRG; PAM sequence: AGG
gtagcccagatcatccttgg

SEQ ID NO: 80971 - DNA, 20 bp, Artificial Sequence
  Description of Artificial Sequence: Synthetic oligonucleotide
  Target: ATXN1; (-) strand; PAM type: NRG; PAM sequence: GAG
agtagcccagatcatccttg

SEQ ID NO: 80972 - DNA, 20 bp, Artificial Sequence
  Description of Artificial Sequence: Synthetic oligonucleotide
  Target: ATXN1; (-) strand; PAM type: NRG; PAM sequence: TGG
gcagtagcccagatcatcct

SEQ ID NO: 80973 - DNA, 20 bp, Artificial Sequence
  Description of Artificial Sequence: Synthetic oligonucleotide
  Target: ATXN1; (-) strand; PAM type: NRG; PAM sequence: CAG
tgaagaagaaagcagtagcc

SEQ ID NO: 80974 - DNA, 20 bp, Artificial Sequence
  Description of Artificial Sequence: Synthetic oligonucleotide
  Target: ATXN1; (-) strand; PAM type: NRG; PAM sequence: TAG
ccctatgaagaagaaagcag

SEQ ID NO: 80975 - DNA, 20 bp, Artificial Sequence
  Description of Artificial Sequence: Synthetic oligonucleotide
  Target: ATXN1; (-) strand; PAM type: NRG; PAM sequence: CAG
ctcccctatgaagaagaaag

SEQ ID NO: 80976 - DNA, 20 bp, Artificial Sequence
  Description of Artificial Sequence: Synthetic oligonucleotide
  Target: ATXN1; (-) strand; PAM type: NRG; PAM sequence: AAG
ttcctcccctatgaagaaga

SEQ ID NO: 80977 - DNA, 20 bp, Artificial Sequence
  Description of Artificial Sequence: Synthetic oligonucleotide
  Target: ATXN1; (-) strand; PAM type: NRG; PAM sequence: AAG
cagtttcctcccctatgaag

SEQ ID NO: 80978 - DNA, 20 bp, Artificial Sequence
  Description of Artificial Sequence: Synthetic oligonucleotide
  Target: ATXN1; (-) strand; PAM type: NRG; PAM sequence: AAG
tctcagtttcctcccctatg

SEQ ID NO: 80979 - DNA, 20 bp, Artificial Sequence
  Description of Artificial Sequence: Synthetic oligonucleotide
  Target: ATXN1; (-) strand; PAM type: NRG; PAM sequence: CAG
taccaacctctctggaatct

SEQ ID NO: 80980 - DNA, 20 bp, Artificial Sequence
  Description of Artificial Sequence: Synthetic oligonucleotide
  Target: ATXN1; (-) strand; PAM type: NRG; PAM sequence: TGG
gggaaagttaccaacctctc

SEQ ID NO: 80981 - DNA, 20 bp, Artificial Sequence
  Description of Artificial Sequence: Synthetic oligonucleotide
  Target: ATXN1; (-) strand; PAM type: NRG; PAM sequence: AAG
ctaattttgtaaccttggga

SEQ ID NO: 80982 - DNA, 20 bp, Artificial Sequence
  Description of Artificial Sequence: Synthetic oligonucleotide
  Target: ATXN1; (-) strand; PAM type: NRG; PAM sequence: GGG
actgctaattttgtaacctt

SEQ ID NO: 80983 - DNA, 20 bp, Artificial Sequence
  Description of Artificial Sequence: Synthetic oligonucleotide
  Target: ATXN1; (-) strand; PAM type: NRG; PAM sequence: TGG
cactgctaattttgtaacct

SEQ ID NO: 80984 - DNA, 20 bp, Artificial Sequence
  Description of Artificial Sequence: Synthetic oligonucleotide
  Target: ATXN1; (-) strand; PAM type: NRG; PAM sequence: CGG
cacaatgtaggtttcagttc

SEQ ID NO: 80985 - DNA, 20 bp, Artificial Sequence
  Description of Artificial Sequence: Synthetic oligonucleotide
  Target: ATXN1; (-) strand; PAM type: NRG; PAM sequence: CAG
tggtcacacaatgtaggttt

SEQ ID NO: 80986 - DNA, 20 bp, Artificial Sequence
  Description of Artificial Sequence: Synthetic oligonucleotide
  Target: ATXN1; (-) strand; PAM type: NRG; PAM sequence: AGG
ggagagtggtcacacaatgt

SEQ ID NO: 80987 - DNA, 20 bp, Artificial Sequence
  Description of Artificial Sequence: Synthetic oligonucleotide
  Target: ATXN1; (-) strand; PAM type: NRG; PAM sequence: TAG
aggagagtggtcacacaatg

SEQ ID NO: 80988 - DNA, 20 bp, Artificial Sequence
  Description of Artificial Sequence: Synthetic oligonucleotide
  Target: ATXN1; (-) strand; PAM type: NRG; PAM sequence: TGG
ttgctttgggaggaggagag

SEQ ID NO: 80989 - DNA, 20 bp, Artificial Sequence
  Description of Artificial Sequence: Synthetic oligonucleotide
  Target: ATXN1; (-) strand; PAM type: NRG; PAM sequence: GAG
aaattgctttgggaggagga

SEQ ID NO: 80990 - DNA, 20 bp, Artificial Sequence
  Description of Artificial Sequence: Synthetic oligonucleotide
  Target: ATXN1; (-) strand; PAM type: NRG; PAM sequence: GAG
ctaaattgctttgggaggag

SEQ ID NO: 80991 - DNA, 20 bp, Artificial Sequence
  Description of Artificial Sequence: Synthetic oligonucleotide
  Target: ATXN1; (-) strand; PAM type: NRG; PAM sequence: AGG
aactaaattgctttgggagg

SEQ ID NO: 80992 - DNA, 20 bp, Artificial Sequence
  Description of Artificial Sequence: Synthetic oligonucleotide
  Target: ATXN1; (-) strand; PAM type: NRG; PAM sequence: GAG
aaactaaattgctttgggag

SEQ ID NO: 80993 - DNA, 20 bp, Artificial Sequence
  Description of Artificial Sequence: Synthetic oligonucleotide
  Target: ATXN1; (-) strand; PAM type: NRG; PAM sequence: AGG
ggaaactaaattgctttggg

SEQ ID NO: 80994 - DNA, 20 bp, Artificial Sequence
  Description of Artificial Sequence: Synthetic oligonucleotide
  Target: ATXN1; (-) strand; PAM type: NRG; PAM sequence: GAG
tggaaactaaattgctttgg

SEQ ID NO: 80995 - DNA, 20 bp, Artificial Sequence
  Description of Artificial Sequence: Synthetic oligonucleotide
  Target: ATXN1; (-) strand; PAM type: NRG; PAM sequence: GGG
gttggaaactaaattgcttt

SEQ ID NO: 80996 - DNA, 20 bp, Artificial Sequence
  Description of Artificial Sequence: Synthetic oligonucleotide
  Target: ATXN1; (-) strand; PAM type: NRG; PAM sequence: TGG
agttggaaactaaattgctt

SEQ ID NO: 80997 - DNA, 20 bp, Artificial Sequence
  Description of Artificial Sequence: Synthetic oligonucleotide
  Target: ATXN1; (-) strand; PAM type: NRG; PAM sequence: TGG
gtaggcagatgaggtccagt

SEQ ID NO: 80998 - DNA, 20 bp, Artificial Sequence
  Description of Artificial Sequence: Synthetic oligonucleotide
  Target: ATXN1; (-) strand; PAM type: NRG; PAM sequence: CAG
acaagtaggcagatgaggtc

SEQ ID NO: 80999 - DNA, 20 bp, Artificial Sequence
  Description of Artificial Sequence: Synthetic oligonucleotide
  Target: ATXN1; (-) strand; PAM type: NRG; PAM sequence: AGG
gagaaacaagtaggcagatg

SEQ ID NO: 81000 - DNA, 20 bp, Artificial Sequence
  Description of Artificial Sequence: Synthetic oligonucleotide
  Target: ATXN1; (-) strand; PAM type: NRG; PAM sequence: GAG
ggagaaacaagtaggcagat

SEQ ID NO: 81001 - DNA, 20 bp, Artificial Sequence
  Description of Artificial Sequence: Synthetic oligonucleotide
  Target: ATXN1; (-) strand; PAM type: NRG; PAM sequence: CAG
ctgggggagaaacaagtagg

SEQ ID NO: 81002 - DNA, 20 bp, Artificial Sequence
  Description of Artificial Sequence: Synthetic oligonucleotide
  Target: ATXN1; (-) strand; PAM type: NRG; PAM sequence: AGG
gggctgggggagaaacaagt

SEQ ID NO: 81003 - DNA, 20 bp, Artificial Sequence
  Description of Artificial Sequence: Synthetic oligonucleotide
  Target: ATXN1; (-) strand; PAM type: NRG; PAM sequence: TAG
ggggctgggggagaaacaag

SEQ ID NO: 81004 - DNA, 20 bp, Artificial Sequence
  Description of Artificial Sequence: Synthetic oligonucleotide
  Target: ATXN1; (-) strand; PAM type: NRG; PAM sequence: AAG
ctgggggctgggggagaaac

SEQ ID NO: 81005 - DNA, 20 bp, Artificial Sequence
  Description of Artificial Sequence: Synthetic oligonucleotide
  Target: ATXN1; (-) strand; PAM type: NRG; PAM sequence: GAG
gggctgcctgggggctgggg

SEQ ID NO: 81006 - DNA, 20 bp, Artificial Sequence
  Description of Artificial Sequence: Synthetic oligonucleotide
  Target: ATXN1; (-) strand; PAM type: NRG; PAM sequence: GGG
aagggctgcctgggggctgg

SEQ ID NO: 81007 - DNA, 20 bp, Artificial Sequence
  Description of Artificial Sequence: Synthetic oligonucleotide
  Target: ATXN1; (-) strand; PAM type: NRG; PAM sequence: GGG
gaagggctgcctgggggctg

SEQ ID NO: 81008 - DNA, 20 bp, Artificial Sequence
  Description of Artificial Sequence: Synthetic oligonucleotide
  Target: ATXN1; (-) strand; PAM type: NRG; PAM sequence: GGG
tgaagggctgcctgggggct

SEQ ID NO: 81009 - DNA, 20 bp, Artificial Sequence
  Description of Artificial Sequence: Synthetic oligonucleotide
  Target: ATXN1; (-) strand; PAM type: NRG; PAM sequence: TGG
gtgaagggctgcctgggggc

SEQ ID NO: 81010 - DNA, 20 bp, Artificial Sequence
  Description of Artificial Sequence: Synthetic oligonucleotide
  Target: ATXN1; (-) strand; PAM type: NRG; PAM sequence: GGG
cacagtgaagggctgcctgg

SEQ ID NO: 81011 - DNA, 20 bp, Artificial Sequence
  Description of Artificial Sequence: Synthetic oligonucleotide
  Target: ATXN1; (-) strand; PAM type: NRG; PAM sequence: GGG
ccacagtgaagggctgcctg

SEQ ID NO: 81012 - DNA, 20 bp, Artificial Sequence
  Description of Artificial Sequence: Synthetic oligonucleotide
  Target: ATXN1; (-) strand; PAM type: NRG; PAM sequence: GGG
gccacagtgaagggctgcct

SEQ ID NO: 81013 - DNA, 20 bp, Artificial Sequence
  Description of Artificial Sequence: Synthetic oligonucleotide
  Target: ATXN1; (-) strand; PAM type: NRG; PAM sequence: TGG
agccacagtgaagggctgcc

SEQ ID NO: 81014 - DNA, 20 bp, Artificial Sequence
  Description of Artificial Sequence: Synthetic oligonucleotide
  Target: ATXN1; (-) strand; PAM type: NRG; PAM sequence: GGG
gactcagcagccacagtgaa

SEQ ID NO: 81015 - DNA, 20 bp, Artificial Sequence
  Description of Artificial Sequence: Synthetic oligonucleotide
  Target: ATXN1; (-) strand; PAM type: NRG; PAM sequence: AGG
tgactcagcagccacagtga

SEQ ID NO: 81016 - DNA, 20 bp, Artificial Sequence
  Description of Artificial Sequence: Synthetic oligonucleotide
  Target: ATXN1; (-) strand; PAM type: NRG; PAM sequence: AAG
atgactcagcagccacagtg

SEQ ID NO: 81017 - DNA, 20 bp, Artificial Sequence
  Description of Artificial Sequence: Synthetic oligonucleotide
  Target: ATXN1; (-) strand; PAM type: NRG; PAM sequence: CAG
tcctgatgactcagcagcca

SEQ ID NO: 81018 - DNA, 20 bp, Artificial Sequence
  Description of Artificial Sequence: Synthetic oligonucleotide
  Target: ATXN1; (-) strand; PAM type: NRG; PAM sequence: CAG
agctcatcctgatgactcag

SEQ ID NO: 81019 - DNA, 20 bp, Artificial Sequence
  Description of Artificial Sequence: Synthetic oligonucleotide
  Target: ATXN1; (-) strand; PAM type: NRG; PAM sequence: CAG
caaagctcatcctgatgact

SEQ ID NO: 81020 - DNA, 20 bp, Artificial Sequence
  Description of Artificial Sequence: Synthetic oligonucleotide
  Target: ATXN1; (-) strand; PAM type: NRG; PAM sequence: AAG
cagtggcttgcttgagaaca

SEQ ID NO: 81021 - DNA, 20 bp, Artificial Sequence
  Description of Artificial Sequence: Synthetic oligonucleotide
  Target: ATXN1; (-) strand; PAM type: NRG; PAM sequence: GAG
cctgtcccagtggcttgctt

SEQ ID NO: 81022 - DNA, 20 bp, Artificial Sequence
  Description of Artificial Sequence: Synthetic oligonucleotide
  Target: ATXN1; (-) strand; PAM type: NRG; PAM sequence: TGG
gacatgagggcctgtcccag

SEQ ID NO: 81023 - DNA, 20 bp, Artificial Sequence
  Description of Artificial Sequence: Synthetic oligonucleotide
  Target: ATXN1; (-) strand; PAM type: NRG; PAM sequence: CAG
caagacatgagggcctgtcc

SEQ ID NO: 81024 - DNA, 20 bp, Artificial Sequence
  Description of Artificial Sequence: Synthetic oligonucleotide
  Target: ATXN1; (-) strand; PAM type: NRG; PAM sequence: GGG
ttgtcctactcaagacatga

SEQ ID NO: 81025 - DNA, 20 bp, Artificial Sequence
  Description of Artificial Sequence: Synthetic oligonucleotide
  Target: ATXN1; (-) strand; PAM type: NRG; PAM sequence: AGG
tttgtcctactcaagacatg

SEQ ID NO: 81026 - DNA, 20 bp, Artificial Sequence
  Description of Artificial Sequence: Synthetic oligonucleotide
  Target: ATXN1; (-) strand; PAM type: NRG; PAM sequence: GAG
ctttgtcctactcaagacat

SEQ ID NO: 81027 - DNA, 20 bp, Artificial Sequence
  Description of Artificial Sequence: Synthetic oligonucleotide
  Target: ATXN1; (-) strand; PAM type: NRG; PAM sequence: AAG
aaatatactttgtcctactc

SEQ ID NO: 81028 - DNA, 20 bp, Artificial Sequence
  Description of Artificial Sequence: Synthetic oligonucleotide
  Target: ATXN1; (-) strand; PAM type: NRG; PAM sequence: TGG
ggtgaccacaaagtggggag

SEQ ID NO: 81029 - DNA, 20 bp, Artificial Sequence
  Description of Artificial Sequence: Synthetic oligonucleotide
  Target: ATXN1; (-) strand; PAM type: NRG; PAM sequence: GAG
cagggtgaccacaaagtggg

SEQ ID NO: 81030 - DNA, 20 bp, Artificial Sequence
  Description of Artificial Sequence: Synthetic oligonucleotide
  Target: ATXN1; (-) strand; PAM type: NRG; PAM sequence: GGG
agcagggtgaccacaaagtg

SEQ ID NO: 81031 - DNA, 20 bp, Artificial Sequence
  Description of Artificial Sequence: Synthetic oligonucleotide
  Target: ATXN1; (-) strand; PAM type: NRG; PAM sequence: GGG
gagcagggtgaccacaaagt

SEQ ID NO: 81032 - DNA, 20 bp, Artificial Sequence
  Description of Artificial Sequence: Synthetic oligonucleotide
  Target: ATXN1; (-) strand; PAM type: NRG; PAM sequence: TGG
agagcagggtgaccacaaag

SEQ ID NO: 81033 - DNA, 20 bp, Artificial Sequence
  Description of Artificial Sequence: Synthetic oligonucleotide
  Target: ATXN1; (-) strand; PAM type: NRG; PAM sequence: AAG
ggcagagcagggtgaccaca

SEQ ID NO: 81034 - DNA, 20 bp, Artificial Sequence
  Description of Artificial Sequence: Synthetic oligonucleotide
  Target: ATXN1; (-) strand; PAM type: NRG; PAM sequence: GGG
cccatgcatcaggcagagca

SEQ ID NO: 81035 - DNA, 20 bp, Artificial Sequence
  Description of Artificial Sequence: Synthetic oligonucleotide
  Target: ATXN1; (-) strand; PAM type: NRG; PAM sequence: AGG
gcccatgcatcaggcagagc

SEQ ID NO: 81036 - DNA, 20 bp, Artificial Sequence
  Description of Artificial Sequence: Synthetic oligonucleotide
  Target: ATXN1; (-) strand; PAM type: NRG; PAM sequence: CAG
tgcccatgcatcaggcagag

SEQ ID NO: 81037 - DNA, 20 bp, Artificial Sequence
  Description of Artificial Sequence: Synthetic oligonucleotide
  Target: ATXN1; (-) strand; PAM type: NRG; PAM sequence: GAG
aggtgcccatgcatcaggca

SEQ ID NO: 81038 - DNA, 20 bp, Artificial Sequence
  Description of Artificial Sequence: Synthetic oligonucleotide
  Target: ATXN1; (-) strand; PAM type: NRG; PAM sequence: CAG
gaaggtgcccatgcatcagg

SEQ ID NO: 81039 - DNA, 20 bp, Artificial Sequence
  Description of Artificial Sequence: Synthetic oligonucleotide
  Target: ATXN1; (-) strand; PAM type: NRG; PAM sequence: AGG
gcagaaggtgcccatgcatc

SEQ ID NO: 81040 - DNA, 20 bp, Artificial Sequence
  Description of Artificial Sequence: Synthetic oligonucleotide
  Target: ATXN1; (-) strand; PAM type: NRG; PAM sequence: CAG
ggcagaaggtgcccatgcat

SEQ ID NO: 81041 - DNA, 20 bp, Artificial Sequence
  Description of Artificial Sequence: Synthetic oligonucleotide
  Target: ATXN1; (-) strand; PAM type: NRG; PAM sequence: AGG
tgacagttgtcatgggcaga

SEQ ID NO: 81042 - DNA, 20 bp, Artificial Sequence
  Description of Artificial Sequence: Synthetic oligonucleotide
  Target: ATXN1; (-) strand; PAM type: NRG; PAM sequence: AAG
atgacagttgtcatgggcag

SEQ ID NO: 81043 - DNA, 20 bp, Artificial Sequence
  Description of Artificial Sequence: Synthetic oligonucleotide
  Target: ATXN1; (-) strand; PAM type: NRG; PAM sequence: CAG
cgaatgacagttgtcatggg

SEQ ID NO: 81044 - DNA, 20 bp, Artificial Sequence
  Description of Artificial Sequence: Synthetic oligonucleotide
  Target: ATXN1; (-) strand; PAM type: NRG; PAM sequence: GGG
gggcgaatgacagttgtcat

SEQ ID NO: 81045 - DNA, 20 bp, Artificial Sequence
  Description of Artificial Sequence: Synthetic oligonucleotide
  Target: ATXN1; (-) strand; PAM type: NRG; PAM sequence: TGG
agggcgaatgacagttgtca

SEQ ID NO: 81046 - DNA, 20 bp, Artificial Sequence
  Description of Artificial Sequence: Synthetic oligonucleotide
  Target: ATXN1; (-) strand; PAM type: NRG; PAM sequence: CAG
agactattcagggcgaatga

SEQ ID NO: 81047 - DNA, 20 bp, Artificial Sequence
  Description of Artificial Sequence: Synthetic oligonucleotide
  Target: ATXN1; (-) strand; PAM type: NRG; PAM sequence: GGG
gtgatggcatagactattca

SEQ ID NO: 81048 - DNA, 20 bp, Artificial Sequence
  Description of Artificial Sequence: Synthetic oligonucleotide
  Target: ATXN1; (-) strand; PAM type: NRG; PAM sequence: AGG
tgtgatggcatagactattc

SEQ ID NO: 81049 - DNA, 20 bp, Artificial Sequence
  Description of Artificial Sequence: Synthetic oligonucleotide
  Target: ATXN1; (-) strand; PAM type: NRG; PAM sequence: CAG
gtgtgatggcatagactatt

SEQ ID NO: 81050 - DNA, 20 bp, Artificial Sequence
  Description of Artificial Sequence: Synthetic oligonucleotide
  Target: ATXN1; (-) strand; PAM type: NRG; PAM sequence: TAG
cataaggaggtgtgatggca

SEQ ID NO: 81051 - DNA, 20 bp, Artificial Sequence
  Description of Artificial Sequence: Synthetic oligonucleotide
  Target: ATXN1; (-) strand; PAM type: NRG; PAM sequence: TGG
gtagccataaggaggtgtga

SEQ ID NO: 81052 - DNA, 20 bp, Artificial Sequence
  Description of Artificial Sequence: Synthetic oligonucleotide
  Target: ATXN1; (-) strand; PAM type: NRG; PAM sequence: AGG
ttatgttagtagccataagg

SEQ ID NO: 81053 - DNA, 20 bp, Artificial Sequence
  Description of Artificial Sequence: Synthetic oligonucleotide
  Target: ATXN1; (-) strand; PAM type: NRG; PAM sequence: GAG
tttatgttagtagccataag

SEQ ID NO: 81054 - DNA, 20 bp, Artificial Sequence
  Description of Artificial Sequence: Synthetic oligonucleotide
  Target: ATXN1; (-) strand; PAM type: NRG; PAM sequence: AGG
cttttatgttagtagccata

SEQ ID NO: 81055 - DNA, 20 bp, Artificial Sequence
  Description of Artificial Sequence: Synthetic oligonucleotide
  Target: ATXN1; (-) strand; PAM type: NRG; PAM sequence: AAG
ccttttatgttagtagccat

SEQ ID NO: 81056 - DNA, 20 bp, Artificial Sequence
  Description of Artificial Sequence: Synthetic oligonucleotide
  Target: ATXN1; (-) strand; PAM type: NRG; PAM sequence: TAG
tcacttaccttttatgttag

SEQ ID NO: 81057 - DNA, 20 bp, Artificial Sequence
  Description of Artificial Sequence: Synthetic oligonucleotide
  Target: ATXN1; (-) strand; PAM type: NRG; PAM sequence: TAG
tagtcacttaccttttatgt

SEQ ID NO: 81058 - DNA, 20 bp, Artificial Sequence
  Description of Artificial Sequence: Synthetic oligonucleotide
  Target: ATXN1; (-) strand; PAM type: NRG; PAM sequence: TAG
taattcatgataccatttat

SEQ ID NO: 81059 - DNA, 20 bp, Artificial Sequence
  Description of Artificial Sequence: Synthetic oligonucleotide
  Target: ATXN1; (-) strand; PAM type: NRG; PAM sequence: AGG
caaatatttgtctgtataaa

SEQ ID NO: 81060 - DNA, 20 bp, Artificial Sequence
  Description of Artificial Sequence: Synthetic oligonucleotide
  Target: ATXN1; (-) strand; PAM type: NRG; PAM sequence: AAG
tcaaatatttgtctgtataa

SEQ ID NO: 81061 - DNA, 20 bp, Artificial Sequence
  Description of Artificial Sequence: Synthetic oligonucleotide
  Target: ATXN1; (-) strand; PAM type: NRG; PAM sequence: AGG
atcccaagaaaatataactg

SEQ ID NO: 81062 - DNA, 20 bp, Artificial Sequence
  Description of Artificial Sequence: Synthetic oligonucleotide
  Target: ATXN1; (-) strand; PAM type: NRG; PAM sequence: GAG
gatcccaagaaaatataact

SEQ ID NO: 81063 - DNA, 20 bp, Artificial Sequence
  Description of Artificial Sequence: Synthetic oligonucleotide
  Target: ATXN1; (-) strand; PAM type: NRG; PAM sequence: AAG
acctgggaagaaaagatccc

SEQ ID NO: 81064 - DNA, 20 bp, Artificial Sequence
  Description of Artificial Sequence: Synthetic oligonucleotide
  Target: ATXN1; (-) strand; PAM type: NRG; PAM sequence: AAG
ctgctatgacctgggaagaa

SEQ ID NO: 81065 - DNA, 20 bp, Artificial Sequence
  Description of Artificial Sequence: Synthetic oligonucleotide
  Target: ATXN1; (-) strand; PAM type: NRG; PAM sequence: AAG
cagcactgctatgacctggg

SEQ ID NO: 81066 - DNA, 20 bp, Artificial Sequence
  Description of Artificial Sequence: Synthetic oligonucleotide
  Target: ATXN1; (-) strand; PAM type: NRG; PAM sequence: GGG
aaacagcactgctatgacct

SEQ ID NO: 81067 - DNA, 20 bp, Artificial Sequence
  Description of Artificial Sequence: Synthetic oligonucleotide
  Target: ATXN1; (-) strand; PAM type: NRG; PAM sequence: TGG
gaaacagcactgctatgacc

SEQ ID NO: 81068 - DNA, 20 bp, Artificial Sequence
  Description of Artificial Sequence: Synthetic oligonucleotide
  Target: ATXN1; (-) strand; PAM type: NRG; PAM sequence: CAG
tatgacatttcctgttgaaa

SEQ ID NO: 81069 - DNA, 20 bp, Artificial Sequence
  Description of Artificial Sequence: Synthetic oligonucleotide
  Target: ATXN1; (-) strand; PAM type: NRG; PAM sequence: AAG
ttaaagtgcacctggcattc

SEQ ID NO: 81070 - DNA, 20 bp, Artificial Sequence
  Description of Artificial Sequence: Synthetic oligonucleotide
  Target: ATXN1; (-) strand; PAM type: NRG; PAM sequence: TGG
attattttttaaagtgcacc

SEQ ID NO: 81071 - DNA, 20 bp, Artificial Sequence
  Description of Artificial Sequence: Synthetic oligonucleotide
  Target: ATXN1; (-) strand; PAM type: NRG; PAM sequence: AAG
ttagtttagattatttttta

SEQ ID NO: 81072 - DNA, 20 bp, Artificial Sequence
  Description of Artificial Sequence: Synthetic oligonucleotide
  Target: ATXN1; (-) strand; PAM type: NRG; PAM sequence: TAG
gtgtaaaagctaatttagtt

SEQ ID NO: 81073 - DNA, 20 bp, Artificial Sequence
  Description of Artificial Sequence: Synthetic oligonucleotide
  Target: ATXN1; (-) strand; PAM type: NRG; PAM sequence: TAG
gttaggtgtaaaagctaatt

SEQ ID NO: 81074 - DNA, 20 bp, Artificial Sequence
  Description of Artificial Sequence: Synthetic oligonucleotide
  Target: ATXN1; (-) strand; PAM type: NRG; PAM sequence: AAG
caggccgtcgttaggtgtaa

SEQ ID NO: 81075 - DNA, 20 bp, Artificial Sequence
  Description of Artificial Sequence: Synthetic oligonucleotide
  Target: ATXN1; (-) strand; PAM type: NRG; PAM sequence: AGG
attattcccaggccgtcgtt

SEQ ID NO: 81076 - DNA, 20 bp, Artificial Sequence
  Description of Artificial Sequence: Synthetic oligonucleotide
  Target: ATXN1; (-) strand; PAM type: NRG; PAM sequence: TAG
tattattcccaggccgtcgt

SEQ ID NO: 81077 - DNA, 20 bp, Artificial Sequence
  Description of Artificial Sequence: Synthetic oligonucleotide
  Target: ATXN1; (-) strand; PAM type: NRG; PAM sequence: AGG
agagttcctttattattccc

SEQ ID NO: 81078 - DNA, 20 bp, Artificial Sequence
  Description of Artificial Sequence: Synthetic oligonucleotide
  Target: ATXN1; (-) strand; PAM type: NRG; PAM sequence: CAG
aagagttcctttattattcc

SEQ ID NO: 81079 - DNA, 20 bp, Artificial Sequence
  Description of Artificial Sequence: Synthetic oligonucleotide
  Target: ATXN1; (-) strand; PAM type: NRG; PAM sequence: GAG
cactttcttcctttttcaaa

SEQ ID NO: 81080 - DNA, 20 bp, Artificial Sequence
  Description of Artificial Sequence: Synthetic oligonucleotide
  Target: ATXN1; (-) strand; PAM type: NRG; PAM sequence: AAG
tccactttcttcctttttca

SEQ ID NO: 81081 - DNA, 20 bp, Artificial Sequence
  Description of Artificial Sequence: Synthetic oligonucleotide
  Target: ATXN1; (-) strand; PAM type: NRG; PAM sequence: AAG
caggcccaccaacagtgtaa

SEQ ID NO: 81082 - DNA, 20 bp, Artificial Sequence
  Description of Artificial Sequence: Synthetic oligonucleotide
  Target: ATXN1; (-) strand; PAM type: NRG; PAM sequence: CAG
ctagtttgcaggcccaccaa

SEQ ID NO: 81083 - DNA, 20 bp, Artificial Sequence
  Description of Artificial Sequence: Synthetic oligonucleotide
  Target: ATXN1; (-) strand; PAM type: NRG; PAM sequence: AGG
caatggttgaactagtttgc

SEQ ID NO: 81084 - DNA, 20 bp, Artificial Sequence
  Description of Artificial Sequence: Synthetic oligonucleotide
  Target: ATXN1; (-) strand; PAM type: NRG; PAM sequence: CAG
acaatggttgaactagtttg

SEQ ID NO: 81085 - DNA, 20 bp, Artificial Sequence
  Description of Artificial Sequence: Synthetic oligonucleotide
  Target: ATXN1; (-) strand; PAM type: NRG; PAM sequence: TAG
gtcttccacaatggttgaac

SEQ ID NO: 81086 - DNA, 20 bp, Artificial Sequence
  Description of Artificial Sequence: Synthetic oligonucleotide
  Target: ATXN1; (-) strand; PAM type: NRG; PAM sequence: TGG
cgccacactgtcttccacaa

SEQ ID NO: 81087 - DNA, 20 bp, Artificial Sequence
  Description of Artificial Sequence: Synthetic oligonucleotide
  Target: ATXN1; (-) strand; PAM type: NRG; PAM sequence: AGG
tttctagttctagatccttg

SEQ ID NO: 81088 - DNA, 20 bp, Artificial Sequence
  Description of Artificial Sequence: Synthetic oligonucleotide
  Target: ATXN1; (-) strand; PAM type: NRG; PAM sequence: GAG
atttctagttctagatcctt

SEQ ID NO: 81089 - DNA, 20 bp, Artificial Sequence
  Description of Artificial Sequence: Synthetic oligonucleotide
  Target: ATXN1; (-) strand; PAM type: NRG; PAM sequence: TAG
tcaaatggtatttctagttc

SEQ ID NO: 81090 - DNA, 20 bp, Artificial Sequence
  Description of Artificial Sequence: Synthetic oligonucleotide
  Target: ATXN1; (-) strand; PAM type: NRG; PAM sequence: TAG
gctgggtcaaatggtatttc

SEQ ID NO: 81091 - DNA, 20 bp, Artificial Sequence
  Description of Artificial Sequence: Synthetic oligonucleotide
  Target: ATXN1; (-) strand; PAM type: NRG; PAM sequence: TGG
aatgggatggctgggtcaaa

SEQ ID NO: 81092 - DNA, 20 bp, Artificial Sequence
  Description of Artificial Sequence: Synthetic oligonucleotide
  Target: ATXN1; (-) strand; PAM type: NRG; PAM sequence: GGG
tccccagtaatgggatggct

SEQ ID NO: 81093 - DNA, 20 bp, Artificial Sequence
  Description of Artificial Sequence: Synthetic oligonucleotide
  Target: ATXN1; (-) strand; PAM type: NRG; PAM sequence: TGG
atccccagtaatgggatggc

SEQ ID NO: 81094 - DNA, 20 bp, Artificial Sequence
  Description of Artificial Sequence: Synthetic oligonucleotide
  Target: ATXN1; (-) strand; PAM type: NRG; PAM sequence: TGG
gtatatccccagtaatggga

SEQ ID NO: 81095 - DNA, 20 bp, Artificial Sequence
  Description of Artificial Sequence: Synthetic oligonucleotide
  Target: ATXN1; (-) strand; PAM type: NRG; PAM sequence: GGG
ttgggtatatccccagtaat

SEQ ID NO: 81096 - DNA, 20 bp, Artificial Sequence
  Description of Artificial Sequence: Synthetic oligonucleotide
  Target: ATXN1; (-) strand; PAM type: NRG; PAM sequence: TGG
tttgggtatatccccagtaa

SEQ ID NO: 81097 - DNA, 20 bp, Artificial Sequence
  Description of Artificial Sequence: Synthetic oligonucleotide
  Target: ATXN1; (-) strand; PAM type: NRG; PAM sequence: CAG
taatcctttgggtatatccc

SEQ ID NO: 81098 - DNA, 20 bp, Artificial Sequence
  Description of Artificial Sequence: Synthetic oligonucleotide
  Target: ATXN1; (-) strand; PAM type: NRG; PAM sequence: GGG
agcatgatttataatccttt

SEQ ID NO: 81099 - DNA, 20 bp, Artificial Sequence
  Description of Artificial Sequence: Synthetic oligonucleotide
  Target: ATXN1; (-) strand; PAM type: NRG; PAM sequence: TGG
cagcatgatttataatcctt

SEQ ID NO: 81100 - DNA, 20 bp, Artificial Sequence
  Description of Artificial Sequence: Synthetic oligonucleotide
  Target: ATXN1; (-) strand; PAM type: NRG; PAM sequence: CAG
gtgcgcatgtgcctttatag

SEQ ID NO: 81101 - DNA, 20 bp, Artificial Sequence
  Description of Artificial Sequence: Synthetic oligonucleotide
  Target: ATXN1; (-) strand; PAM type: NRG; PAM sequence: TAG
tacgtgcgcatgtgccttta

SEQ ID NO: 81102 - DNA, 20 bp, Artificial Sequence
  Description of Artificial Sequence: Synthetic oligonucleotide
  Target: ATXN1; (-) strand; PAM type: NRG; PAM sequence: TAG
caagtctttgctattgtgaa

SEQ ID NO: 81103 - DNA, 20 bp, Artificial Sequence
  Description of Artificial Sequence: Synthetic oligonucleotide
  Target: ATXN1; (-) strand; PAM type: NRG; PAM sequence: AAG
tggacatttgggttggttcc

SEQ ID NO: 81104 - DNA, 20 bp, Artificial Sequence
  Description of Artificial Sequence: Synthetic oligonucleotide
  Target: ATXN1; (-) strand; PAM type: NRG; PAM sequence: TGG
tcattgatggacatttgggt

SEQ ID NO: 81105 - DNA, 20 bp, Artificial Sequence
  Description of Artificial Sequence: Synthetic oligonucleotide
  Target: ATXN1; (-) strand; PAM type: NRG; PAM sequence: GGG
tctatcattgatggacattt

SEQ ID NO: 81106 - DNA, 20 bp, Artificial Sequence
  Description of Artificial Sequence: Synthetic oligonucleotide
  Target: ATXN1; (-) strand; PAM type: NRG; PAM sequence: TGG
gtctatcattgatggacatt

SEQ ID NO: 81107 - DNA, 20 bp, Artificial Sequence
  Description of Artificial Sequence: Synthetic oligonucleotide
  Target: ATXN1; (-) strand; PAM type: NRG; PAM sequence: TGG
ttaatccagtctatcattga

SEQ ID NO: 81108 - DNA, 20 bp, Artificial Sequence
  Description of Artificial Sequence: Synthetic oligonucleotide
  Target: ATXN1; (-) strand; PAM type: NRG; PAM sequence: CAG
tgtgccacattttcttaatc

SEQ ID NO: 81109 - DNA, 20 bp, Artificial Sequence
  Description of Artificial Sequence: Synthetic oligonucleotide
  Target: ATXN1; (-) strand; PAM type: NRG; PAM sequence: TGG
tatggctacatagtattcca

SEQ ID NO: 81110 - DNA, 20 bp, Artificial Sequence
  Description of Artificial Sequence: Synthetic oligonucleotide
  Target: ATXN1; (-) strand; PAM type: NRG; PAM sequence: TAG
catccttttttatggctaca

SEQ ID NO: 81111 - DNA, 20 bp, Artificial Sequence
  Description of Artificial Sequence: Synthetic oligonucleotide
  Target: ATXN1; (-) strand; PAM type: NRG; PAM sequence: TGG
catgaactcatcctttttta

SEQ ID NO: 81112 - DNA, 20 bp, Artificial Sequence
  Description of Artificial Sequence: Synthetic oligonucleotide
  Target: ATXN1; (-) strand; PAM type: NRG; PAM sequence: AGG
cttcatccatgtcccaacaa

SEQ ID NO: 81113 - DNA, 20 bp, Artificial Sequence
  Description of Artificial Sequence: Synthetic oligonucleotide
  Target: ATXN1; (-) strand; PAM type: NRG; PAM sequence: AAG
gcttcatccatgtcccaaca

SEQ ID NO: 81114 - DNA, 20 bp, Artificial Sequence
  Description of Artificial Sequence: Synthetic oligonucleotide
  Target: ATXN1; (-) strand; PAM type: NRG; PAM sequence: CAG
ttgctgagaatgatggtttc

SEQ ID NO: 81115 - DNA, 20 bp, Artificial Sequence
  Description of Artificial Sequence: Synthetic oligonucleotide
  Target: ATXN1; (-) strand; PAM type: NRG; PAM sequence: TGG
cgataatttgctgagaatga

SEQ ID NO: 81116 - DNA, 20 bp, Artificial Sequence
  Description of Artificial Sequence: Synthetic oligonucleotide
  Target: ATXN1; (-) strand; PAM type: NRG; PAM sequence: GAG
tgtccttgcgataatttgct

SEQ ID NO: 81117 - DNA, 20 bp, Artificial Sequence
  Description of Artificial Sequence: Synthetic oligonucleotide
  Target: ATXN1; (-) strand; PAM type: NRG; PAM sequence: TGG
gagtgagaacatgcggtgtt

SEQ ID NO: 81118 - DNA, 20 bp, Artificial Sequence
  Description of Artificial Sequence: Synthetic oligonucleotide
  Target: ATXN1; (-) strand; PAM type: NRG; PAM sequence: CGG
cacctatgagtgagaacatg

SEQ ID NO: 81119 - DNA, 20 bp, Artificial Sequence
  Description of Artificial Sequence: Synthetic oligonucleotide
  Target: ATXN1; (-) strand; PAM type: NRG; PAM sequence: GAG
ttcaattcccacctatgagt

SEQ ID NO: 81120 - DNA, 20 bp, Artificial Sequence
  Description of Artificial Sequence: Synthetic oligonucleotide
  Target: ATXN1; (-) strand; PAM type: NRG; PAM sequence: GAG
attgttcaattcccacctat

SEQ ID NO: 81121 - DNA, 20 bp, Artificial Sequence
  Description of Artificial Sequence: Synthetic oligonucleotide
  Target: ATXN1; (-) strand; PAM type: NRG; PAM sequence: AAG
atgttccccttcctgtgacc

SEQ ID NO: 81122 - DNA, 20 bp, Artificial Sequence
  Description of Artificial Sequence: Synthetic oligonucleotide
  Target: ATXN1; (-) strand; PAM type: NRG; PAM sequence: CGG
ccccactccatgacaggccc

SEQ ID NO: 81123 - DNA, 20 bp, Artificial Sequence
  Description of Artificial Sequence: Synthetic oligonucleotide
  Target: ATXN1; (-) strand; PAM type: NRG; PAM sequence: AGG
ccctccccccactccatgac

SEQ ID NO: 81124 - DNA, 20 bp, Artificial Sequence
  Description of Artificial Sequence: Synthetic oligonucleotide
  Target: ATXN1; (-) strand; PAM type: NRG; PAM sequence: CAG
cccctccccccactccatga

SEQ ID NO: 81125 - DNA, 20 bp, Artificial Sequence
  Description of Artificial Sequence: Synthetic oligonucleotide
  Target: ATXN1; (-) strand; PAM type: NRG; PAM sequence: AAG
tacattaggtatatctccta

SEQ ID NO: 81126 - DNA, 20 bp, Artificial Sequence
  Description of Artificial Sequence: Synthetic oligonucleotide
  Target: ATXN1; (-) strand; PAM type: NRG; PAM sequence: AGG
attaactcatcatttacatt

SEQ ID NO: 81127 - DNA, 20 bp, Artificial Sequence
  Description of Artificial Sequence: Synthetic oligonucleotide
  Target: ATXN1; (-) strand; PAM type: NRG; PAM sequence: TAG
cattaactcatcatttacat

SEQ ID NO: 81128 - DNA, 20 bp, Artificial Sequence
  Description of Artificial Sequence: Synthetic oligonucleotide
  Target: ATXN1; (-) strand; PAM type: NRG; PAM sequence: TGG
tatgtatacatgtatcatgt

SEQ ID NO: 81129 - DNA, 20 bp, Artificial Sequence
  Description of Artificial Sequence: Synthetic oligonucleotide
  Target: ATXN1; (-) strand; PAM type: NRG; PAM sequence: AGG
ggtacatgtgcacaatgtgc

SEQ ID NO: 81130 - DNA, 20 bp, Artificial Sequence
  Description of Artificial Sequence: Synthetic oligonucleotide
  Target: ATXN1; (-) strand; PAM type: NRG; PAM sequence: CAG
gggtacatgtgcacaatgtg

SEQ ID NO: 81131 - DNA, 20 bp, Artificial Sequence
  Description of Artificial Sequence: Synthetic oligonucleotide
  Target: ATXN1; (-) strand; PAM type: NRG; PAM sequence: GGG
ttattatactttaagttcta

SEQ ID NO: 81132 - DNA, 20 bp, Artificial Sequence
  Description of Artificial Sequence: Synthetic oligonucleotide
  Target: ATXN1; (-) strand; PAM type: NRG; PAM sequence: AGG
tttattatactttaagttct

SEQ ID NO: 81133 - DNA, 20 bp, Artificial Sequence
  Description of Artificial Sequence: Synthetic oligonucleotide
  Target: ATXN1; (-) strand; PAM type: NRG; PAM sequence: TAG
ttttattatactttaagttc

SEQ ID NO: 81134 - DNA, 20 bp, Artificial Sequence
  Description of Artificial Sequence: Synthetic oligonucleotide
  Target: ATXN1; (-) strand; PAM type: NRG; PAM sequence: AAG
tttattttttattatacttt

SEQ ID NO: 81135 - DNA, 20 bp, Artificial Sequence
  Description of Artificial Sequence: Synthetic oligonucleotide
  Target: ATXN1; (-) strand; PAM type: NRG; PAM sequence: TAG
tgacttctagtgtgctcaat

SEQ ID NO: 81136 - DNA, 20 bp, Artificial Sequence
  Description of Artificial Sequence: Synthetic oligonucleotide
  Target: ATXN1; (-) strand; PAM type: NRG; PAM sequence: TAG
gagaaacagctgttgacttc

SEQ ID NO: 81137 - DNA, 20 bp, Artificial Sequence
  Description of Artificial Sequence: Synthetic oligonucleotide
  Target: ATXN1; (-) strand; PAM type: NRG; PAM sequence: CAG
ggtgactctaattggagaaa

SEQ ID NO: 81138 - DNA, 20 bp, Artificial Sequence
  Description of Artificial Sequence: Synthetic oligonucleotide
  Target: ATXN1; (-) strand; PAM type: NRG; PAM sequence: GAG
gttataggtgactctaattg

SEQ ID NO: 81139 - DNA, 20 bp, Artificial Sequence
  Description of Artificial Sequence: Synthetic oligonucleotide
  Target: ATXN1; (-) strand; PAM type: NRG; PAM sequence: TGG
ttgttataggtgactctaat

SEQ ID NO: 81140 - DNA, 20 bp, Artificial Sequence
  Description of Artificial Sequence: Synthetic oligonucleotide
  Target: ATXN1; (-) strand; PAM type: NRG; PAM sequence: AGG
gctaagaattcacttgttat

SEQ ID NO: 81141 - DNA, 20 bp, Artificial Sequence
  Description of Artificial Sequence: Synthetic oligonucleotide
  Target: ATXN1; (-) strand; PAM type: NRG; PAM sequence: TAG
tgctaagaattcacttgtta

SEQ ID NO: 81142 - DNA, 20 bp, Artificial Sequence
  Description of Artificial Sequence: Synthetic oligonucleotide
  Target: ATXN1; (-) strand; PAM type: NRG; PAM sequence: AAG
ttaaggtgattttccctgct

SEQ ID NO: 81143 - DNA, 20 bp, Artificial Sequence
  Description of Artificial Sequence: Synthetic oligonucleotide
  Target: ATXN1; (-) strand; PAM type: NRG; PAM sequence: AGG
aactcgacatggatatttta

SEQ ID NO: 81144 - DNA, 20 bp, Artificial Sequence
  Description of Artificial Sequence: Synthetic oligonucleotide
  Target: ATXN1; (-) strand; PAM type: NRG; PAM sequence: AAG
taactcgacatggatatttt

SEQ ID NO: 81145 - DNA, 20 bp, Artificial Sequence
  Description of Artificial Sequence: Synthetic oligonucleotide
  Target: ATXN1; (-) strand; PAM type: NRG; PAM sequence: TGG
cattttttcctaactcgaca

SEQ ID NO: 81146 - DNA, 20 bp, Artificial Sequence
  Description of Artificial Sequence: Synthetic oligonucleotide
  Target: ATXN1; (-) strand; PAM type: NRG; PAM sequence: TAG
attcaagaaaattaatttaa

SEQ ID NO: 81147 - DNA, 20 bp, Artificial Sequence
  Description of Artificial Sequence: Synthetic oligonucleotide
  Target: ATXN1; (-) strand; PAM type: NRG; PAM sequence: AAG
ttcttgtcccatgccaattc

SEQ ID NO: 81148 - DNA, 20 bp, Artificial Sequence
  Description of Artificial Sequence: Synthetic oligonucleotide
  Target: ATXN1; (-) strand; PAM type: NRG; PAM sequence: TAG
tttagcagaactgaactata

SEQ ID NO: 81149 - DNA, 20 bp, Artificial Sequence
  Description of Artificial Sequence: Synthetic oligonucleotide
  Target: ATXN1; (-) strand; PAM type: NRG; PAM sequence: CAG
agagttttttaggtgtttag

SEQ ID NO: 81150 - DNA, 20 bp, Artificial Sequence
  Description of Artificial Sequence: Synthetic oligonucleotide
  Target: ATXN1; (-) strand; PAM type: NRG; PAM sequence: TAG
atcagagttttttaggtgtt

SEQ ID NO: 81151 - DNA, 20 bp, Artificial Sequence
  Description of Artificial Sequence: Synthetic oligonucleotide
  Target: ATXN1; (-) strand; PAM type: NRG; PAM sequence: AGG
gtagtatatcagagtttttt

SEQ ID NO: 81152 - DNA, 20 bp, Artificial Sequence
  Description of Artificial Sequence: Synthetic oligonucleotide
  Target: ATXN1; (-) strand; PAM type: NRG; PAM sequence: TAG
tgtagtatatcagagttttt

SEQ ID NO: 81153 - DNA, 20 bp, Artificial Sequence
  Description of Artificial Sequence: Synthetic oligonucleotide
  Target: ATXN1; (-) strand; PAM type: NRG; PAM sequence: GAG
ggcgtagctgtagtatatca

SEQ ID NO: 81154 - DNA, 20 bp, Artificial Sequence
  Description of Artificial Sequence: Synthetic oligonucleotide
  Target: ATXN1; (-) strand; PAM type: NRG; PAM sequence: CAG
ctggcgtagctgtagtatat

SEQ ID NO: 81155 - DNA, 20 bp, Artificial Sequence
  Description of Artificial Sequence: Synthetic oligonucleotide
  Target: ATXN1; (-) strand; PAM type: NRG; PAM sequence: TAG
cgatttgcctggcgtagctg

SEQ ID NO: 81156 - DNA, 20 bp, Artificial Sequence
  Description of Artificial Sequence: Synthetic oligonucleotide
  Target: ATXN1; (-) strand; PAM type: NRG; PAM sequence: TAG
aacttgcgatttgcctggcg

SEQ ID NO: 81157 - DNA, 20 bp, Artificial Sequence
  Description of Artificial Sequence: Synthetic oligonucleotide
  Target: ATXN1; (-) strand; PAM type: NRG; PAM sequence: TGG
ccaacaacttgcgatttgcc

SEQ ID NO: 81158 - DNA, 20 bp, Artificial Sequence
  Description of Artificial Sequence: Synthetic oligonucleotide
  Target: ATXN1; (-) strand; PAM type: NRG; PAM sequence: GGG
atcgtgattcacatatttct

SEQ ID NO: 81159 - DNA, 20 bp, Artificial Sequence
  Description of Artificial Sequence: Synthetic oligonucleotide
  Target: ATXN1; (-) strand; PAM type: NRG; PAM sequence: TGG
aatcgtgattcacatatttc

SEQ ID NO: 81160 - DNA, 20 bp, Artificial Sequence
  Description of Artificial Sequence: Synthetic oligonucleotide
  Target: ATXN1; (-) strand; PAM type: NRG; PAM sequence: GAG
cctaaatttcccaaactgat

SEQ ID NO: 81161 - DNA, 20 bp, Artificial Sequence
  Description of Artificial Sequence: Synthetic oligonucleotide
  Target: ATXN1; (-) strand; PAM type: NRG; PAM sequence: TAG
ataatatcatgtttgactga

SEQ ID NO: 81162 - DNA, 20 bp, Artificial Sequence
  Description of Artificial Sequence: Synthetic oligonucleotide
  Target: ATXN1; (-) strand; PAM type: NRG; PAM sequence: CAG
tttatatcttggacatttgg

SEQ ID NO: 81163 - DNA, 20 bp, Artificial Sequence
  Description of Artificial Sequence: Synthetic oligonucleotide
  Target: ATXN1; (-) strand; PAM type: NRG; PAM sequence: TGG
aaatttatatcttggacatt

SEQ ID NO: 81164 - DNA, 20 bp, Artificial Sequence
  Description of Artificial Sequence: Synthetic oligonucleotide
  Target: ATXN1; (-) strand; PAM type: NRG; PAM sequence: TGG
ttccaaggaaatttatatct

SEQ ID NO: 81165 - DNA, 20 bp, Artificial Sequence
  Description of Artificial Sequence: Synthetic oligonucleotide
  Target: ATXN1; (-) strand; PAM type: NRG; PAM sequence: AGG
acctctgccagctgtttcca

SEQ ID NO: 81166 - DNA, 20 bp, Artificial Sequence
  Description of Artificial Sequence: Synthetic oligonucleotide
  Target: ATXN1; (-) strand; PAM type: NRG; PAM sequence: AAG
tacctctgccagctgtttcc

SEQ ID NO: 81167 - DNA, 20 bp, Artificial Sequence
  Description of Artificial Sequence: Synthetic oligonucleotide
  Target: ATXN1; (-) strand; PAM type: NRG; PAM sequence: CAG
agggctatgcctacctctgc

SEQ ID NO: 81168 - DNA, 20 bp, Artificial Sequence
  Description of Artificial Sequence: Synthetic oligonucleotide
  Target: ATXN1; (-) strand; PAM type: NRG; PAM sequence: GGG
cacaaattaggaaaattaaa

SEQ ID NO: 81169 - DNA, 20 bp, Artificial Sequence
  Description of Artificial Sequence: Synthetic oligonucleotide
  Target: ATXN1; (-) strand; PAM type: NRG; PAM sequence: AGG
ccacaaattaggaaaattaa

SEQ ID NO: 81170 - DNA, 20 bp, Artificial Sequence
  Description of Artificial Sequence: Synthetic oligonucleotide
  Target: ATXN1; (-) strand; PAM type: NRG; PAM sequence: AAG
cccacaaattaggaaaatta

SEQ ID NO: 81171 - DNA, 20 bp, Artificial Sequence
  Description of Artificial Sequence: Synthetic oligonucleotide
  Target: ATXN1; (-) strand; PAM type: NRG; PAM sequence: AGG
aatctgctagcccacaaatt

SEQ ID NO: 81172 - DNA, 20 bp, Artificial Sequence
  Description of Artificial Sequence: Synthetic oligonucleotide
  Target: ATXN1; (-) strand; PAM type: NRG; PAM sequence: TAG
aaatctgctagcccacaaat

SEQ ID NO: 81173 - DNA, 20 bp, Artificial Sequence
  Description of Artificial Sequence: Synthetic oligonucleotide
  Target: ATXN1; (-) strand; PAM type: NRG; PAM sequence: TAG
tgaaattccaaaaaatctgc

SEQ ID NO: 81174 - DNA, 20 bp, Artificial Sequence
  Description of Artificial Sequence: Synthetic oligonucleotide
  Target: ATXN1; (-) strand; PAM type: NRG; PAM sequence: TAG
tatttatttctctttcatac

SEQ ID NO: 81175 - DNA, 20 bp, Artificial Sequence
  Description of Artificial Sequence: Synthetic oligonucleotide
  Target: ATXN1; (-) strand; PAM type: NRG; PAM sequence: TGG
aaactgcagacctcacagac

SEQ ID NO: 81176 - DNA, 20 bp, Artificial Sequence
  Description of Artificial Sequence: Synthetic oligonucleotide
  Target: ATXN1; (-) strand; PAM type: NRG; PAM sequence: CAG
tttataaactgcagacctca

SEQ ID NO: 81177 - DNA, 20 bp, Artificial Sequence
  Description of Artificial Sequence: Synthetic oligonucleotide
  Target: ATXN1; (-) strand; PAM type: NRG; PAM sequence: CAG
ttgactagttttataaactg

SEQ ID NO: 81178 - DNA, 20 bp, Artificial Sequence
  Description of Artificial Sequence: Synthetic oligonucleotide
  Target: ATXN1; (-) strand; PAM type: NRG; PAM sequence: TAG
acactcctctaccccttgac

SEQ ID NO: 81179 - DNA, 20 bp, Artificial Sequence
  Description of Artificial Sequence: Synthetic oligonucleotide
  Target: ATXN1; (-) strand; PAM type: NRG; PAM sequence: AAG
gcctttgagatcttttctta

SEQ ID NO: 81180 - DNA, 20 bp, Artificial Sequence
  Description of Artificial Sequence: Synthetic oligonucleotide
  Target: ATXN1; (-) strand; PAM type: NRG; PAM sequence: GAG
agtgaccatggctggccttt

SEQ ID NO: 81181 - DNA, 20 bp, Artificial Sequence
  Description of Artificial Sequence: Synthetic oligonucleotide
  Target: ATXN1; (-) strand; PAM type: NRG; PAM sequence: TGG
caggcgtgagtgaccatggc

SEQ ID NO: 81182 - DNA, 20 bp, Artificial Sequence
  Description of Artificial Sequence: Synthetic oligonucleotide
  Target: ATXN1; (-) strand; PAM type: NRG; PAM sequence: TGG
attacaggcgtgagtgacca

SEQ ID NO: 81183 - DNA, 20 bp, Artificial Sequence
  Description of Artificial Sequence: Synthetic oligonucleotide
  Target: ATXN1; (-) strand; PAM type: NRG; PAM sequence: GAG
agttctgggattacaggcgt

SEQ ID NO: 81184 - DNA, 20 bp, Artificial Sequence
  Description of Artificial Sequence: Synthetic oligonucleotide
  Target: ATXN1; (-) strand; PAM type: NRG; PAM sequence: AGG
tcccaaagttctgggattac

SEQ ID NO: 81185 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagttctgggatta

SEQ ID NO: 81186 - DNA, 20 bp, Artificial Sequence
  Description of Artificial Sequence: Synthetic oligonucleotide
  Target: ATXN1; (-) strand; PAM type: NRG; PAM sequence: GGG
cttcagcctcccaaagttct

SEQ ID NO: 81187 - DNA, 20 bp, Artificial Sequence
  Description of Artificial Sequence: Synthetic oligonucleotide
  Target: ATXN1; (-) strand; PAM type: NRG; PAM sequence: TGG
acttcagcctcccaaagttc

SEQ ID NO: 81188 - DNA, 20 bp, Artificial Sequence
  Description of Artificial Sequence: Synthetic oligonucleotide
  Target: ATXN1; (-) strand; PAM type: NRG; PAM sequence: AAG
tcctccacttcagcctccca

SEQ ID NO: 81189 - DNA, 20 bp, Artificial Sequence
  Description of Artificial Sequence: Synthetic oligonucleotide
  Target: ATXN1; (-) strand; PAM type: NRG; PAM sequence: CAG
gctcaagcgatcctccactt

SEQ ID NO: 81190 - DNA, 20 bp, Artificial Sequence
  Description of Artificial Sequence: Synthetic oligonucleotide
  Target: ATXN1; (-) strand; PAM type: NRG; PAM sequence: AAG
tgtcttgaactcctgggctc

SEQ ID NO: 81191 - DNA, 20 bp, Artificial Sequence
  Description of Artificial Sequence: Synthetic oligonucleotide
  Target: ATXN1; (-) strand; PAM type: NRG; PAM sequence: GGG
cagttttgtcttgaactcct

SEQ ID NO: 81192 - DNA, 20 bp, Artificial Sequence
  Description of Artificial Sequence: Synthetic oligonucleotide
  Target: ATXN1; (-) strand; PAM type: NRG; PAM sequence: TGG
ccagttttgtcttgaactcc

SEQ ID NO: 81193 - DNA, 20 bp, Artificial Sequence
  Description of Artificial Sequence: Synthetic oligonucleotide
  Target: ATXN1; (-) strand; PAM type: NRG; PAM sequence: CAG
gggggtctcactatgttgcc

SEQ ID NO: 81194 - DNA, 20 bp, Artificial Sequence
  Description of Artificial Sequence: Synthetic oligonucleotide
  Target: ATXN1; (-) strand; PAM type: NRG; PAM sequence: GGG
gtatttttttgtagagatgg

SEQ ID NO: 81195 - DNA, 20 bp, Artificial Sequence
  Description of Artificial Sequence: Synthetic oligonucleotide
  Target: ATXN1; (-) strand; PAM type: NRG; PAM sequence: GGG
tgtatttttttgtagagatg

SEQ ID NO: 81196 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttttgtagagat

SEQ ID NO: 81197 - DNA, 20 bp, Artificial Sequence
  Description of Artificial Sequence: Synthetic oligonucleotide
  Target: ATXN1; (-) strand; PAM type: NRG; PAM sequence: TGG
tttgtatttttttgtagaga

SEQ ID NO: 81198 - DNA, 20 bp, Artificial Sequence
  Description of Artificial Sequence: Synthetic oligonucleotide
  Target: ATXN1; (-) strand; PAM type: NRG; PAM sequence: GAG
aatttttgtatttttttgta

SEQ ID NO: 81199 - DNA, 20 bp, Artificial Sequence
  Description of Artificial Sequence: Synthetic oligonucleotide
  Target: ATXN1; (-) strand; PAM type: NRG; PAM sequence: TAG
ctaatttttgtatttttttg

SEQ ID NO: 81200 - DNA, 20 bp, Artificial Sequence
  Description of Artificial Sequence: Synthetic oligonucleotide
  Target: ATXN1; (-) strand; PAM type: NRG; PAM sequence: CAG
gatacatatgccaccatgct

SEQ ID NO: 81201 - DNA, 20 bp, Artificial Sequence
  Description of Artificial Sequence: Synthetic oligonucleotide
  Target: ATXN1; (-) strand; PAM type: NRG; PAM sequence: CAG
gccttctgagtagctgtgag

SEQ ID NO: 81202 - DNA, 20 bp, Artificial Sequence
  Description of Artificial Sequence: Synthetic oligonucleotide
  Target: ATXN1; (-) strand; PAM type: NRG; PAM sequence: GAG
tgagccttctgagtagctgt

SEQ ID NO: 81203 - DNA, 20 bp, Artificial Sequence
  Description of Artificial Sequence: Synthetic oligonucleotide
  Target: ATXN1; (-) strand; PAM type: NRG; PAM sequence: TAG
tcccacctgagccttctgag

SEQ ID NO: 81204 - DNA, 20 bp, Artificial Sequence
  Description of Artificial Sequence: Synthetic oligonucleotide
  Target: ATXN1; (-) strand; PAM type: NRG; PAM sequence: GAG
tcctcccacctgagccttct

SEQ ID NO: 81205 - DNA, 20 bp, Artificial Sequence
  Description of Artificial Sequence: Synthetic oligonucleotide
  Target: ATXN1; (-) strand; PAM type: NRG; PAM sequence: GAG
ctcaagtgatcctcccacct

SEQ ID NO: 81206 - DNA, 20 bp, Artificial Sequence
  Description of Artificial Sequence: Synthetic oligonucleotide
  Target: ATXN1; (-) strand; PAM type: NRG; PAM sequence: AAG
agcctcaacctcccaggctc

SEQ ID NO: 81207 - DNA, 20 bp, Artificial Sequence
  Description of Artificial Sequence: Synthetic oligonucleotide
  Target: ATXN1; (-) strand; PAM type: NRG; PAM sequence: AGG
cactgcagcctcaacctccc

SEQ ID NO: 81208 - DNA, 20 bp, Artificial Sequence
  Description of Artificial Sequence: Synthetic oligonucleotide
  Target: ATXN1; (-) strand; PAM type: NRG; PAM sequence: CAG
tcactgcagcctcaacctcc

SEQ ID NO: 81209 - DNA, 20 bp, Artificial Sequence
  Description of Artificial Sequence: Synthetic oligonucleotide
  Target: ATXN1; (-) strand; PAM type: NRG; PAM sequence: CAG
gttgtgatcttggctcactg

SEQ ID NO: 81210 - DNA, 20 bp, Artificial Sequence
  Description of Artificial Sequence: Synthetic oligonucleotide
  Target: ATXN1; (-) strand; PAM type: NRG; PAM sequence: TGG
ggattgcagtgttgtgatct

SEQ ID NO: 81211 - DNA, 20 bp, Artificial Sequence
  Description of Artificial Sequence: Synthetic oligonucleotide
  Target: ATXN1; (-) strand; PAM type: NRG; PAM sequence: CAG
ctgtcatccaggctggattg

SEQ ID NO: 81212 - DNA, 20 bp, Artificial Sequence
  Description of Artificial Sequence: Synthetic oligonucleotide
  Target: ATXN1; (-) strand; PAM type: NRG; PAM sequence: TGG
tctagctctgtcatccaggc

SEQ ID NO: 81213 - DNA, 20 bp, Artificial Sequence
  Description of Artificial Sequence: Synthetic oligonucleotide
  Target: ATXN1; (-) strand; PAM type: NRG; PAM sequence: AGG
agcgtctagctctgtcatcc

SEQ ID NO: 81214 - DNA, 20 bp, Artificial Sequence
  Description of Artificial Sequence: Synthetic oligonucleotide
  Target: ATXN1; (-) strand; PAM type: NRG; PAM sequence: CAG
cagcgtctagctctgtcatc

SEQ ID NO: 81215 - DNA, 20 bp, Artificial Sequence
  Description of Artificial Sequence: Synthetic oligonucleotide
  Target: ATXN1; (-) strand; PAM type: NRG; PAM sequence: TAG
tttttttttgaggcagcgtc

SEQ ID NO: 81216 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgagg

SEQ ID NO: 81217 - DNA, 20 bp, Artificial Sequence
  Description of Artificial Sequence: Synthetic oligonucleotide
  Target: ATXN1; (-) strand; PAM type: NRG; PAM sequence: AGG
tttttttttttttttttttg

SEQ ID NO: 81218 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 81219 - DNA, 20 bp, Artificial Sequence
  Description of Artificial Sequence: Synthetic oligonucleotide
  Target: ATXN1; (-) strand; PAM type: NRG; PAM sequence: CAG
tttatgttgataattttgtg

SEQ ID NO: 81220 - DNA, 20 bp, Artificial Sequence
  Description of Artificial Sequence: Synthetic oligonucleotide
  Target: ATXN1; (-) strand; PAM type: NRG; PAM sequence: AAG
cgctcctgcaggccctttgt

SEQ ID NO: 81221 - DNA, 20 bp, Artificial Sequence
  Description of Artificial Sequence: Synthetic oligonucleotide
  Target: ATXN1; (-) strand; PAM type: NRG; PAM sequence: AGG
tcaaggcgtctcgctcctgc

SEQ ID NO: 81222 - DNA, 20 bp, Artificial Sequence
  Description of Artificial Sequence: Synthetic oligonucleotide
  Target: ATXN1; (-) strand; PAM type: NRG; PAM sequence: CAG
gtcaaggcgtctcgctcctg

SEQ ID NO: 81223 - DNA, 20 bp, Artificial Sequence
  Description of Artificial Sequence: Synthetic oligonucleotide
  Target: ATXN1; (-) strand; PAM type: NRG; PAM sequence: AGG
ctagtgacacttcagcgtca

SEQ ID NO: 81224 - DNA, 20 bp, Artificial Sequence
  Description of Artificial Sequence: Synthetic oligonucleotide
  Target: ATXN1; (-) strand; PAM type: NRG; PAM sequence: AAG
gctagtgacacttcagcgtc

SEQ ID NO: 81225 - DNA, 20 bp, Artificial Sequence
  Description of Artificial Sequence: Synthetic oligonucleotide
  Target: ATXN1; (-) strand; PAM type: NRG; PAM sequence: CAG
tctggaagctagtgacactt

SEQ ID NO: 81226 - DNA, 20 bp, Artificial Sequence
  Description of Artificial Sequence: Synthetic oligonucleotide
  Target: ATXN1; (-) strand; PAM type: NRG; PAM sequence: TAG
aggaggttttatctggaagc

SEQ ID NO: 81227 - DNA, 20 bp, Artificial Sequence
  Description of Artificial Sequence: Synthetic oligonucleotide
  Target: ATXN1; (-) strand; PAM type: NRG; PAM sequence: AAG
ggccaggaggttttatctgg

SEQ ID NO: 81228 - DNA, 20 bp, Artificial Sequence
  Description of Artificial Sequence: Synthetic oligonucleotide
  Target: ATXN1; (-) strand; PAM type: NRG; PAM sequence: TGG
gtgggccaggaggttttatc

SEQ ID NO: 81229 - DNA, 20 bp, Artificial Sequence
  Description of Artificial Sequence: Synthetic oligonucleotide
  Target: ATXN1; (-) strand; PAM type: NRG; PAM sequence: AGG
tgcatgcattgtgggccagg

SEQ ID NO: 81230 - DNA, 20 bp, Artificial Sequence
  Description of Artificial Sequence: Synthetic oligonucleotide
  Target: ATXN1; (-) strand; PAM type: NRG; PAM sequence: GAG
gtgcatgcattgtgggccag

SEQ ID NO: 81231 - DNA, 20 bp, Artificial Sequence
  Description of Artificial Sequence: Synthetic oligonucleotide
  Target: ATXN1; (-) strand; PAM type: NRG; PAM sequence: AGG
gtgtgcatgcattgtgggcc

SEQ ID NO: 81232 - DNA, 20 bp, Artificial Sequence
  Description of Artificial Sequence: Synthetic oligonucleotide
  Target: ATXN1; (-) strand; PAM type: NRG; PAM sequence: CAG
tgtgtgcatgcattgtgggc

SEQ ID NO: 81233 - DNA, 20 bp, Artificial Sequence
  Description of Artificial Sequence: Synthetic oligonucleotide
  Target: ATXN1; (-) strand; PAM type: NRG; PAM sequence: GGG
gtgatgtgtgcatgcattgt

SEQ ID NO: 81234 - DNA, 20 bp, Artificial Sequence
  Description of Artificial Sequence: Synthetic oligonucleotide
  Target: ATXN1; (-) strand; PAM type: NRG; PAM sequence: TGG
tgtgatgtgtgcatgcattg

SEQ ID NO: 81235 - DNA, 20 bp, Artificial Sequence
  Description of Artificial Sequence: Synthetic oligonucleotide
  Target: ATXN1; (-) strand; PAM type: NRG; PAM sequence: AGG
tgttgatcttggtcatttat

SEQ ID NO: 81236 - DNA, 20 bp, Artificial Sequence
  Description of Artificial Sequence: Synthetic oligonucleotide
  Target: ATXN1; (-) strand; PAM type: NRG; PAM sequence: TAG
atgttgatcttggtcattta

SEQ ID NO: 81237 - DNA, 20 bp, Artificial Sequence
  Description of Artificial Sequence: Synthetic oligonucleotide
  Target: ATXN1; (-) strand; PAM type: NRG; PAM sequence: TGG
ataatgaaatatgttgatct

SEQ ID NO: 81238 - DNA, 20 bp, Artificial Sequence
  Description of Artificial Sequence: Synthetic oligonucleotide
  Target: ATXN1; (-) strand; PAM type: NRG; PAM sequence: GGG
accatatacttggcattgaa

SEQ ID NO: 81239 - DNA, 20 bp, Artificial Sequence
  Description of Artificial Sequence: Synthetic oligonucleotide
  Target: ATXN1; (-) strand; PAM type: NRG; PAM sequence: AGG
taccatatacttggcattga

SEQ ID NO: 81240 - DNA, 20 bp, Artificial Sequence
  Description of Artificial Sequence: Synthetic oligonucleotide
  Target: ATXN1; (-) strand; PAM type: NRG; PAM sequence: AAG
ttaccatatacttggcattg

SEQ ID NO: 81241 - DNA, 20 bp, Artificial Sequence
  Description of Artificial Sequence: Synthetic oligonucleotide
  Target: ATXN1; (-) strand; PAM type: NRG; PAM sequence: TGG
taaagtgtttaccatatact

SEQ ID NO: 81242 - DNA, 20 bp, Artificial Sequence
  Description of Artificial Sequence: Synthetic oligonucleotide
  Target: ATXN1; (-) strand; PAM type: NRG; PAM sequence: AAG
ctcagcaaaaatgtatacta

SEQ ID NO: 81243 - DNA, 20 bp, Artificial Sequence
  Description of Artificial Sequence: Synthetic oligonucleotide
  Target: ATXN1; (-) strand; PAM type: NRG; PAM sequence: CAG
tctatttagtcacgtgtact

SEQ ID NO: 81244 - DNA, 20 bp, Artificial Sequence
  Description of Artificial Sequence: Synthetic oligonucleotide
  Target: ATXN1; (-) strand; PAM type: NRG; PAM sequence: TAG
aatttgtaaacatttctatt

SEQ ID NO: 81245 - DNA, 20 bp, Artificial Sequence
  Description of Artificial Sequence: Synthetic oligonucleotide
  Target: ATXN1; (-) strand; PAM type: NRG; PAM sequence: CAG
acatattggaattcatttaa

SEQ ID NO: 81246 - DNA, 20 bp, Artificial Sequence
  Description of Artificial Sequence: Synthetic oligonucleotide
  Target: ATXN1; (-) strand; PAM type: NRG; PAM sequence: TGG
gaggtagtaaagccacatat

SEQ ID NO: 81247 - DNA, 20 bp, Artificial Sequence
  Description of Artificial Sequence: Synthetic oligonucleotide
  Target: ATXN1; (-) strand; PAM type: NRG; PAM sequence: AAG
gttttcctgatgaggtagta

SEQ ID NO: 81248 - DNA, 20 bp, Artificial Sequence
  Description of Artificial Sequence: Synthetic oligonucleotide
  Target: ATXN1; (-) strand; PAM type: NRG; PAM sequence: TAG
tacaggttttcctgatgagg

SEQ ID NO: 81249 - DNA, 20 bp, Artificial Sequence
  Description of Artificial Sequence: Synthetic oligonucleotide
  Target: ATXN1; (-) strand; PAM type: NRG; PAM sequence: AGG
ggatacaggttttcctgatg

SEQ ID NO: 81250 - DNA, 20 bp, Artificial Sequence
  Description of Artificial Sequence: Synthetic oligonucleotide
  Target: ATXN1; (-) strand; PAM type: NRG; PAM sequence: GAG
gggatacaggttttcctgat

SEQ ID NO: 81251 - DNA, 20 bp, Artificial Sequence
  Description of Artificial Sequence: Synthetic oligonucleotide
  Target: ATXN1; (-) strand; PAM type: NRG; PAM sequence: AGG
gataaatgactgtgggatac

SEQ ID NO: 81252 - DNA, 20 bp, Artificial Sequence
  Description of Artificial Sequence: Synthetic oligonucleotide
  Target: ATXN1; (-) strand; PAM type: NRG; PAM sequence: CAG
tgataaatgactgtgggata

SEQ ID NO: 81253 - DNA, 20 bp, Artificial Sequence
  Description of Artificial Sequence: Synthetic oligonucleotide
  Target: ATXN1; (-) strand; PAM type: NRG; PAM sequence: GGG
gctgcctgataaatgactgt

SEQ ID NO: 81254 - DNA, 20 bp, Artificial Sequence
  Description of Artificial Sequence: Synthetic oligonucleotide
  Target: ATXN1; (-) strand; PAM type: NRG; PAM sequence: TGG
tgctgcctgataaatgactg

SEQ ID NO: 81255 - DNA, 20 bp, Artificial Sequence
  Description of Artificial Sequence: Synthetic oligonucleotide
  Target: ATXN1; (-) strand; PAM type: NRG; PAM sequence: TAG
gcagatgggtttccataagc

SEQ ID NO: 81256 - DNA, 20 bp, Artificial Sequence
  Description of Artificial Sequence: Synthetic oligonucleotide
  Target: ATXN1; (-) strand; PAM type: NRG; PAM sequence: AAG
acctgcagatgggtttccat

SEQ ID NO: 81257 - DNA, 20 bp, Artificial Sequence
  Description of Artificial Sequence: Synthetic oligonucleotide
  Target: ATXN1; (-) strand; PAM type: NRG; PAM sequence: GGG
ttgcttaggaacctgcagat

SEQ ID NO: 81258 - DNA, 20 bp, Artificial Sequence
  Description of Artificial Sequence: Synthetic oligonucleotide
  Target: ATXN1; (-) strand; PAM type: NRG; PAM sequence: TGG
cttgcttaggaacctgcaga

SEQ ID NO: 81259 - DNA, 20 bp, Artificial Sequence
  Description of Artificial Sequence: Synthetic oligonucleotide
  Target: ATXN1; (-) strand; PAM type: NRG; PAM sequence: CAG
gctacttgcttaggaacctg

SEQ ID NO: 81260 - DNA, 20 bp, Artificial Sequence
  Description of Artificial Sequence: Synthetic oligonucleotide
  Target: ATXN1; (-) strand; PAM type: NRG; PAM sequence: AGG
ttaatctgggctacttgctt

SEQ ID NO: 81261 - DNA, 20 bp, Artificial Sequence
  Description of Artificial Sequence: Synthetic oligonucleotide
  Target: ATXN1; (-) strand; PAM type: NRG; PAM sequence: TAG
attaatctgggctacttgct

SEQ ID NO: 81262 - DNA, 20 bp, Artificial Sequence
  Description of Artificial Sequence: Synthetic oligonucleotide
  Target: ATXN1; (-) strand; PAM type: NRG; PAM sequence: GGG
ctgcactatgatattaatct

SEQ ID NO: 81263 - DNA, 20 bp, Artificial Sequence
  Description of Artificial Sequence: Synthetic oligonucleotide
  Target: ATXN1; (-) strand; PAM type: NRG; PAM sequence: TGG
gctgcactatgatattaatc

SEQ ID NO: 81264 - DNA, 20 bp, Artificial Sequence
  Description of Artificial Sequence: Synthetic oligonucleotide
  Target: ATXN1; (-) strand; PAM type: NRG; PAM sequence: TAG
atttaattatagccaccgac

SEQ ID NO: 81265 - DNA, 20 bp, Artificial Sequence
  Description of Artificial Sequence: Synthetic oligonucleotide
  Target: ATXN1; (-) strand; PAM type: NRG; PAM sequence: TAG
accacttctgcatttaatta

SEQ ID NO: 81266 - DNA, 20 bp, Artificial Sequence
  Description of Artificial Sequence: Synthetic oligonucleotide
  Target: ATXN1; (-) strand; PAM type: NRG; PAM sequence: TGG
ctcgacccaagaagtccagc

SEQ ID NO: 81267 - DNA, 20 bp, Artificial Sequence
  Description of Artificial Sequence: Synthetic oligonucleotide
  Target: ATXN1; (-) strand; PAM type: NRG; PAM sequence: CAG
cccactcgacccaagaagtc

SEQ ID NO: 81268 - DNA, 20 bp, Artificial Sequence
  Description of Artificial Sequence: Synthetic oligonucleotide
  Target: ATXN1; (-) strand; PAM type: NRG; PAM sequence: AAG
aagtccccactcgacccaag

SEQ ID NO: 81269 - DNA, 20 bp, Artificial Sequence
  Description of Artificial Sequence: Synthetic oligonucleotide
  Target: ATXN1; (-) strand; PAM type: NRG; PAM sequence: AAG
tccaagtccccactcgaccc

SEQ ID NO: 81270 - DNA, 20 bp, Artificial Sequence
  Description of Artificial Sequence: Synthetic oligonucleotide
  Target: ATXN1; (-) strand; PAM type: NRG; PAM sequence: AAG
gtaagacagaaaagttctcc

SEQ ID NO: 81271 - DNA, 20 bp, Artificial Sequence
  Description of Artificial Sequence: Synthetic oligonucleotide
  Target: ATXN1; (-) strand; PAM type: NRG; PAM sequence: AAG
aatccccttgtaagacagaa

SEQ ID NO: 81272 - DNA, 20 bp, Artificial Sequence
  Description of Artificial Sequence: Synthetic oligonucleotide
  Target: ATXN1; (-) strand; PAM type: NRG; PAM sequence: CAG
tttacaatccccttgtaaga

SEQ ID NO: 81273 - DNA, 20 bp, Artificial Sequence
  Description of Artificial Sequence: Synthetic oligonucleotide
  Target: ATXN1; (-) strand; PAM type: NRG; PAM sequence: AAG
gcattttacaatccccttgt

SEQ ID NO: 81274 - DNA, 20 bp, Artificial Sequence
  Description of Artificial Sequence: Synthetic oligonucleotide
  Target: ATXN1; (-) strand; PAM type: NRG; PAM sequence: TGG
tgtttttacagagcactcat

SEQ ID NO: 81275 - DNA, 20 bp, Artificial Sequence
  Description of Artificial Sequence: Synthetic oligonucleotide
  Target: ATXN1; (-) strand; PAM type: NRG; PAM sequence: GAG
ctgattggtgtgtttttaca

SEQ ID NO: 81276 - DNA, 20 bp, Artificial Sequence
  Description of Artificial Sequence: Synthetic oligonucleotide
  Target: ATXN1; (-) strand; PAM type: NRG; PAM sequence: CAG
cgctgattggtgtgttttta

SEQ ID NO: 81277 - DNA, 20 bp, Artificial Sequence
  Description of Artificial Sequence: Synthetic oligonucleotide
  Target: ATXN1; (-) strand; PAM type: NRG; PAM sequence: TGG
gctagctacagagcgctgat

SEQ ID NO: 81278 - DNA, 20 bp, Artificial Sequence
  Description of Artificial Sequence: Synthetic oligonucleotide
  Target: ATXN1; (-) strand; PAM type: NRG; PAM sequence: GAG
caaacctcaagctagctaca

SEQ ID NO: 81279 - DNA, 20 bp, Artificial Sequence
  Description of Artificial Sequence: Synthetic oligonucleotide
  Target: ATXN1; (-) strand; PAM type: NRG; PAM sequence: CAG
tacaaacctcaagctagcta

SEQ ID NO: 81280 - DNA, 20 bp, Artificial Sequence
  Description of Artificial Sequence: Synthetic oligonucleotide
  Target: ATXN1; (-) strand; PAM type: NRG; PAM sequence: TAG
ccattttacaaacctcaagc

SEQ ID NO: 81281 - DNA, 20 bp, Artificial Sequence
  Description of Artificial Sequence: Synthetic oligonucleotide
  Target: ATXN1; (-) strand; PAM type: NRG; PAM sequence: AAG
tggtccattttacaaacctc

SEQ ID NO: 81282 - DNA, 20 bp, Artificial Sequence
  Description of Artificial Sequence: Synthetic oligonucleotide
  Target: ATXN1; (-) strand; PAM type: NRG; PAM sequence: TGG
ccattttacagagtgctgat

SEQ ID NO: 81283 - DNA, 20 bp, Artificial Sequence
  Description of Artificial Sequence: Synthetic oligonucleotide
  Target: ATXN1; (-) strand; PAM type: NRG; PAM sequence: GAG
actgattggtccattttaca

SEQ ID NO: 81284 - DNA, 20 bp, Artificial Sequence
  Description of Artificial Sequence: Synthetic oligonucleotide
  Target: ATXN1; (-) strand; PAM type: NRG; PAM sequence: CAG
gcactgattggtccatttta

SEQ ID NO: 81285 - DNA, 20 bp, Artificial Sequence
  Description of Artificial Sequence: Synthetic oligonucleotide
  Target: ATXN1; (-) strand; PAM type: NRG; PAM sequence: TGG
ccattctacagagcactgat

SEQ ID NO: 81286 - DNA, 20 bp, Artificial Sequence
  Description of Artificial Sequence: Synthetic oligonucleotide
  Target: ATXN1; (-) strand; PAM type: NRG; PAM sequence: GAG
gctgattggtccattctaca

SEQ ID NO: 81287 - DNA, 20 bp, Artificial Sequence
  Description of Artificial Sequence: Synthetic oligonucleotide
  Target: ATXN1; (-) strand; PAM type: NRG; PAM sequence: CAG
ctgctgattggtccattcta

SEQ ID NO: 81288 - DNA, 20 bp, Artificial Sequence
  Description of Artificial Sequence: Synthetic oligonucleotide
  Target: ATXN1; (-) strand; PAM type: NRG; PAM sequence: TGG
cctgcccatgtcctgctgat

SEQ ID NO: 81289 - DNA, 20 bp, Artificial Sequence
  Description of Artificial Sequence: Synthetic oligonucleotide
  Target: ATXN1; (-) strand; PAM type: NRG; PAM sequence: CAG
tctctgctggctggcgtggc

SEQ ID NO: 81290 - DNA, 20 bp, Artificial Sequence
  Description of Artificial Sequence: Synthetic oligonucleotide
  Target: ATXN1; (-) strand; PAM type: NRG; PAM sequence: TGG
gttgtctctgctggctggcg

SEQ ID NO: 81291 - DNA, 20 bp, Artificial Sequence
  Description of Artificial Sequence: Synthetic oligonucleotide
  Target: ATXN1; (-) strand; PAM type: NRG; PAM sequence: TGG
agcgggttgtctctgctggc

SEQ ID NO: 81292 - DNA, 20 bp, Artificial Sequence
  Description of Artificial Sequence: Synthetic oligonucleotide
  Target: ATXN1; (-) strand; PAM type: NRG; PAM sequence: TGG
cccgagcgggttgtctctgc

SEQ ID NO: 81293 - DNA, 20 bp, Artificial Sequence
  Description of Artificial Sequence: Synthetic oligonucleotide
  Target: ATXN1; (-) strand; PAM type: NRG; PAM sequence: GGG
gcgtggaaggggacccgagc

SEQ ID NO: 81294 - DNA, 20 bp, Artificial Sequence
  Description of Artificial Sequence: Synthetic oligonucleotide
  Target: ATXN1; (-) strand; PAM type: NRG; PAM sequence: CGG
agcgtggaaggggacccgag

SEQ ID NO: 81295 - DNA, 20 bp, Artificial Sequence
  Description of Artificial Sequence: Synthetic oligonucleotide
  Target: ATXN1; (-) strand; PAM type: NRG; PAM sequence: GAG
cacagcgtggaaggggaccc

SEQ ID NO: 81296 - DNA, 20 bp, Artificial Sequence
  Description of Artificial Sequence: Synthetic oligonucleotide
  Target: ATXN1; (-) strand; PAM type: NRG; PAM sequence: GGG
aaccttccacagcgtggaag

SEQ ID NO: 81297 - DNA, 20 bp, Artificial Sequence
  Description of Artificial Sequence: Synthetic oligonucleotide
  Target: ATXN1; (-) strand; PAM type: NRG; PAM sequence: GGG
aaaccttccacagcgtggaa

SEQ ID NO: 81298 - DNA, 20 bp, Artificial Sequence
  Description of Artificial Sequence: Synthetic oligonucleotide
  Target: ATXN1; (-) strand; PAM type: NRG; PAM sequence: AGG
caaaccttccacagcgtgga

SEQ ID NO: 81299 - DNA, 20 bp, Artificial Sequence
  Description of Artificial Sequence: Synthetic oligonucleotide
  Target: ATXN1; (-) strand; PAM type: NRG; PAM sequence: AAG
acaaaccttccacagcgtgg

SEQ ID NO: 81300 - DNA, 20 bp, Artificial Sequence
  Description of Artificial Sequence: Synthetic oligonucleotide
  Target: ATXN1; (-) strand; PAM type: NRG; PAM sequence: TGG
agaacaaaccttccacagcg

SEQ ID NO: 81301 - DNA, 20 bp, Artificial Sequence
  Description of Artificial Sequence: Synthetic oligonucleotide
  Target: ATXN1; (-) strand; PAM type: NRG; PAM sequence: CAG
gcgaaagaacaaaccttcca

SEQ ID NO: 81302 - DNA, 20 bp, Artificial Sequence
  Description of Artificial Sequence: Synthetic oligonucleotide
  Target: ATXN1; (-) strand; PAM type: NRG; PAM sequence: AAG
agatttattgtgaggagcga

SEQ ID NO: 81303 - DNA, 20 bp, Artificial Sequence
  Description of Artificial Sequence: Synthetic oligonucleotide
  Target: ATXN1; (-) strand; PAM type: NRG; PAM sequence: GAG
gtagcaagatttattgtgag

SEQ ID NO: 81304 - DNA, 20 bp, Artificial Sequence
  Description of Artificial Sequence: Synthetic oligonucleotide
  Target: ATXN1; (-) strand; PAM type: NRG; PAM sequence: AGG
cagtagcaagatttattgtg

SEQ ID NO: 81305 - DNA, 20 bp, Artificial Sequence
  Description of Artificial Sequence: Synthetic oligonucleotide
  Target: ATXN1; (-) strand; PAM type: NRG; PAM sequence: GAG
gcagtagcaagatttattgt

SEQ ID NO: 81306 - DNA, 20 bp, Artificial Sequence
  Description of Artificial Sequence: Synthetic oligonucleotide
  Target: ATXN1; (-) strand; PAM type: NRG; PAM sequence: AAG
cccaaagagcgagcagtagc

SEQ ID NO: 81307 - DNA, 20 bp, Artificial Sequence
  Description of Artificial Sequence: Synthetic oligonucleotide
  Target: ATXN1; (-) strand; PAM type: NRG; PAM sequence: TAG
gggacccaaagagcgagcag

SEQ ID NO: 81308 - DNA, 20 bp, Artificial Sequence
  Description of Artificial Sequence: Synthetic oligonucleotide
  Target: ATXN1; (-) strand; PAM type: NRG; PAM sequence: CAG
gtagggacccaaagagcgag

SEQ ID NO: 81309 - DNA, 20 bp, Artificial Sequence
  Description of Artificial Sequence: Synthetic oligonucleotide
  Target: ATXN1; (-) strand; PAM type: NRG; PAM sequence: GAG
atggtagggacccaaagagc

SEQ ID NO: 81310 - DNA, 20 bp, Artificial Sequence
  Description of Artificial Sequence: Synthetic oligonucleotide
  Target: ATXN1; (-) strand; PAM type: NRG; PAM sequence: GAG
aaagatggtagggacccaaa

SEQ ID NO: 81311 - DNA, 20 bp, Artificial Sequence
  Description of Artificial Sequence: Synthetic oligonucleotide
  Target: ATXN1; (-) strand; PAM type: NRG; PAM sequence: AAG
ttaaagatggtagggaccca

SEQ ID NO: 81312 - DNA, 20 bp, Artificial Sequence
  Description of Artificial Sequence: Synthetic oligonucleotide
  Target: ATXN1; (-) strand; PAM type: NRG; PAM sequence: GGG
tacagctcttaaagatggta

SEQ ID NO: 81313 - DNA, 20 bp, Artificial Sequence
  Description of Artificial Sequence: Synthetic oligonucleotide
  Target: ATXN1; (-) strand; PAM type: NRG; PAM sequence: AGG
ttacagctcttaaagatggt

SEQ ID NO: 81314 - DNA, 20 bp, Artificial Sequence
  Description of Artificial Sequence: Synthetic oligonucleotide
  Target: ATXN1; (-) strand; PAM type: NRG; PAM sequence: TAG
gttacagctcttaaagatgg

SEQ ID NO: 81315 - DNA, 20 bp, Artificial Sequence
  Description of Artificial Sequence: Synthetic oligonucleotide
  Target: ATXN1; (-) strand; PAM type: NRG; PAM sequence: TGG
agtgttacagctcttaaaga

SEQ ID NO: 81316 - DNA, 20 bp, Artificial Sequence
  Description of Artificial Sequence: Synthetic oligonucleotide
  Target: ATXN1; (-) strand; PAM type: NRG; PAM sequence: AAG
agtgagtgttacagctctta

SEQ ID NO: 81317 - DNA, 20 bp, Artificial Sequence
  Description of Artificial Sequence: Synthetic oligonucleotide
  Target: ATXN1; (-) strand; PAM type: NRG; PAM sequence: CAG
gaccttcacagtgagtgtta

SEQ ID NO: 81318 - DNA, 20 bp, Artificial Sequence
  Description of Artificial Sequence: Synthetic oligonucleotide
  Target: ATXN1; (-) strand; PAM type: NRG; PAM sequence: GAG
gagccacggaccttcacagt

SEQ ID NO: 81319 - DNA, 20 bp, Artificial Sequence
  Description of Artificial Sequence: Synthetic oligonucleotide
  Target: ATXN1; (-) strand; PAM type: NRG; PAM sequence: CAG
aatggagccacggaccttca

SEQ ID NO: 81320 - DNA, 20 bp, Artificial Sequence
  Description of Artificial Sequence: Synthetic oligonucleotide
  Target: ATXN1; (-) strand; PAM type: NRG; PAM sequence: CGG
tgacttcaagaatggagcca

SEQ ID NO: 81321 - DNA, 20 bp, Artificial Sequence
  Description of Artificial Sequence: Synthetic oligonucleotide
  Target: ATXN1; (-) strand; PAM type: NRG; PAM sequence: GAG
tcttgctgacttcaagaatg

SEQ ID NO: 81322 - DNA, 20 bp, Artificial Sequence
  Description of Artificial Sequence: Synthetic oligonucleotide
  Target: ATXN1; (-) strand; PAM type: NRG; PAM sequence: TGG
ggtcttgctgacttcaagaa

SEQ ID NO: 81323 - DNA, 20 bp, Artificial Sequence
  Description of Artificial Sequence: Synthetic oligonucleotide
  Target: ATXN1; (-) strand; PAM type: NRG; PAM sequence: AAG
tttgtggtcttgctgacttc

SEQ ID NO: 81324 - DNA, 20 bp, Artificial Sequence
  Description of Artificial Sequence: Synthetic oligonucleotide
  Target: ATXN1; (-) strand; PAM type: NRG; PAM sequence: TGG
ggttccttccgataggtttg

SEQ ID NO: 81325 - DNA, 20 bp, Artificial Sequence
  Description of Artificial Sequence: Synthetic oligonucleotide
  Target: ATXN1; (-) strand; PAM type: NRG; PAM sequence: AGG
tggagttggttccttccgat

SEQ ID NO: 81326 - DNA, 20 bp, Artificial Sequence
  Description of Artificial Sequence: Synthetic oligonucleotide
  Target: ATXN1; (-) strand; PAM type: NRG; PAM sequence: TAG
ctggagttggttccttccga

SEQ ID NO: 81327 - DNA, 20 bp, Artificial Sequence
  Description of Artificial Sequence: Synthetic oligonucleotide
  Target: ATXN1; (-) strand; PAM type: NRG; PAM sequence: TGG
ggtgagcctgtgtctggagt

SEQ ID NO: 81328 - DNA, 20 bp, Artificial Sequence
  Description of Artificial Sequence: Synthetic oligonucleotide
  Target: ATXN1; (-) strand; PAM type: NRG; PAM sequence: GAG
ttgcggtgagcctgtgtctg

SEQ ID NO: 81329 - DNA, 20 bp, Artificial Sequence
  Description of Artificial Sequence: Synthetic oligonucleotide
  Target: ATXN1; (-) strand; PAM type: NRG; PAM sequence: TGG
ggttgcggtgagcctgtgtc

SEQ ID NO: 81330 - DNA, 20 bp, Artificial Sequence
  Description of Artificial Sequence: Synthetic oligonucleotide
  Target: ATXN1; (-) strand; PAM type: NRG; PAM sequence: GAG
taggaggtggaggttgcggt

SEQ ID NO: 81331 - DNA, 20 bp, Artificial Sequence
  Description of Artificial Sequence: Synthetic oligonucleotide
  Target: ATXN1; (-) strand; PAM type: NRG; PAM sequence: CGG
aacctaggaggtggaggttg

SEQ ID NO: 81332 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacctaggaggtgg

SEQ ID NO: 81333 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacctaggaggtg

SEQ ID NO: 81334 - DNA, 20 bp, Artificial Sequence
  Description of Artificial Sequence: Synthetic oligonucleotide
  Target: ATXN1; (-) strand; PAM type: NRG; PAM sequence: TGG
aatcgcttgaacctaggagg

SEQ ID NO: 81335 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacctagg

SEQ ID NO: 81336 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacctag

SEQ ID NO: 81337 - DNA, 20 bp, Artificial Sequence
  Description of Artificial Sequence: Synthetic oligonucleotide
  Target: ATXN1; (-) strand; PAM type: NRG; PAM sequence: AGG
caggagaatcgcttgaacct

SEQ ID NO: 81338 - DNA, 20 bp, Artificial Sequence
  Description of Artificial Sequence: Synthetic oligonucleotide
  Target: ATXN1; (-) strand; PAM type: NRG; PAM sequence: TAG
gcaggagaatcgcttgaacc

SEQ ID NO: 81339 - DNA, 20 bp, Artificial Sequence
  Description of Artificial Sequence: Synthetic oligonucleotide
  Target: ATXN1; (-) strand; PAM type: NRG; PAM sequence: GAG
tacttaggcggctgaggcag

SEQ ID NO: 81340 - DNA, 20 bp, Artificial Sequence
  Description of Artificial Sequence: Synthetic oligonucleotide
  Target: ATXN1; (-) strand; PAM type: NRG; PAM sequence: AGG
gctacttaggcggctgaggc

SEQ ID NO: 81341 - DNA, 20 bp, Artificial Sequence
  Description of Artificial Sequence: Synthetic oligonucleotide
  Target: ATXN1; (-) strand; PAM type: NRG; PAM sequence: CAG
agctacttaggcggctgagg

SEQ ID NO: 81342 - DNA, 20 bp, Artificial Sequence
  Description of Artificial Sequence: Synthetic oligonucleotide
  Target: ATXN1; (-) strand; PAM type: NRG; PAM sequence: AGG
cccagctacttaggcggctg

SEQ ID NO: 81343 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttaggcggct

SEQ ID NO: 81344 - DNA, 20 bp, Artificial Sequence
  Description of Artificial Sequence: Synthetic oligonucleotide
  Target: ATXN1; (-) strand; PAM type: NRG; PAM sequence: CGG
tgtaatcccagctacttagg

SEQ ID NO: 81345 - DNA, 20 bp, Artificial Sequence
  Description of Artificial Sequence: Synthetic oligonucleotide
  Target: ATXN1; (-) strand; PAM type: NRG; PAM sequence: AGG
gcctgtaatcccagctactt

SEQ ID NO: 81346 - DNA, 20 bp, Artificial Sequence
  Description of Artificial Sequence: Synthetic oligonucleotide
  Target: ATXN1; (-) strand; PAM type: NRG; PAM sequence: TAG
tgcctgtaatcccagctact

SEQ ID NO: 81347 - DNA, 20 bp, Artificial Sequence
  Description of Artificial Sequence: Synthetic oligonucleotide
  Target: ATXN1; (-) strand; PAM type: NRG; PAM sequence: CAG
gtggggcatgcctgtaatcc

SEQ ID NO: 81348 - DNA, 20 bp, Artificial Sequence
  Description of Artificial Sequence: Synthetic oligonucleotide
  Target: ATXN1; (-) strand; PAM type: NRG; PAM sequence: GGG
aaaattagccgggtgtggtg

SEQ ID NO: 81349 - DNA, 20 bp, Artificial Sequence
  Description of Artificial Sequence: Synthetic oligonucleotide
  Target: ATXN1; (-) strand; PAM type: NRG; PAM sequence: GGG
caaaattagccgggtgtggt

SEQ ID NO: 81350 - DNA, 20 bp, Artificial Sequence
  Description of Artificial Sequence: Synthetic oligonucleotide
  Target: ATXN1; (-) strand; PAM type: NRG; PAM sequence: TGG
acaaaattagccgggtgtgg

SEQ ID NO: 81351 - DNA, 20 bp, Artificial Sequence
  Description of Artificial Sequence: Synthetic oligonucleotide
  Target: ATXN1; (-) strand; PAM type: NRG; PAM sequence: TGG
aatacaaaattagccgggtg

SEQ ID NO: 81352 - DNA, 20 bp, Artificial Sequence
  Description of Artificial Sequence: Synthetic oligonucleotide
  Target: ATXN1; (-) strand; PAM type: NRG; PAM sequence: GGG
ctaaaaatacaaaattagcc

SEQ ID NO: 81353 - DNA, 20 bp, Artificial Sequence
  Description of Artificial Sequence: Synthetic oligonucleotide
  Target: ATXN1; (-) strand; PAM type: NRG; PAM sequence: CGG
actaaaaatacaaaattagc

SEQ ID NO: 81354 - DNA, 20 bp, Artificial Sequence
  Description of Artificial Sequence: Synthetic oligonucleotide
  Target: ATXN1; (-) strand; PAM type: NRG; PAM sequence: TAG
ctctactaaaaatacaaaat

SEQ ID NO: 81355 - DNA, 20 bp, Artificial Sequence
  Description of Artificial Sequence: Synthetic oligonucleotide
  Target: ATXN1; (-) strand; PAM type: NRG; PAM sequence: GAG
gaaccagcctgaccaacatg

SEQ ID NO: 81356 - DNA, 20 bp, Artificial Sequence
  Description of Artificial Sequence: Synthetic oligonucleotide
  Target: ATXN1; (-) strand; PAM type: NRG; PAM sequence: TGG
aagaaccagcctgaccaaca

SEQ ID NO: 81357 - DNA, 20 bp, Artificial Sequence
  Description of Artificial Sequence: Synthetic oligonucleotide
  Target: ATXN1; (-) strand; PAM type: NRG; PAM sequence: CAG
gaggttgggagttcaagaac

SEQ ID NO: 81358 - DNA, 20 bp, Artificial Sequence
  Description of Artificial Sequence: Synthetic oligonucleotide
  Target: ATXN1; (-) strand; PAM type: NRG; PAM sequence: AAG
tcacctgaggttgggagttc

SEQ ID NO: 81359 - DNA, 20 bp, Artificial Sequence
  Description of Artificial Sequence: Synthetic oligonucleotide
  Target: ATXN1; (-) strand; PAM type: NRG; PAM sequence: GAG
ggcgaatcacctgaggttgg

SEQ ID NO: 81360 - DNA, 20 bp, Artificial Sequence
  Description of Artificial Sequence: Synthetic oligonucleotide
  Target: ATXN1; (-) strand; PAM type: NRG; PAM sequence: GGG
caggcgaatcacctgaggtt

SEQ ID NO: 81361 - DNA, 20 bp, Artificial Sequence
  Description of Artificial Sequence: Synthetic oligonucleotide
  Target: ATXN1; (-) strand; PAM type: NRG; PAM sequence: TGG
gcaggcgaatcacctgaggt

SEQ ID NO: 81362 - DNA, 20 bp, Artificial Sequence
  Description of Artificial Sequence: Synthetic oligonucleotide
  Target: ATXN1; (-) strand; PAM type: NRG; PAM sequence: AGG
tgaggcaggcgaatcacctg

SEQ ID NO: 81363 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggcgaatcacct

SEQ ID NO: 81364 - DNA, 20 bp, Artificial Sequence
  Description of Artificial Sequence: Synthetic oligonucleotide
  Target: ATXN1; (-) strand; PAM type: NRG; PAM sequence: AGG
gcaccttgggaagctgaggc

SEQ ID NO: 81365 - DNA, 20 bp, Artificial Sequence
  Description of Artificial Sequence: Synthetic oligonucleotide
  Target: ATXN1; (-) strand; PAM type: NRG; PAM sequence: CAG
agcaccttgggaagctgagg

SEQ ID NO: 81366 - DNA, 20 bp, Artificial Sequence
  Description of Artificial Sequence: Synthetic oligonucleotide
  Target: ATXN1; (-) strand; PAM type: NRG; PAM sequence: AGG
cccagcaccttgggaagctg

SEQ ID NO: 81367 - DNA, 20 bp, Artificial Sequence
  Description of Artificial Sequence: Synthetic oligonucleotide
  Target: ATXN1; (-) strand; PAM type: NRG; PAM sequence: GAG
tcccagcaccttgggaagct

SEQ ID NO: 81368 - DNA, 20 bp, Artificial Sequence
  Description of Artificial Sequence: Synthetic oligonucleotide
  Target: ATXN1; (-) strand; PAM type: NRG; PAM sequence: AAG
tgtaatcccagcaccttggg

SEQ ID NO: 81369 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacctt

SEQ ID NO: 81370 - DNA, 20 bp, Artificial Sequence
  Description of Artificial Sequence: Synthetic oligonucleotide
  Target: ATXN1; (-) strand; PAM type: NRG; PAM sequence: TGG
ggcctgtaatcccagcacct

SEQ ID NO: 81371 - DNA, 20 bp, Artificial Sequence
  Description of Artificial Sequence: Synthetic oligonucleotide
  Target: ATXN1; (-) strand; PAM type: NRG; PAM sequence: CAG
atggctcaggcctgtaatcc

SEQ ID NO: 81372 - DNA, 20 bp, Artificial Sequence
  Description of Artificial Sequence: Synthetic oligonucleotide
  Target: ATXN1; (-) strand; PAM type: NRG; PAM sequence: AGG
ggggccgggcgcaatggctc

SEQ ID NO: 81373 - DNA, 20 bp, Artificial Sequence
  Description of Artificial Sequence: Synthetic oligonucleotide
  Target: ATXN1; (-) strand; PAM type: NRG; PAM sequence: CAG
aggggccgggcgcaatggct

SEQ ID NO: 81374 - DNA, 20 bp, Artificial Sequence
  Description of Artificial Sequence: Synthetic oligonucleotide
  Target: ATXN1; (-) strand; PAM type: NRG; PAM sequence: TGG
aacccaggggccgggcgcaa

SEQ ID NO: 81375 - DNA, 20 bp, Artificial Sequence
  Description of Artificial Sequence: Synthetic oligonucleotide
  Target: ATXN1; (-) strand; PAM type: NRG; PAM sequence: GGG
aagaaagaaacccaggggcc

SEQ ID NO: 81376 - DNA, 20 bp, Artificial Sequence
  Description of Artificial Sequence: Synthetic oligonucleotide
  Target: ATXN1; (-) strand; PAM type: NRG; PAM sequence: CGG
taagaaagaaacccaggggc

SEQ ID NO: 81377 - DNA, 20 bp, Artificial Sequence
  Description of Artificial Sequence: Synthetic oligonucleotide
  Target: ATXN1; (-) strand; PAM type: NRG; PAM sequence: GGG
gccttaagaaagaaacccag

SEQ ID NO: 81378 - DNA, 20 bp, Artificial Sequence
  Description of Artificial Sequence: Synthetic oligonucleotide
  Target: ATXN1; (-) strand; PAM type: NRG; PAM sequence: GGG
agccttaagaaagaaaccca

SEQ ID NO: 81379 - DNA, 20 bp, Artificial Sequence
  Description of Artificial Sequence: Synthetic oligonucleotide
  Target: ATXN1; (-) strand; PAM type: NRG; PAM sequence: AGG
aagccttaagaaagaaaccc

SEQ ID NO: 81380 - DNA, 20 bp, Artificial Sequence
  Description of Artificial Sequence: Synthetic oligonucleotide
  Target: ATXN1; (-) strand; PAM type: NRG; PAM sequence: CAG
aaagccttaagaaagaaacc

SEQ ID NO: 81381 - DNA, 20 bp, Artificial Sequence
  Description of Artificial Sequence: Synthetic oligonucleotide
  Target: ATXN1; (-) strand; PAM type: NRG; PAM sequence: AAG
gagctccaaaagccttaaga

SEQ ID NO: 81382 - DNA, 20 bp, Artificial Sequence
  Description of Artificial Sequence: Synthetic oligonucleotide
  Target: ATXN1; (-) strand; PAM type: NRG; PAM sequence: AAG
cttggagctccaaaagcctt

SEQ ID NO: 81383 - DNA, 20 bp, Artificial Sequence
  Description of Artificial Sequence: Synthetic oligonucleotide
  Target: ATXN1; (-) strand; PAM type: NRG; PAM sequence: AAG
ctggccccttggagctccaa

SEQ ID NO: 81384 - DNA, 20 bp, Artificial Sequence
  Description of Artificial Sequence: Synthetic oligonucleotide
  Target: ATXN1; (-) strand; PAM type: NRG; PAM sequence: GAG
tgcacttccctggccccttg

SEQ ID NO: 81385 - DNA, 20 bp, Artificial Sequence
  Description of Artificial Sequence: Synthetic oligonucleotide
  Target: ATXN1; (-) strand; PAM type: NRG; PAM sequence: TGG
gctgcacttccctggcccct

SEQ ID NO: 81386 - DNA, 20 bp, Artificial Sequence
  Description of Artificial Sequence: Synthetic oligonucleotide
  Target: ATXN1; (-) strand; PAM type: NRG; PAM sequence: TGG
tggttgaagctgcacttccc

SEQ ID NO: 81387 - DNA, 20 bp, Artificial Sequence
  Description of Artificial Sequence: Synthetic oligonucleotide
  Target: ATXN1; (-) strand; PAM type: NRG; PAM sequence: AAG
acaatggctgctgctggttg

SEQ ID NO: 81388 - DNA, 20 bp, Artificial Sequence
  Description of Artificial Sequence: Synthetic oligonucleotide
  Target: ATXN1; (-) strand; PAM type: NRG; PAM sequence: TGG
gttagaacaatggctgctgc

SEQ ID NO: 81389 - DNA, 20 bp, Artificial Sequence
  Description of Artificial Sequence: Synthetic oligonucleotide
  Target: ATXN1; (-) strand; PAM type: NRG; PAM sequence: TGG
tcagatttctgttagaacaa

SEQ ID NO: 81390 - DNA, 20 bp, Artificial Sequence
  Description of Artificial Sequence: Synthetic oligonucleotide
  Target: ATXN1; (-) strand; PAM type: NRG; PAM sequence: TAG
tgttattttcagatttctgt

SEQ ID NO: 81391 - DNA, 20 bp, Artificial Sequence
  Description of Artificial Sequence: Synthetic oligonucleotide
  Target: ATXN1; (-) strand; PAM type: NRG; PAM sequence: CAG
cagagtgaatgtgttatttt

SEQ ID NO: 81392 - DNA, 20 bp, Artificial Sequence
  Description of Artificial Sequence: Synthetic oligonucleotide
  Target: ATXN1; (-) strand; PAM type: NRG; PAM sequence: GAG
agtagtgagttggcatgtca

SEQ ID NO: 81393 - DNA, 20 bp, Artificial Sequence
  Description of Artificial Sequence: Synthetic oligonucleotide
  Target: ATXN1; (-) strand; PAM type: NRG; PAM sequence: CAG
aaagtagtgagttggcatgt

SEQ ID NO: 81394 - DNA, 20 bp, Artificial Sequence
  Description of Artificial Sequence: Synthetic oligonucleotide
  Target: ATXN1; (-) strand; PAM type: NRG; PAM sequence: TGG
cacaattaaaagtagtgagt

SEQ ID NO: 81395 - DNA, 20 bp, Artificial Sequence
  Description of Artificial Sequence: Synthetic oligonucleotide
  Target: ATXN1; (-) strand; PAM type: NRG; PAM sequence: GAG
gagccacaattaaaagtagt

SEQ ID NO: 81396 - DNA, 20 bp, Artificial Sequence
  Description of Artificial Sequence: Synthetic oligonucleotide
  Target: ATXN1; (-) strand; PAM type: NRG; PAM sequence: TAG
taatgagccacaattaaaag

SEQ ID NO: 81397 - DNA, 20 bp, Artificial Sequence
  Description of Artificial Sequence: Synthetic oligonucleotide
  Target: ATXN1; (-) strand; PAM type: NRG; PAM sequence: AAG
ctttaatgagccacaattaa

SEQ ID NO: 81398 - DNA, 20 bp, Artificial Sequence
  Description of Artificial Sequence: Synthetic oligonucleotide
  Target: ATXN1; (-) strand; PAM type: NRG; PAM sequence: GAG
cttctatttacatctttaat

SEQ ID NO: 81399 - DNA, 20 bp, Artificial Sequence
  Description of Artificial Sequence: Synthetic oligonucleotide
  Target: ATXN1; (-) strand; PAM type: NRG; PAM sequence: AGG
cagcaatgaaattgtagtag

SEQ ID NO: 81400 - DNA, 20 bp, Artificial Sequence
  Description of Artificial Sequence: Synthetic oligonucleotide
  Target: ATXN1; (-) strand; PAM type: NRG; PAM sequence: GAG
gcagcaatgaaattgtagta

SEQ ID NO: 81401 - DNA, 20 bp, Artificial Sequence
  Description of Artificial Sequence: Synthetic oligonucleotide
  Target: ATXN1; (-) strand; PAM type: NRG; PAM sequence: TAG
ctgcagcaatgaaattgtag

SEQ ID NO: 81402 - DNA, 20 bp, Artificial Sequence
  Description of Artificial Sequence: Synthetic oligonucleotide
  Target: ATXN1; (-) strand; PAM type: NRG; PAM sequence: TAG
ttactgcagcaatgaaattg

SEQ ID NO: 81403 - DNA, 20 bp, Artificial Sequence
  Description of Artificial Sequence: Synthetic oligonucleotide
  Target: ATXN1; (-) strand; PAM type: NRG; PAM sequence: CAG
gaaacattgtaattttactg

SEQ ID NO: 81404 - DNA, 20 bp, Artificial Sequence
  Description of Artificial Sequence: Synthetic oligonucleotide
  Target: ATXN1; (-) strand; PAM type: NRG; PAM sequence: AGG
agtatttctttctgcataga

SEQ ID NO: 81405 - DNA, 20 bp, Artificial Sequence
  Description of Artificial Sequence: Synthetic oligonucleotide
  Target: ATXN1; (-) strand; PAM type: NRG; PAM sequence: AAG
aagtatttctttctgcatag

SEQ ID NO: 81406 - DNA, 20 bp, Artificial Sequence
  Description of Artificial Sequence: Synthetic oligonucleotide
  Target: ATXN1; (-) strand; PAM type: NRG; PAM sequence: TAG
aagaagtatttctttctgca

SEQ ID NO: 81407 - DNA, 20 bp, Artificial Sequence
  Description of Artificial Sequence: Synthetic oligonucleotide
  Target: ATXN1; (-) strand; PAM type: NRG; PAM sequence: AAG
ggtgctattactcagagaag

SEQ ID NO: 81408 - DNA, 20 bp, Artificial Sequence
  Description of Artificial Sequence: Synthetic oligonucleotide
  Target: ATXN1; (-) strand; PAM type: NRG; PAM sequence: AAG
tctggtgctattactcagag

SEQ ID NO: 81409 - DNA, 20 bp, Artificial Sequence
  Description of Artificial Sequence: Synthetic oligonucleotide
  Target: ATXN1; (-) strand; PAM type: NRG; PAM sequence: GAG
acttctggtgctattactca

SEQ ID NO: 81410 - DNA, 20 bp, Artificial Sequence
  Description of Artificial Sequence: Synthetic oligonucleotide
  Target: ATXN1; (-) strand; PAM type: NRG; PAM sequence: CAG
ccacttctggtgctattact

SEQ ID NO: 81411 - DNA, 20 bp, Artificial Sequence
  Description of Artificial Sequence: Synthetic oligonucleotide
  Target: ATXN1; (-) strand; PAM type: NRG; PAM sequence: TGG
gaatcataggcctccacttc

SEQ ID NO: 81412 - DNA, 20 bp, Artificial Sequence
  Description of Artificial Sequence: Synthetic oligonucleotide
  Target: ATXN1; (-) strand; PAM type: NRG; PAM sequence: AGG
ttggagaattggtgaatcat

SEQ ID NO: 81413 - DNA, 20 bp, Artificial Sequence
  Description of Artificial Sequence: Synthetic oligonucleotide
  Target: ATXN1; (-) strand; PAM type: NRG; PAM sequence: TAG
gttggagaattggtgaatca

SEQ ID NO: 81414 - DNA, 20 bp, Artificial Sequence
  Description of Artificial Sequence: Synthetic oligonucleotide
  Target: ATXN1; (-) strand; PAM type: NRG; PAM sequence: TGG
gatgcctactgttggagaat

SEQ ID NO: 81415 - DNA, 20 bp, Artificial Sequence
  Description of Artificial Sequence: Synthetic oligonucleotide
  Target: ATXN1; (-) strand; PAM type: NRG; PAM sequence: GAG
acatgtgatgcctactgttg

SEQ ID NO: 81416 - DNA, 20 bp, Artificial Sequence
  Description of Artificial Sequence: Synthetic oligonucleotide
  Target: ATXN1; (-) strand; PAM type: NRG; PAM sequence: TGG
tcacatgtgatgcctactgt

SEQ ID NO: 81417 - DNA, 20 bp, Artificial Sequence
  Description of Artificial Sequence: Synthetic oligonucleotide
  Target: ATXN1; (-) strand; PAM type: NRG; PAM sequence: CAG
tgcctctgtccaacaacagg

SEQ ID NO: 81418 - DNA, 20 bp, Artificial Sequence
  Description of Artificial Sequence: Synthetic oligonucleotide
  Target: ATXN1; (-) strand; PAM type: NRG; PAM sequence: AGG
atctgcctctgtccaacaac

SEQ ID NO: 81419 - DNA, 20 bp, Artificial Sequence
  Description of Artificial Sequence: Synthetic oligonucleotide
  Target: ATXN1; (-) strand; PAM type: NRG; PAM sequence: CAG
catctgcctctgtccaacaa

SEQ ID NO: 81420 - DNA, 20 bp, Artificial Sequence
  Description of Artificial Sequence: Synthetic oligonucleotide
  Target: ATXN1; (-) strand; PAM type: NRG; PAM sequence: GAG
aaagtgaaatgcaataaaat

SEQ ID NO: 81421 - DNA, 20 bp, Artificial Sequence
  Description of Artificial Sequence: Synthetic oligonucleotide
  Target: ATXN1; (-) strand; PAM type: NRG; PAM sequence: AAG
agtatctgcaaaggacaaca

SEQ ID NO: 81422 - DNA, 20 bp, Artificial Sequence
  Description of Artificial Sequence: Synthetic oligonucleotide
  Target: ATXN1; (-) strand; PAM type: NRG; PAM sequence: AGG
aaaaaatgcagtatctgcaa

SEQ ID NO: 81423 - DNA, 20 bp, Artificial Sequence
  Description of Artificial Sequence: Synthetic oligonucleotide
  Target: ATXN1; (-) strand; PAM type: NRG; PAM sequence: AAG
aaaaaaatgcagtatctgca

SEQ ID NO: 81424 - DNA, 20 bp, Artificial Sequence
  Description of Artificial Sequence: Synthetic oligonucleotide
  Target: ATXN1; (-) strand; PAM type: NRG; PAM sequence: CAG
ttcaatttgaaaaaaaaatg

SEQ ID NO: 81425 - DNA, 20 bp, Artificial Sequence
  Description of Artificial Sequence: Synthetic oligonucleotide
  Target: ATXN1; (-) strand; PAM type: NRG; PAM sequence: CAG
tgcttgacacggggttgcca

SEQ ID NO: 81426 - DNA, 20 bp, Artificial Sequence
  Description of Artificial Sequence: Synthetic oligonucleotide
  Target: ATXN1; (-) strand; PAM type: NRG; PAM sequence: GGG
tggtggagttgcttgacacg

SEQ ID NO: 81427 - DNA, 20 bp, Artificial Sequence
  Description of Artificial Sequence: Synthetic oligonucleotide
  Target: ATXN1; (-) strand; PAM type: NRG; PAM sequence: GGG
ctggtggagttgcttgacac

SEQ ID NO: 81428 - DNA, 20 bp, Artificial Sequence
  Description of Artificial Sequence: Synthetic oligonucleotide
  Target: ATXN1; (-) strand; PAM type: NRG; PAM sequence: CGG
gctggtggagttgcttgaca

SEQ ID NO: 81429 - DNA, 20 bp, Artificial Sequence
  Description of Artificial Sequence: Synthetic oligonucleotide
  Target: ATXN1; (-) strand; PAM type: NRG; PAM sequence: GAG
ttggagaggtgatgctggtg

SEQ ID NO: 81430 - DNA, 20 bp, Artificial Sequence
  Description of Artificial Sequence: Synthetic oligonucleotide
  Target: ATXN1; (-) strand; PAM type: NRG; PAM sequence: TGG
tgttggagaggtgatgctgg

SEQ ID NO: 81431 - DNA, 20 bp, Artificial Sequence
  Description of Artificial Sequence: Synthetic oligonucleotide
  Target: ATXN1; (-) strand; PAM type: NRG; PAM sequence: TGG
tgctgttggagaggtgatgc

SEQ ID NO: 81432 - DNA, 20 bp, Artificial Sequence
  Description of Artificial Sequence: Synthetic oligonucleotide
  Target: ATXN1; (-) strand; PAM type: NRG; PAM sequence: AGG
atgagcacatgctgttggag

SEQ ID NO: 81433 - DNA, 20 bp, Artificial Sequence
  Description of Artificial Sequence: Synthetic oligonucleotide
  Target: ATXN1; (-) strand; PAM type: NRG; PAM sequence: GAG
catgagcacatgctgttgga

SEQ ID NO: 81434 - DNA, 20 bp, Artificial Sequence
  Description of Artificial Sequence: Synthetic oligonucleotide
  Target: ATXN1; (-) strand; PAM type: NRG; PAM sequence: GAG
aacatgagcacatgctgttg

SEQ ID NO: 81435 - DNA, 20 bp, Artificial Sequence
  Description of Artificial Sequence: Synthetic oligonucleotide
  Target: ATXN1; (-) strand; PAM type: NRG; PAM sequence: TGG
tcaacatgagcacatgctgt

SEQ ID NO: 81436 - DNA, 20 bp, Artificial Sequence
  Description of Artificial Sequence: Synthetic oligonucleotide
  Target: ATXN1; (-) strand; PAM type: NRG; PAM sequence: GAG
atgtggcagaggctcaacat

SEQ ID NO: 81437 - DNA, 20 bp, Artificial Sequence
  Description of Artificial Sequence: Synthetic oligonucleotide
  Target: ATXN1; (-) strand; PAM type: NRG; PAM sequence: AGG
gtattaccgaaatgtggcag

SEQ ID NO: 81438 - DNA, 20 bp, Artificial Sequence
  Description of Artificial Sequence: Synthetic oligonucleotide
  Target: ATXN1; (-) strand; PAM type: NRG; PAM sequence: GAG
tgtattaccgaaatgtggca

SEQ ID NO: 81439 - DNA, 20 bp, Artificial Sequence
  Description of Artificial Sequence: Synthetic oligonucleotide
  Target: ATXN1; (-) strand; PAM type: NRG; PAM sequence: CAG
actgtattaccgaaatgtgg

SEQ ID NO: 81440 - DNA, 20 bp, Artificial Sequence
  Description of Artificial Sequence: Synthetic oligonucleotide
  Target: ATXN1; (-) strand; PAM type: NRG; PAM sequence: TGG
aatactgtattaccgaaatg

SEQ ID NO: 81441 - DNA, 20 bp, Artificial Sequence
  Description of Artificial Sequence: Synthetic oligonucleotide
  Target: ATXN1; (-) strand; PAM type: NRG; PAM sequence: AAG
taacagatataacagcgcaa

SEQ ID NO: 81442 - DNA, 20 bp, Artificial Sequence
  Description of Artificial Sequence: Synthetic oligonucleotide
  Target: ATXN1; (-) strand; PAM type: NRG; PAM sequence: CAG
gatcaccataacagatataa

SEQ ID NO: 81443 - DNA, 20 bp, Artificial Sequence
  Description of Artificial Sequence: Synthetic oligonucleotide
  Target: ATXN1; (-) strand; PAM type: NRG; PAM sequence: CAG
ctgatctcagatcaccataa

SEQ ID NO: 81444 - DNA, 20 bp, Artificial Sequence
  Description of Artificial Sequence: Synthetic oligonucleotide
  Target: ATXN1; (-) strand; PAM type: NRG; PAM sequence: CAG
acgtcaaagagcactgatct

SEQ ID NO: 81445 - DNA, 20 bp, Artificial Sequence
  Description of Artificial Sequence: Synthetic oligonucleotide
  Target: ATXN1; (-) strand; PAM type: NRG; PAM sequence: GAG
attataatagtaacgtcaaa

SEQ ID NO: 81446 - DNA, 20 bp, Artificial Sequence
  Description of Artificial Sequence: Synthetic oligonucleotide
  Target: ATXN1; (-) strand; PAM type: NRG; PAM sequence: AAG
caattataatagtaacgtca

SEQ ID NO: 81447 - DNA, 20 bp, Artificial Sequence
  Description of Artificial Sequence: Synthetic oligonucleotide
  Target: ATXN1; (-) strand; PAM type: NRG; PAM sequence: TAG
ggtgaacaaaacaattataa

SEQ ID NO: 81448 - DNA, 20 bp, Artificial Sequence
  Description of Artificial Sequence: Synthetic oligonucleotide
  Target: ATXN1; (-) strand; PAM type: NRG; PAM sequence: TGG
tatatggggtgtgtggttca

SEQ ID NO: 81449 - DNA, 20 bp, Artificial Sequence
  Description of Artificial Sequence: Synthetic oligonucleotide
  Target: ATXN1; (-) strand; PAM type: NRG; PAM sequence: TGG
attaccttatatggggtgtg

SEQ ID NO: 81450 - DNA, 20 bp, Artificial Sequence
  Description of Artificial Sequence: Synthetic oligonucleotide
  Target: ATXN1; (-) strand; PAM type: NRG; PAM sequence: GGG
taagttcattaccttatatg

SEQ ID NO: 81451 - DNA, 20 bp, Artificial Sequence
  Description of Artificial Sequence: Synthetic oligonucleotide
  Target: ATXN1; (-) strand; PAM type: NRG; PAM sequence: GGG
ttaagttcattaccttatat

SEQ ID NO: 81452 - DNA, 20 bp, Artificial Sequence
  Description of Artificial Sequence: Synthetic oligonucleotide
  Target: ATXN1; (-) strand; PAM type: NRG; PAM sequence: TGG
attaagttcattaccttata

SEQ ID NO: 81453 - DNA, 20 bp, Artificial Sequence
  Description of Artificial Sequence: Synthetic oligonucleotide
  Target: ATXN1; (-) strand; PAM type: NRG; PAM sequence: AAG
acacatgacatttactgatt

SEQ ID NO: 81454 - DNA, 20 bp, Artificial Sequence
  Description of Artificial Sequence: Synthetic oligonucleotide
  Target: ATXN1; (-) strand; PAM type: NRG; PAM sequence: CAG
cagccagtctttgtagcagt

SEQ ID NO: 81455 - DNA, 20 bp, Artificial Sequence
  Description of Artificial Sequence: Synthetic oligonucleotide
  Target: ATXN1; (-) strand; PAM type: NRG; PAM sequence: CAG
agaacagccagtctttgtag

SEQ ID NO: 81456 - DNA, 20 bp, Artificial Sequence
  Description of Artificial Sequence: Synthetic oligonucleotide
  Target: ATXN1; (-) strand; PAM type: NRG; PAM sequence: TAG
gagagaacagccagtctttg

SEQ ID NO: 81457 - DNA, 20 bp, Artificial Sequence
  Description of Artificial Sequence: Synthetic oligonucleotide
  Target: ATXN1; (-) strand; PAM type: NRG; PAM sequence: CAG
gaggagggagagagaacagc

SEQ ID NO: 81458 - DNA, 20 bp, Artificial Sequence
  Description of Artificial Sequence: Synthetic oligonucleotide
  Target: ATXN1; (-) strand; PAM type: NRG; PAM sequence: CAG
ccgagaggagggagagagaa

SEQ ID NO: 81459 - DNA, 20 bp, Artificial Sequence
  Description of Artificial Sequence: Synthetic oligonucleotide
  Target: ATXN1; (-) strand; PAM type: NRG; PAM sequence: GAG
gaggcccgagaggagggaga

SEQ ID NO: 81460 - DNA, 20 bp, Artificial Sequence
  Description of Artificial Sequence: Synthetic oligonucleotide
  Target: ATXN1; (-) strand; PAM type: NRG; PAM sequence: GAG
aggaggcccgagaggaggga

SEQ ID NO: 81461 - DNA, 20 bp, Artificial Sequence
  Description of Artificial Sequence: Synthetic oligonucleotide
  Target: ATXN1; (-) strand; PAM type: NRG; PAM sequence: GAG
caaggaggcccgagaggagg

SEQ ID NO: 81462 - DNA, 20 bp, Artificial Sequence
  Description of Artificial Sequence: Synthetic oligonucleotide
  Target: ATXN1; (-) strand; PAM type: NRG; PAM sequence: GGG
aacaaggaggcccgagagga

SEQ ID NO: 81463 - DNA, 20 bp, Artificial Sequence
  Description of Artificial Sequence: Synthetic oligonucleotide
  Target: ATXN1; (-) strand; PAM type: NRG; PAM sequence: AGG
aaacaaggaggcccgagagg

SEQ ID NO: 81464 - DNA, 20 bp, Artificial Sequence
  Description of Artificial Sequence: Synthetic oligonucleotide
  Target: ATXN1; (-) strand; PAM type: NRG; PAM sequence: GAG
gaaacaaggaggcccgagag

SEQ ID NO: 81465 - DNA, 20 bp, Artificial Sequence
  Description of Artificial Sequence: Synthetic oligonucleotide
  Target: ATXN1; (-) strand; PAM type: NRG; PAM sequence: AGG
aggaaacaaggaggcccgag

SEQ ID NO: 81466 - DNA, 20 bp, Artificial Sequence
  Description of Artificial Sequence: Synthetic oligonucleotide
  Target: ATXN1; (-) strand; PAM type: NRG; PAM sequence: GAG
gaggaaacaaggaggcccga

SEQ ID NO: 81467 - DNA, 20 bp, Artificial Sequence
  Description of Artificial Sequence: Synthetic oligonucleotide
  Target: ATXN1; (-) strand; PAM type: NRG; PAM sequence: GAG
ctgaggaaacaaggaggccc

SEQ ID NO: 81468 - DNA, 20 bp, Artificial Sequence
  Description of Artificial Sequence: Synthetic oligonucleotide
  Target: ATXN1; (-) strand; PAM type: NRG; PAM sequence: AGG
ttgtgtctgaggaaacaagg

SEQ ID NO: 81469 - DNA, 20 bp, Artificial Sequence
  Description of Artificial Sequence: Synthetic oligonucleotide
  Target: ATXN1; (-) strand; PAM type: NRG; PAM sequence: GAG
cttgtgtctgaggaaacaag

SEQ ID NO: 81470 - DNA, 20 bp, Artificial Sequence
  Description of Artificial Sequence: Synthetic oligonucleotide
  Target: ATXN1; (-) strand; PAM type: NRG; PAM sequence: AGG
ttcttgtgtctgaggaaaca

SEQ ID NO: 81471 - DNA, 20 bp, Artificial Sequence
  Description of Artificial Sequence: Synthetic oligonucleotide
  Target: ATXN1; (-) strand; PAM type: NRG; PAM sequence: AAG
attcttgtgtctgaggaaac

SEQ ID NO: 81472 - DNA, 20 bp, Artificial Sequence
  Description of Artificial Sequence: Synthetic oligonucleotide
  Target: ATXN1; (-) strand; PAM type: NRG; PAM sequence: AGG
cttcaatattcttgtgtctg

SEQ ID NO: 81473 - DNA, 20 bp, Artificial Sequence
  Description of Artificial Sequence: Synthetic oligonucleotide
  Target: ATXN1; (-) strand; PAM type: NRG; PAM sequence: GAG
acttcaatattcttgtgtct

SEQ ID NO: 81474 - DNA, 20 bp, Artificial Sequence
  Description of Artificial Sequence: Synthetic oligonucleotide
  Target: ATXN1; (-) strand; PAM type: NRG; PAM sequence: TGG
caggcgtgagcccccgtgcc

SEQ ID NO: 81475 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 81476 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 81477 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 81478 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 81479 - DNA, 20 bp, Artificial Sequence
  Description of Artificial Sequence: Synthetic oligonucleotide
  Target: ATXN1; (-) strand; PAM type: NRG; PAM sequence: TGG
accttggcctcccaaagtgc

SEQ ID NO: 81480 - DNA, 20 bp, Artificial Sequence
  Description of Artificial Sequence: Synthetic oligonucleotide
  Target: ATXN1; (-) strand; PAM type: NRG; PAM sequence: AAG
ctgcccaccttggcctccca

SEQ ID NO: 81481 - DNA, 20 bp, Artificial Sequence
  Description of Artificial Sequence: Synthetic oligonucleotide
  Target: ATXN1; (-) strand; PAM type: NRG; PAM sequence: TGG
aactcgtgatctgcccacct

SEQ ID NO: 81482 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttagccagga

SEQ ID NO: 81483 - DNA, 20 bp, Artificial Sequence
  Description of Artificial Sequence: Synthetic oligonucleotide
  Target: ATXN1; (-) strand; PAM type: NRG; PAM sequence: AGG
tgagtttcaccatgttagcc

SEQ ID NO: 81484 - DNA, 20 bp, Artificial Sequence
  Description of Artificial Sequence: Synthetic oligonucleotide
  Target: ATXN1; (-) strand; PAM type: NRG; PAM sequence: CAG
ttgagtttcaccatgttagc

SEQ ID NO: 81485 - DNA, 20 bp, Artificial Sequence
  Description of Artificial Sequence: Synthetic oligonucleotide
  Target: ATXN1; (-) strand; PAM type: NRG; PAM sequence: TAG
gagattgagtttcaccatgt

SEQ ID NO: 81486 - DNA, 20 bp, Artificial Sequence
  Description of Artificial Sequence: Synthetic oligonucleotide
  Target: ATXN1; (-) strand; PAM type: NRG; PAM sequence: GAG
ttgtatttttagtagagatt

SEQ ID NO: 81487 - DNA, 20 bp, Artificial Sequence
  Description of Artificial Sequence: Synthetic oligonucleotide
  Target: ATXN1; (-) strand; PAM type: NRG; PAM sequence: GAG
aactttttgtatttttagta

SEQ ID NO: 81488 - DNA, 20 bp, Artificial Sequence
  Description of Artificial Sequence: Synthetic oligonucleotide
  Target: ATXN1; (-) strand; PAM type: NRG; PAM sequence: TAG
ctaactttttgtatttttag

SEQ ID NO: 81489 - DNA, 20 bp, Artificial Sequence
  Description of Artificial Sequence: Synthetic oligonucleotide
  Target: ATXN1; (-) strand; PAM type: NRG; PAM sequence: TAG
cggctaactttttgtatttt

SEQ ID NO: 81490 - DNA, 20 bp, Artificial Sequence
  Description of Artificial Sequence: Synthetic oligonucleotide
  Target: ATXN1; (-) strand; PAM type: NRG; PAM sequence: CGG
caggcacccgccactacgtc

SEQ ID NO: 81491 - DNA, 20 bp, Artificial Sequence
  Description of Artificial Sequence: Synthetic oligonucleotide
  Target: ATXN1; (-) strand; PAM type: NRG; PAM sequence: AGG
tcccgaatagctgagactac

SEQ ID NO: 81492 - DNA, 20 bp, Artificial Sequence
  Description of Artificial Sequence: Synthetic oligonucleotide
  Target: ATXN1; (-) strand; PAM type: NRG; PAM sequence: CAG
ctcccgaatagctgagacta

SEQ ID NO: 81493 - DNA, 20 bp, Artificial Sequence
  Description of Artificial Sequence: Synthetic oligonucleotide
  Target: ATXN1; (-) strand; PAM type: NRG; PAM sequence: GAG
cctcagcctcccgaatagct

SEQ ID NO: 81494 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgaa

SEQ ID NO: 81495 - DNA, 20 bp, Artificial Sequence
  Description of Artificial Sequence: Synthetic oligonucleotide
  Target: ATXN1; (-) strand; PAM type: NRG; PAM sequence: CAG
ttcacgccattctcctgcct

SEQ ID NO: 81496 - DNA, 20 bp, Artificial Sequence
  Description of Artificial Sequence: Synthetic oligonucleotide
  Target: ATXN1; (-) strand; PAM type: NRG; PAM sequence: GGG
tactgcaagctccgcctccc

SEQ ID NO: 81497 - DNA, 20 bp, Artificial Sequence
  Description of Artificial Sequence: Synthetic oligonucleotide
  Target: ATXN1; (-) strand; PAM type: NRG; PAM sequence: CGG
ttactgcaagctccgcctcc

SEQ ID NO: 81498 - DNA, 20 bp, Artificial Sequence
  Description of Artificial Sequence: Synthetic oligonucleotide
  Target: ATXN1; (-) strand; PAM type: NRG; PAM sequence: AAG
gcacgatctctgcttactgc

SEQ ID NO: 81499 - DNA, 20 bp, Artificial Sequence
  Description of Artificial Sequence: Synthetic oligonucleotide
  Target: ATXN1; (-) strand; PAM type: NRG; PAM sequence: TGG
tcacccaggcttgagtgcag

SEQ ID NO: 81500 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggcttgagtg

SEQ ID NO: 81501 - DNA, 20 bp, Artificial Sequence
  Description of Artificial Sequence: Synthetic oligonucleotide
  Target: ATXN1; (-) strand; PAM type: NRG; PAM sequence: GAG
tcgctctgtcacccaggctt

SEQ ID NO: 81502 - DNA, 20 bp, Artificial Sequence
  Description of Artificial Sequence: Synthetic oligonucleotide
  Target: ATXN1; (-) strand; PAM type: NRG; PAM sequence: AGG
agagtctcgctctgtcaccc

SEQ ID NO: 81503 - DNA, 20 bp, Artificial Sequence
  Description of Artificial Sequence: Synthetic oligonucleotide
  Target: ATXN1; (-) strand; PAM type: NRG; PAM sequence: CAG
cagagtctcgctctgtcacc

SEQ ID NO: 81504 - DNA, 20 bp, Artificial Sequence
  Description of Artificial Sequence: Synthetic oligonucleotide
  Target: ATXN1; (-) strand; PAM type: NRG; PAM sequence: GAG
tttttttcttttttgagaca

SEQ ID NO: 81505 - DNA, 20 bp, Artificial Sequence
  Description of Artificial Sequence: Synthetic oligonucleotide
  Target: ATXN1; (-) strand; PAM type: NRG; PAM sequence: CAG
tttttttttcttttttgaga

SEQ ID NO: 81506 - DNA, 20 bp, Artificial Sequence
  Description of Artificial Sequence: Synthetic oligonucleotide
  Target: ATXN1; (-) strand; PAM type: NRG; PAM sequence: GAG
cttttttttttttctttttt

SEQ ID NO: 81507 - DNA, 20 bp, Artificial Sequence
  Description of Artificial Sequence: Synthetic oligonucleotide
  Target: ATXN1; (-) strand; PAM type: NRG; PAM sequence: TGG
gctattttagggttattaat

SEQ ID NO: 81508 - DNA, 20 bp, Artificial Sequence
  Description of Artificial Sequence: Synthetic oligonucleotide
  Target: ATXN1; (-) strand; PAM type: NRG; PAM sequence: GGG
aatgcttagcggctatttta

SEQ ID NO: 81509 - DNA, 20 bp, Artificial Sequence
  Description of Artificial Sequence: Synthetic oligonucleotide
  Target: ATXN1; (-) strand; PAM type: NRG; PAM sequence: AGG
gaatgcttagcggctatttt

SEQ ID NO: 81510 - DNA, 20 bp, Artificial Sequence
  Description of Artificial Sequence: Synthetic oligonucleotide
  Target: ATXN1; (-) strand; PAM type: NRG; PAM sequence: TAG
tgaatgcttagcggctattt

SEQ ID NO: 81511 - DNA, 20 bp, Artificial Sequence
  Description of Artificial Sequence: Synthetic oligonucleotide
  Target: ATXN1; (-) strand; PAM type: NRG; PAM sequence: CGG
cctttcacttgaatgcttag

SEQ ID NO: 81512 - DNA, 20 bp, Artificial Sequence
  Description of Artificial Sequence: Synthetic oligonucleotide
  Target: ATXN1; (-) strand; PAM type: NRG; PAM sequence: TAG
cttcctttcacttgaatgct

SEQ ID NO: 81513 - DNA, 20 bp, Artificial Sequence
  Description of Artificial Sequence: Synthetic oligonucleotide
  Target: ATXN1; (-) strand; PAM type: NRG; PAM sequence: AGG
gttttcttatttaaattgag

SEQ ID NO: 81514 - DNA, 20 bp, Artificial Sequence
  Description of Artificial Sequence: Synthetic oligonucleotide
  Target: ATXN1; (-) strand; PAM type: NRG; PAM sequence: GAG
agttttcttatttaaattga

SEQ ID NO: 81515 - DNA, 20 bp, Artificial Sequence
  Description of Artificial Sequence: Synthetic oligonucleotide
  Target: ATXN1; (-) strand; PAM type: NRG; PAM sequence: GAG
ctagttttcttatttaaatt

SEQ ID NO: 81516 - DNA, 20 bp, Artificial Sequence
  Description of Artificial Sequence: Synthetic oligonucleotide
  Target: ATXN1; (-) strand; PAM type: NRG; PAM sequence: TAG
tcgctaagcttaatcatttc

SEQ ID NO: 81517 - DNA, 20 bp, Artificial Sequence
  Description of Artificial Sequence: Synthetic oligonucleotide
  Target: ATXN1; (-) strand; PAM type: NRG; PAM sequence: AAG
ttcaacatgccttcctcgct

SEQ ID NO: 81518 - DNA, 20 bp, Artificial Sequence
  Description of Artificial Sequence: Synthetic oligonucleotide
  Target: ATXN1; (-) strand; PAM type: NRG; PAM sequence: CAG
gcctggcttttgacatatgt

SEQ ID NO: 81519 - DNA, 20 bp, Artificial Sequence
  Description of Artificial Sequence: Synthetic oligonucleotide
  Target: ATXN1; (-) strand; PAM type: NRG; PAM sequence: TGG
cccttcagtcacaagaagcc

SEQ ID NO: 81520 - DNA, 20 bp, Artificial Sequence
  Description of Artificial Sequence: Synthetic oligonucleotide
  Target: ATXN1; (-) strand; PAM type: NRG; PAM sequence: AAG
gctaacccttcagtcacaag

SEQ ID NO: 81521 - DNA, 20 bp, Artificial Sequence
  Description of Artificial Sequence: Synthetic oligonucleotide
  Target: ATXN1; (-) strand; PAM type: NRG; PAM sequence: AAG
ttggctaacccttcagtcac

SEQ ID NO: 81522 - DNA, 20 bp, Artificial Sequence
  Description of Artificial Sequence: Synthetic oligonucleotide
  Target: ATXN1; (-) strand; PAM type: NRG; PAM sequence: CAG
tcacagcttggctaaccctt

SEQ ID NO: 81523 - DNA, 20 bp, Artificial Sequence
  Description of Artificial Sequence: Synthetic oligonucleotide
  Target: ATXN1; (-) strand; PAM type: NRG; PAM sequence: TGG
tttccttagcattcacagct

SEQ ID NO: 81524 - DNA, 20 bp, Artificial Sequence
  Description of Artificial Sequence: Synthetic oligonucleotide
  Target: ATXN1; (-) strand; PAM type: NRG; PAM sequence: CAG
gaacttttccttagcattca

SEQ ID NO: 81525 - DNA, 20 bp, Artificial Sequence
  Description of Artificial Sequence: Synthetic oligonucleotide
  Target: ATXN1; (-) strand; PAM type: NRG; PAM sequence: TAG
tttcttcaagaacttttcct

SEQ ID NO: 81526 - DNA, 20 bp, Artificial Sequence
  Description of Artificial Sequence: Synthetic oligonucleotide
  Target: ATXN1; (-) strand; PAM type: NRG; PAM sequence: AAG
tagcacttttaattttcttc

SEQ ID NO: 81527 - DNA, 20 bp, Artificial Sequence
  Description of Artificial Sequence: Synthetic oligonucleotide
  Target: ATXN1; (-) strand; PAM type: NRG; PAM sequence: TAG
cattgatgagttcactggag

SEQ ID NO: 81528 - DNA, 20 bp, Artificial Sequence
  Description of Artificial Sequence: Synthetic oligonucleotide
  Target: ATXN1; (-) strand; PAM type: NRG; PAM sequence: GAG
taccattgatgagttcactg

SEQ ID NO: 81529 - DNA, 20 bp, Artificial Sequence
  Description of Artificial Sequence: Synthetic oligonucleotide
  Target: ATXN1; (-) strand; PAM type: NRG; PAM sequence: TGG
cttaccattgatgagttcac

SEQ ID NO: 81530 - DNA, 20 bp, Artificial Sequence
  Description of Artificial Sequence: Synthetic oligonucleotide
  Target: ATXN1; (-) strand; PAM type: NRG; PAM sequence: GAG
ttcactttcttaccattgat

SEQ ID NO: 81531 - DNA, 20 bp, Artificial Sequence
  Description of Artificial Sequence: Synthetic oligonucleotide
  Target: ATXN1; (-) strand; PAM type: NRG; PAM sequence: AGG
ctttgtccatatcagcaaca

SEQ ID NO: 81532 - DNA, 20 bp, Artificial Sequence
  Description of Artificial Sequence: Synthetic oligonucleotide
  Target: ATXN1; (-) strand; PAM type: NRG; PAM sequence: AAG
actttgtccatatcagcaac

SEQ ID NO: 81533 - DNA, 20 bp, Artificial Sequence
  Description of Artificial Sequence: Synthetic oligonucleotide
  Target: ATXN1; (-) strand; PAM type: NRG; PAM sequence: CAG
cactctaactttgtccatat

SEQ ID NO: 81534 - DNA, 20 bp, Artificial Sequence
  Description of Artificial Sequence: Synthetic oligonucleotide
  Target: ATXN1; (-) strand; PAM type: NRG; PAM sequence: CAG
ggctggtttgcttttctatt

SEQ ID NO: 81535 - DNA, 20 bp, Artificial Sequence
  Description of Artificial Sequence: Synthetic oligonucleotide
  Target: ATXN1; (-) strand; PAM type: NRG; PAM sequence: TGG
ggcttaagggaatgtatggc

SEQ ID NO: 81536 - DNA, 20 bp, Artificial Sequence
  Description of Artificial Sequence: Synthetic oligonucleotide
  Target: ATXN1; (-) strand; PAM type: NRG; PAM sequence: TGG
ctttggcttaagggaatgta

SEQ ID NO: 81537 - DNA, 20 bp, Artificial Sequence
  Description of Artificial Sequence: Synthetic oligonucleotide
  Target: ATXN1; (-) strand; PAM type: NRG; PAM sequence: GGG
tggattaggctttggcttaa

SEQ ID NO: 81538 - DNA, 20 bp, Artificial Sequence
  Description of Artificial Sequence: Synthetic oligonucleotide
  Target: ATXN1; (-) strand; PAM type: NRG; PAM sequence: AGG
ctggattaggctttggctta

SEQ ID NO: 81539 - DNA, 20 bp, Artificial Sequence
  Description of Artificial Sequence: Synthetic oligonucleotide
  Target: ATXN1; (-) strand; PAM type: NRG; PAM sequence: AAG
tctggattaggctttggctt

SEQ ID NO: 81540 - DNA, 20 bp, Artificial Sequence
  Description of Artificial Sequence: Synthetic oligonucleotide
  Target: ATXN1; (-) strand; PAM type: NRG; PAM sequence: TGG
ccttgatctggattaggctt

SEQ ID NO: 81541 - DNA, 20 bp, Artificial Sequence
  Description of Artificial Sequence: Synthetic oligonucleotide
  Target: ATXN1; (-) strand; PAM type: NRG; PAM sequence: AGG
ttagggccttgatctggatt

SEQ ID NO: 81542 - DNA, 20 bp, Artificial Sequence
  Description of Artificial Sequence: Synthetic oligonucleotide
  Target: ATXN1; (-) strand; PAM type: NRG; PAM sequence: TAG
gttagggccttgatctggat

SEQ ID NO: 81543 - DNA, 20 bp, Artificial Sequence
  Description of Artificial Sequence: Synthetic oligonucleotide
  Target: ATXN1; (-) strand; PAM type: NRG; PAM sequence: TGG
agagagttagggccttgatc

SEQ ID NO: 81544 - DNA, 20 bp, Artificial Sequence
  Description of Artificial Sequence: Synthetic oligonucleotide
  Target: ATXN1; (-) strand; PAM type: NRG; PAM sequence: GGG
catagaagtgaagagagtta

SEQ ID NO: 81545 - DNA, 20 bp, Artificial Sequence
  Description of Artificial Sequence: Synthetic oligonucleotide
  Target: ATXN1; (-) strand; PAM type: NRG; PAM sequence: AGG
tcatagaagtgaagagagtt

SEQ ID NO: 81546 - DNA, 20 bp, Artificial Sequence
  Description of Artificial Sequence: Synthetic oligonucleotide
  Target: ATXN1; (-) strand; PAM type: NRG; PAM sequence: TAG
ttcatagaagtgaagagagt

SEQ ID NO: 81547 - DNA, 20 bp, Artificial Sequence
  Description of Artificial Sequence: Synthetic oligonucleotide
  Target: ATXN1; (-) strand; PAM type: NRG; PAM sequence: GAG
agccttcatagaagtgaaga

SEQ ID NO: 81548 - DNA, 20 bp, Artificial Sequence
  Description of Artificial Sequence: Synthetic oligonucleotide
  Target: ATXN1; (-) strand; PAM type: NRG; PAM sequence: GAG
tcagccttcatagaagtgaa

SEQ ID NO: 81549 - DNA, 20 bp, Artificial Sequence
  Description of Artificial Sequence: Synthetic oligonucleotide
  Target: ATXN1; (-) strand; PAM type: NRG; PAM sequence: AAG
tctcagccttcatagaagtg

SEQ ID NO: 81550 - DNA, 20 bp, Artificial Sequence
  Description of Artificial Sequence: Synthetic oligonucleotide
  Target: ATXN1; (-) strand; PAM type: NRG; PAM sequence: AAG
acctctctcagccttcatag

SEQ ID NO: 81551 - DNA, 20 bp, Artificial Sequence
  Description of Artificial Sequence: Synthetic oligonucleotide
  Target: ATXN1; (-) strand; PAM type: NRG; PAM sequence: TAG
ctcacctctctcagccttca

SEQ ID NO: 81552 - DNA, 20 bp, Artificial Sequence
  Description of Artificial Sequence: Synthetic oligonucleotide
  Target: ATXN1; (-) strand; PAM type: NRG; PAM sequence: CAG
tccaagttcctcacctctct

SEQ ID NO: 81553 - DNA, 20 bp, Artificial Sequence
  Description of Artificial Sequence: Synthetic oligonucleotide
  Target: ATXN1; (-) strand; PAM type: NRG; PAM sequence: AAG
gcttcaaacttttcttctcc

SEQ ID NO: 81554 - DNA, 20 bp, Artificial Sequence
  Description of Artificial Sequence: Synthetic oligonucleotide
  Target: ATXN1; (-) strand; PAM type: NRG; PAM sequence: TAG
tctcacgaaccaacttctgc

SEQ ID NO: 81555 - DNA, 20 bp, Artificial Sequence
  Description of Artificial Sequence: Synthetic oligonucleotide
  Target: ATXN1; (-) strand; PAM type: NRG; PAM sequence: AAG
ttctacatcagcatttggag

SEQ ID NO: 81556 - DNA, 20 bp, Artificial Sequence
  Description of Artificial Sequence: Synthetic oligonucleotide
  Target: ATXN1; (-) strand; PAM type: NRG; PAM sequence: GAG
agcttctacatcagcatttg

SEQ ID NO: 81557 - DNA, 20 bp, Artificial Sequence
  Description of Artificial Sequence: Synthetic oligonucleotide
  Target: ATXN1; (-) strand; PAM type: NRG; PAM sequence: TGG
gcagcttctacatcagcatt

SEQ ID NO: 81558 - DNA, 20 bp, Artificial Sequence
  Description of Artificial Sequence: Synthetic oligonucleotide
  Target: ATXN1; (-) strand; PAM type: NRG; PAM sequence: CAG
acctgctgcagcttctacat

SEQ ID NO: 81559 - DNA, 20 bp, Artificial Sequence
  Description of Artificial Sequence: Synthetic oligonucleotide
  Target: ATXN1; (-) strand; PAM type: NRG; PAM sequence: CAG
attttctggataacctgctg

SEQ ID NO: 81560 - DNA, 20 bp, Artificial Sequence
  Description of Artificial Sequence: Synthetic oligonucleotide
  Target: ATXN1; (-) strand; PAM type: NRG; PAM sequence: TGG
atgatcttagttaaattttc

SEQ ID NO: 81561 - DNA, 20 bp, Artificial Sequence
  Description of Artificial Sequence: Synthetic oligonucleotide
  Target: ATXN1; (-) strand; PAM type: NRG; PAM sequence: TAG
gtcaccttcatcaatgatct

SEQ ID NO: 81562 - DNA, 20 bp, Artificial Sequence
  Description of Artificial Sequence: Synthetic oligonucleotide
  Target: ATXN1; (-) strand; PAM type: NRG; PAM sequence: TAG
tgcctacgttgaaaaatctg

SEQ ID NO: 81563 - DNA, 20 bp, Artificial Sequence
  Description of Artificial Sequence: Synthetic oligonucleotide
  Target: ATXN1; (-) strand; PAM type: NRG; PAM sequence: AGG
tggcattttcttccaataga

SEQ ID NO: 81564 - DNA, 20 bp, Artificial Sequence
  Description of Artificial Sequence: Synthetic oligonucleotide
  Target: ATXN1; (-) strand; PAM type: NRG; PAM sequence: AAG
atggcattttcttccaatag

SEQ ID NO: 81565 - DNA, 20 bp, Artificial Sequence
  Description of Artificial Sequence: Synthetic oligonucleotide
  Target: ATXN1; (-) strand; PAM type: NRG; PAM sequence: TAG
taaatggcattttcttccaa

SEQ ID NO: 81566 - DNA, 20 bp, Artificial Sequence
  Description of Artificial Sequence: Synthetic oligonucleotide
  Target: ATXN1; (-) strand; PAM type: NRG; PAM sequence: TGG
ctagctatgaaagtcttaaa

SEQ ID NO: 81567 - DNA, 20 bp, Artificial Sequence
  Description of Artificial Sequence: Synthetic oligonucleotide
  Target: ATXN1; (-) strand; PAM type: NRG; PAM sequence: AAG
cttctcctctctagctatga

SEQ ID NO: 81568 - DNA, 20 bp, Artificial Sequence
  Description of Artificial Sequence: Synthetic oligonucleotide
  Target: ATXN1; (-) strand; PAM type: NRG; PAM sequence: TAG
aagcattgacttctcctctc

SEQ ID NO: 81569 - DNA, 20 bp, Artificial Sequence
  Description of Artificial Sequence: Synthetic oligonucleotide
  Target: ATXN1; (-) strand; PAM type: NRG; PAM sequence: AAG
tcctttgaagctttgtagtc

SEQ ID NO: 81570 - DNA, 20 bp, Artificial Sequence
  Description of Artificial Sequence: Synthetic oligonucleotide
  Target: ATXN1; (-) strand; PAM type: NRG; PAM sequence: TAG
gcctctcctttgaagctttg

SEQ ID NO: 81571 - DNA, 20 bp, Artificial Sequence
  Description of Artificial Sequence: Synthetic oligonucleotide
  Target: ATXN1; (-) strand; PAM type: NRG; PAM sequence: AAG
gagagtcagcctctcctttg

SEQ ID NO: 81572 - DNA, 20 bp, Artificial Sequence
  Description of Artificial Sequence: Synthetic oligonucleotide
  Target: ATXN1; (-) strand; PAM type: NRG; PAM sequence: CAG
tttgcccgtaacaagagagt

SEQ ID NO: 81573 - DNA, 20 bp, Artificial Sequence
  Description of Artificial Sequence: Synthetic oligonucleotide
  Target: ATXN1; (-) strand; PAM type: NRG; PAM sequence: GAG
tgcatttgcccgtaacaaga

SEQ ID NO: 81574 - DNA, 20 bp, Artificial Sequence
  Description of Artificial Sequence: Synthetic oligonucleotide
  Target: ATXN1; (-) strand; PAM type: NRG; PAM sequence: GAG
gctgcatttgcccgtaacaa

SEQ ID NO: 81575 - DNA, 20 bp, Artificial Sequence
  Description of Artificial Sequence: Synthetic oligonucleotide
  Target: ATXN1; (-) strand; PAM type: NRG; PAM sequence: AAG
tagctgcatttgcccgtaac

SEQ ID NO: 81576 - DNA, 20 bp, Artificial Sequence
  Description of Artificial Sequence: Synthetic oligonucleotide
  Target: ATXN1; (-) strand; PAM type: NRG; PAM sequence: TAG
ttggcttcaactaaagtcac

SEQ ID NO: 81577 - DNA, 20 bp, Artificial Sequence
  Description of Artificial Sequence: Synthetic oligonucleotide
  Target: ATXN1; (-) strand; PAM type: NRG; PAM sequence: AAG
atgagcattggcttcaacta

SEQ ID NO: 81578 - DNA, 20 bp, Artificial Sequence
  Description of Artificial Sequence: Synthetic oligonucleotide
  Target: ATXN1; (-) strand; PAM type: NRG; PAM sequence: TGG
ttggaatggtaaatgagcat

SEQ ID NO: 81579 - DNA, 20 bp, Artificial Sequence
  Description of Artificial Sequence: Synthetic oligonucleotide
  Target: ATXN1; (-) strand; PAM type: NRG; PAM sequence: GAG
ggatttttggaatggtaaat

SEQ ID NO: 81580 - DNA, 20 bp, Artificial Sequence
  Description of Artificial Sequence: Synthetic oligonucleotide
  Target: ATXN1; (-) strand; PAM type: NRG; PAM sequence: TGG
gggctctaggatttttggaa

SEQ ID NO: 81581 - DNA, 20 bp, Artificial Sequence
  Description of Artificial Sequence: Synthetic oligonucleotide
  Target: ATXN1; (-) strand; PAM type: NRG; PAM sequence: TGG
tattagggctctaggatttt

SEQ ID NO: 81582 - DNA, 20 bp, Artificial Sequence
  Description of Artificial Sequence: Synthetic oligonucleotide
  Target: ATXN1; (-) strand; PAM type: NRG; PAM sequence: AGG
agcataattattagggctct

SEQ ID NO: 81583 - DNA, 20 bp, Artificial Sequence
  Description of Artificial Sequence: Synthetic oligonucleotide
  Target: ATXN1; (-) strand; PAM type: NRG; PAM sequence: TAG
cagcataattattagggctc

SEQ ID NO: 81584 - DNA, 20 bp, Artificial Sequence
  Description of Artificial Sequence: Synthetic oligonucleotide
  Target: ATXN1; (-) strand; PAM type: NRG; PAM sequence: GGG
tagattcagcataattatta

SEQ ID NO: 81585 - DNA, 20 bp, Artificial Sequence
  Description of Artificial Sequence: Synthetic oligonucleotide
  Target: ATXN1; (-) strand; PAM type: NRG; PAM sequence: AGG
gtagattcagcataattatt

SEQ ID NO: 81586 - DNA, 20 bp, Artificial Sequence
  Description of Artificial Sequence: Synthetic oligonucleotide
  Target: ATXN1; (-) strand; PAM type: NRG; PAM sequence: TAG
agtagattcagcataattat

SEQ ID NO: 81587 - DNA, 20 bp, Artificial Sequence
  Description of Artificial Sequence: Synthetic oligonucleotide
  Target: ATXN1; (-) strand; PAM type: NRG; PAM sequence: CAG
tagcactggcagagtagatt

SEQ ID NO: 81588 - DNA, 20 bp, Artificial Sequence
  Description of Artificial Sequence: Synthetic oligonucleotide
  Target: ATXN1; (-) strand; PAM type: NRG; PAM sequence: TAG
tttctatagcactggcagag

SEQ ID NO: 81589 - DNA, 20 bp, Artificial Sequence
  Description of Artificial Sequence: Synthetic oligonucleotide
  Target: ATXN1; (-) strand; PAM type: NRG; PAM sequence: GAG
ccatttctatagcactggca

SEQ ID NO: 81590 - DNA, 20 bp, Artificial Sequence
  Description of Artificial Sequence: Synthetic oligonucleotide
  Target: ATXN1; (-) strand; PAM type: NRG; PAM sequence: CAG
ttccatttctatagcactgg

SEQ ID NO: 81591 - DNA, 20 bp, Artificial Sequence
  Description of Artificial Sequence: Synthetic oligonucleotide
  Target: ATXN1; (-) strand; PAM type: NRG; PAM sequence: TGG
ttgttccatttctatagcac

SEQ ID NO: 81592 - DNA, 20 bp, Artificial Sequence
  Description of Artificial Sequence: Synthetic oligonucleotide
  Target: ATXN1; (-) strand; PAM type: NRG; PAM sequence: TAG
gctttgttgttccatttcta

SEQ ID NO: 81593 - DNA, 20 bp, Artificial Sequence
  Description of Artificial Sequence: Synthetic oligonucleotide
  Target: ATXN1; (-) strand; PAM type: NRG; PAM sequence: AGG
aacccaatgtgctttcatcc

SEQ ID NO: 81594 - DNA, 20 bp, Artificial Sequence
  Description of Artificial Sequence: Synthetic oligonucleotide
  Target: ATXN1; (-) strand; PAM type: NRG; PAM sequence: CAG
taacccaatgtgctttcatc

SEQ ID NO: 81595 - DNA, 20 bp, Artificial Sequence
  Description of Artificial Sequence: Synthetic oligonucleotide
  Target: ATXN1; (-) strand; PAM type: NRG; PAM sequence: TAG
aacagtgggcttaaagtatt

SEQ ID NO: 81596 - DNA, 20 bp, Artificial Sequence
  Description of Artificial Sequence: Synthetic oligonucleotide
  Target: ATXN1; (-) strand; PAM type: NRG; PAM sequence: AAG
aagtctcaacagtgggctta

SEQ ID NO: 81597 - DNA, 20 bp, Artificial Sequence
  Description of Artificial Sequence: Synthetic oligonucleotide
  Target: ATXN1; (-) strand; PAM type: NRG; PAM sequence: GGG
agcaattaagtctcaacagt

SEQ ID NO: 81598 - DNA, 20 bp, Artificial Sequence
  Description of Artificial Sequence: Synthetic oligonucleotide
  Target: ATXN1; (-) strand; PAM type: NRG; PAM sequence: TGG
gagcaattaagtctcaacag

SEQ ID NO: 81599 - DNA, 20 bp, Artificial Sequence
  Description of Artificial Sequence: Synthetic oligonucleotide
  Target: ATXN1; (-) strand; PAM type: NRG; PAM sequence: CAG
tctgagcaattaagtctcaa

SEQ ID NO: 81600 - DNA, 20 bp, Artificial Sequence
  Description of Artificial Sequence: Synthetic oligonucleotide
  Target: ATXN1; (-) strand; PAM type: NRG; PAM sequence: AAG
gaatctttttctgagcaatt

SEQ ID NO: 81601 - DNA, 20 bp, Artificial Sequence
  Description of Artificial Sequence: Synthetic oligonucleotide
  Target: ATXN1; (-) strand; PAM type: NRG; PAM sequence: GAG
tttgaaaggaatctttttct

SEQ ID NO: 81602 - DNA, 20 bp, Artificial Sequence
  Description of Artificial Sequence: Synthetic oligonucleotide
  Target: ATXN1; (-) strand; PAM type: NRG; PAM sequence: AGG
ataagcagtaatattttgaa

SEQ ID NO: 81603 - DNA, 20 bp, Artificial Sequence
  Description of Artificial Sequence: Synthetic oligonucleotide
  Target: ATXN1; (-) strand; PAM type: NRG; PAM sequence: AAG
aataagcagtaatattttga

SEQ ID NO: 81604 - DNA, 20 bp, Artificial Sequence
  Description of Artificial Sequence: Synthetic oligonucleotide
  Target: ATXN1; (-) strand; PAM type: NRG; PAM sequence: CAG
cgaagtgcattgtcaataag

SEQ ID NO: 81605 - DNA, 20 bp, Artificial Sequence
  Description of Artificial Sequence: Synthetic oligonucleotide
  Target: ATXN1; (-) strand; PAM type: NRG; PAM sequence: AAG
tgacgaagtgcattgtcaat

SEQ ID NO: 81606 - DNA, 20 bp, Artificial Sequence
  Description of Artificial Sequence: Synthetic oligonucleotide
  Target: ATXN1; (-) strand; PAM type: NRG; PAM sequence: AAG
gagctcttagatgagtgacg

SEQ ID NO: 81607 - DNA, 20 bp, Artificial Sequence
  Description of Artificial Sequence: Synthetic oligonucleotide
  Target: ATXN1; (-) strand; PAM type: NRG; PAM sequence: GAG
ttccatcagagctcttagat

SEQ ID NO: 81608 - DNA, 20 bp, Artificial Sequence
  Description of Artificial Sequence: Synthetic oligonucleotide
  Target: ATXN1; (-) strand; PAM type: NRG; PAM sequence: TAG
tatatttccatcagagctct

SEQ ID NO: 81609 - DNA, 20 bp, Artificial Sequence
  Description of Artificial Sequence: Synthetic oligonucleotide
  Target: ATXN1; (-) strand; PAM type: NRG; PAM sequence: GAG
ctccttgtatatttccatca

SEQ ID NO: 81610 - DNA, 20 bp, Artificial Sequence
  Description of Artificial Sequence: Synthetic oligonucleotide
  Target: ATXN1; (-) strand; PAM type: NRG; PAM sequence: CAG
atctccttgtatatttccat

SEQ ID NO: 81611 - DNA, 20 bp, Artificial Sequence
  Description of Artificial Sequence: Synthetic oligonucleotide
  Target: ATXN1; (-) strand; PAM type: NRG; PAM sequence: AGG
agaatgggtgttgtgttagc

SEQ ID NO: 81612 - DNA, 20 bp, Artificial Sequence
  Description of Artificial Sequence: Synthetic oligonucleotide
  Target: ATXN1; (-) strand; PAM type: NRG; PAM sequence: CAG
cagaatgggtgttgtgttag

SEQ ID NO: 81613 - DNA, 20 bp, Artificial Sequence
  Description of Artificial Sequence: Synthetic oligonucleotide
  Target: ATXN1; (-) strand; PAM type: NRG; PAM sequence: TAG
ttgcagaatgggtgttgtgt

SEQ ID NO: 81614 - DNA, 20 bp, Artificial Sequence
  Description of Artificial Sequence: Synthetic oligonucleotide
  Target: ATXN1; (-) strand; PAM type: NRG; PAM sequence: GGG
tgatccatgggttgcagaat

SEQ ID NO: 81615 - DNA, 20 bp, Artificial Sequence
  Description of Artificial Sequence: Synthetic oligonucleotide
  Target: ATXN1; (-) strand; PAM type: NRG; PAM sequence: TGG
ttgatccatgggttgcagaa

SEQ ID NO: 81616 - DNA, 20 bp, Artificial Sequence
  Description of Artificial Sequence: Synthetic oligonucleotide
  Target: ATXN1; (-) strand; PAM type: NRG; PAM sequence: CAG
actccttgatccatgggttg

SEQ ID NO: 81617 - DNA, 20 bp, Artificial Sequence
  Description of Artificial Sequence: Synthetic oligonucleotide
  Target: ATXN1; (-) strand; PAM type: NRG; PAM sequence: GGG
aaaattactccttgatccat

SEQ ID NO: 81618 - DNA, 20 bp, Artificial Sequence
  Description of Artificial Sequence: Synthetic oligonucleotide
  Target: ATXN1; (-) strand; PAM type: NRG; PAM sequence: TGG
aaaaattactccttgatcca

SEQ ID NO: 81619 - DNA, 20 bp, Artificial Sequence
  Description of Artificial Sequence: Synthetic oligonucleotide
  Target: ATXN1; (-) strand; PAM type: NRG; PAM sequence: AAG
gaatgtatttcttaaataag

SEQ ID NO: 81620 - DNA, 20 bp, Artificial Sequence
  Description of Artificial Sequence: Synthetic oligonucleotide
  Target: ATXN1; (-) strand; PAM type: NRG; PAM sequence: AAG
acagaatgtatttcttaaat

SEQ ID NO: 81621 - DNA, 20 bp, Artificial Sequence
  Description of Artificial Sequence: Synthetic oligonucleotide
  Target: ATXN1; (-) strand; PAM type: NRG; PAM sequence: CAG
ctgtggcaatgatagcctta

SEQ ID NO: 81622 - DNA, 20 bp, Artificial Sequence
  Description of Artificial Sequence: Synthetic oligonucleotide
  Target: ATXN1; (-) strand; PAM type: NRG; PAM sequence: TAG
attactttctgtggcaatga

SEQ ID NO: 81623 - DNA, 20 bp, Artificial Sequence
  Description of Artificial Sequence: Synthetic oligonucleotide
  Target: ATXN1; (-) strand; PAM type: NRG; PAM sequence: TGG
atcagaggaattactttctg

SEQ ID NO: 81624 - DNA, 20 bp, Artificial Sequence
  Description of Artificial Sequence: Synthetic oligonucleotide
  Target: ATXN1; (-) strand; PAM type: NRG; PAM sequence: AGG
acttttcccagatccatcag

SEQ ID NO: 81625 - DNA, 20 bp, Artificial Sequence
  Description of Artificial Sequence: Synthetic oligonucleotide
  Target: ATXN1; (-) strand; PAM type: NRG; PAM sequence: GAG
tacttttcccagatccatca

SEQ ID NO: 81626 - DNA, 20 bp, Artificial Sequence
  Description of Artificial Sequence: Synthetic oligonucleotide
  Target: ATXN1; (-) strand; PAM type: NRG; PAM sequence: CAG
tttacttttcccagatccat

SEQ ID NO: 81627 - DNA, 20 bp, Artificial Sequence
  Description of Artificial Sequence: Synthetic oligonucleotide
  Target: ATXN1; (-) strand; PAM type: NRG; PAM sequence: CAG
ggttttcaatttacttttcc

SEQ ID NO: 81628 - DNA, 20 bp, Artificial Sequence
  Description of Artificial Sequence: Synthetic oligonucleotide
  Target: ATXN1; (-) strand; PAM type: NRG; PAM sequence: AGG
aatggtgaatcctttccagg

SEQ ID NO: 81629 - DNA, 20 bp, Artificial Sequence
  Description of Artificial Sequence: Synthetic oligonucleotide
  Target: ATXN1; (-) strand; PAM type: NRG; PAM sequence: GAG
caatggtgaatcctttccag

SEQ ID NO: 81630 - DNA, 20 bp, Artificial Sequence
  Description of Artificial Sequence: Synthetic oligonucleotide
  Target: ATXN1; (-) strand; PAM type: NRG; PAM sequence: AGG
tacaatggtgaatcctttcc

SEQ ID NO: 81631 - DNA, 20 bp, Artificial Sequence
  Description of Artificial Sequence: Synthetic oligonucleotide
  Target: ATXN1; (-) strand; PAM type: NRG; PAM sequence: CAG
ctacaatggtgaatcctttc

SEQ ID NO: 81632 - DNA, 20 bp, Artificial Sequence
  Description of Artificial Sequence: Synthetic oligonucleotide
  Target: ATXN1; (-) strand; PAM type: NRG; PAM sequence: TGG
gttcttaatgacatctacaa

SEQ ID NO: 81633 - DNA, 20 bp, Artificial Sequence
  Description of Artificial Sequence: Synthetic oligonucleotide
  Target: ATXN1; (-) strand; PAM type: NRG; PAM sequence: TGG
ctcaagtcatccatgggggt

SEQ ID NO: 81634 - DNA, 20 bp, Artificial Sequence
  Description of Artificial Sequence: Synthetic oligonucleotide
  Target: ATXN1; (-) strand; PAM type: NRG; PAM sequence: GGG
aaccctcaagtcatccatgg

SEQ ID NO: 81635 - DNA, 20 bp, Artificial Sequence
  Description of Artificial Sequence: Synthetic oligonucleotide
  Target: ATXN1; (-) strand; PAM type: NRG; PAM sequence: GGG
aaaccctcaagtcatccatg

SEQ ID NO: 81636 - DNA, 20 bp, Artificial Sequence
  Description of Artificial Sequence: Synthetic oligonucleotide
  Target: ATXN1; (-) strand; PAM type: NRG; PAM sequence: GGG
gaaaccctcaagtcatccat

SEQ ID NO: 81637 - DNA, 20 bp, Artificial Sequence
  Description of Artificial Sequence: Synthetic oligonucleotide
  Target: ATXN1; (-) strand; PAM type: NRG; PAM sequence: TGG
tgaaaccctcaagtcatcca

SEQ ID NO: 81638 - DNA, 20 bp, Artificial Sequence
  Description of Artificial Sequence: Synthetic oligonucleotide
  Target: ATXN1; (-) strand; PAM type: NRG; PAM sequence: AAG
accgaagtcttgaaaccctc

SEQ ID NO: 81639 - DNA, 20 bp, Artificial Sequence
  Description of Artificial Sequence: Synthetic oligonucleotide
  Target: ATXN1; (-) strand; PAM type: NRG; PAM sequence: AAG
tgcagttccttcctccaccg

SEQ ID NO: 81640 - DNA, 20 bp, Artificial Sequence
  Description of Artificial Sequence: Synthetic oligonucleotide
  Target: ATXN1; (-) strand; PAM type: NRG; PAM sequence: CAG
tgctgtttccacctcatctg

SEQ ID NO: 81641 - DNA, 20 bp, Artificial Sequence
  Description of Artificial Sequence: Synthetic oligonucleotide
  Target: ATXN1; (-) strand; PAM type: NRG; PAM sequence: TGG
tcaggctccatttctaattc

SEQ ID NO: 81642 - DNA, 20 bp, Artificial Sequence
  Description of Artificial Sequence: Synthetic oligonucleotide
  Target: ATXN1; (-) strand; PAM type: NRG; PAM sequence: AGG
atcaattcagtcacattttc

SEQ ID NO: 81643 - DNA, 20 bp, Artificial Sequence
  Description of Artificial Sequence: Synthetic oligonucleotide
  Target: ATXN1; (-) strand; PAM type: NRG; PAM sequence: CAG
aatcaattcagtcacatttt

SEQ ID NO: 81644 - DNA, 20 bp, Artificial Sequence
  Description of Artificial Sequence: Synthetic oligonucleotide
  Target: ATXN1; (-) strand; PAM type: NRG; PAM sequence: CAG
tgagattgcagcaatcaatt

SEQ ID NO: 81645 - DNA, 20 bp, Artificial Sequence
  Description of Artificial Sequence: Synthetic oligonucleotide
  Target: ATXN1; (-) strand; PAM type: NRG; PAM sequence: CAG
gaagtttgatcatgagattg

SEQ ID NO: 81646 - DNA, 20 bp, Artificial Sequence
  Description of Artificial Sequence: Synthetic oligonucleotide
  Target: ATXN1; (-) strand; PAM type: NRG; PAM sequence: GAG
atctgctgaagtttgatcat

SEQ ID NO: 81647 - DNA, 20 bp, Artificial Sequence
  Description of Artificial Sequence: Synthetic oligonucleotide
  Target: ATXN1; (-) strand; PAM type: NRG; PAM sequence: AAG
aggcaactcctcatctgctg

SEQ ID NO: 81648 - DNA, 20 bp, Artificial Sequence
  Description of Artificial Sequence: Synthetic oligonucleotide
  Target: ATXN1; (-) strand; PAM type: NRG; PAM sequence: AGG
ctttctttgctcctccatag

SEQ ID NO: 81649 - DNA, 20 bp, Artificial Sequence
  Description of Artificial Sequence: Synthetic oligonucleotide
  Target: ATXN1; (-) strand; PAM type: NRG; PAM sequence: GAG
actttctttgctcctccata

SEQ ID NO: 81650 - DNA, 20 bp, Artificial Sequence
  Description of Artificial Sequence: Synthetic oligonucleotide
  Target: ATXN1; (-) strand; PAM type: NRG; PAM sequence: TAG
ccactttctttgctcctcca

SEQ ID NO: 81651 - DNA, 20 bp, Artificial Sequence
  Description of Artificial Sequence: Synthetic oligonucleotide
  Target: ATXN1; (-) strand; PAM type: NRG; PAM sequence: CGG
caagcgtgagccactgtgcc

SEQ ID NO: 81652 - DNA, 20 bp, Artificial Sequence
  Description of Artificial Sequence: Synthetic oligonucleotide
  Target: ATXN1; (-) strand; PAM type: NRG; PAM sequence: GAG
agtgctgagattacaagcgt

SEQ ID NO: 81653 - DNA, 20 bp, Artificial Sequence
  Description of Artificial Sequence: Synthetic oligonucleotide
  Target: ATXN1; (-) strand; PAM type: NRG; PAM sequence: AAG
tcccaaagtgctgagattac

SEQ ID NO: 81654 - DNA, 20 bp, Artificial Sequence
  Description of Artificial Sequence: Synthetic oligonucleotide
  Target: ATXN1; (-) strand; PAM type: NRG; PAM sequence: GAG
cctcggcctcccaaagtgct

SEQ ID NO: 81655 - DNA, 20 bp, Artificial Sequence
  Description of Artificial Sequence: Synthetic oligonucleotide
  Target: ATXN1; (-) strand; PAM type: NRG; PAM sequence: AAG
tcccctgcctcggcctccca

SEQ ID NO: 81656 - DNA, 20 bp, Artificial Sequence
  Description of Artificial Sequence: Synthetic oligonucleotide
  Target: ATXN1; (-) strand; PAM type: NRG; PAM sequence: CGG
accttgtgattcccctgcct

SEQ ID NO: 81657 - DNA, 20 bp, Artificial Sequence
  Description of Artificial Sequence: Synthetic oligonucleotide
  Target: ATXN1; (-) strand; PAM type: NRG; PAM sequence: CGG
gccaggatggcctctatctc

SEQ ID NO: 81658 - DNA, 20 bp, Artificial Sequence
  Description of Artificial Sequence: Synthetic oligonucleotide
  Target: ATXN1; (-) strand; PAM type: NRG; PAM sequence: TGG
gttagctgtgttagccagga

SEQ ID NO: 81659 - DNA, 20 bp, Artificial Sequence
  Description of Artificial Sequence: Synthetic oligonucleotide
  Target: ATXN1; (-) strand; PAM type: NRG; PAM sequence: AGG
caatgttagctgtgttagcc

SEQ ID NO: 81660 - DNA, 20 bp, Artificial Sequence
  Description of Artificial Sequence: Synthetic oligonucleotide
  Target: ATXN1; (-) strand; PAM type: NRG; PAM sequence: CAG
acaatgttagctgtgttagc

SEQ ID NO: 81661 - DNA, 20 bp, Artificial Sequence
  Description of Artificial Sequence: Synthetic oligonucleotide
  Target: ATXN1; (-) strand; PAM type: NRG; PAM sequence: TAG
tttcacaatgttagctgtgt

SEQ ID NO: 81662 - DNA, 20 bp, Artificial Sequence
  Description of Artificial Sequence: Synthetic oligonucleotide
  Target: ATXN1; (-) strand; PAM type: NRG; PAM sequence: TAG
agagatgggtttcacaatgt

SEQ ID NO: 81663 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 81664 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 81665 - DNA, 20 bp, Artificial Sequence
  Description of Artificial Sequence: Synthetic oligonucleotide
  Target: ATXN1; (-) strand; PAM type: NRG; PAM sequence: GAG
aattttttgtatttttagta

SEQ ID NO: 81666 - DNA, 20 bp, Artificial Sequence
  Description of Artificial Sequence: Synthetic oligonucleotide
  Target: ATXN1; (-) strand; PAM type: NRG; PAM sequence: TAG
ctaattttttgtatttttag

SEQ ID NO: 81667 - DNA, 20 bp, Artificial Sequence
  Description of Artificial Sequence: Synthetic oligonucleotide
  Target: ATXN1; (-) strand; PAM type: NRG; PAM sequence: TAG
gggctaattttttgtatttt

SEQ ID NO: 81668 - DNA, 20 bp, Artificial Sequence
  Description of Artificial Sequence: Synthetic oligonucleotide
  Target: ATXN1; (-) strand; PAM type: NRG; PAM sequence: GGG
caggtgcgcaccaccacgct

SEQ ID NO: 81669 - DNA, 20 bp, Artificial Sequence
  Description of Artificial Sequence: Synthetic oligonucleotide
  Target: ATXN1; (-) strand; PAM type: NRG; PAM sequence: TGG
acaggtgcgcaccaccacgc

SEQ ID NO: 81670 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggactac

SEQ ID NO: 81671 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgggacta

SEQ ID NO: 81672 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagct

SEQ ID NO: 81673 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagc

SEQ ID NO: 81674 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 81675 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 81676 - DNA, 20 bp, Artificial Sequence
  Description of Artificial Sequence: Synthetic oligonucleotide
  Target: ATXN1; (-) strand; PAM type: NRG; PAM sequence: CAG
ttcaaacaattctcctgcct

SEQ ID NO: 81677 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccacctccc

SEQ ID NO: 81678 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccacctcc

SEQ ID NO: 81679 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggcgcgatct

SEQ ID NO: 81680 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 81681 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 81682 - DNA, 20 bp, Artificial Sequence
  Description of Artificial Sequence: Synthetic oligonucleotide
  Target: ATXN1; (-) strand; PAM type: NRG; PAM sequence: GAG
tcgttctgtcacccaggctg

SEQ ID NO: 81683 - DNA, 20 bp, Artificial Sequence
  Description of Artificial Sequence: Synthetic oligonucleotide
  Target: ATXN1; (-) strand; PAM type: NRG; PAM sequence: TGG
tctcgttctgtcacccaggc

SEQ ID NO: 81684 - DNA, 20 bp, Artificial Sequence
  Description of Artificial Sequence: Synthetic oligonucleotide
  Target: ATXN1; (-) strand; PAM type: NRG; PAM sequence: AGG
ggagtctcgttctgtcaccc

SEQ ID NO: 81685 - DNA, 20 bp, Artificial Sequence
  Description of Artificial Sequence: Synthetic oligonucleotide
  Target: ATXN1; (-) strand; PAM type: NRG; PAM sequence: CAG
cggagtctcgttctgtcacc

SEQ ID NO: 81686 - DNA, 20 bp, Artificial Sequence
  Description of Artificial Sequence: Synthetic oligonucleotide
  Target: ATXN1; (-) strand; PAM type: NRG; PAM sequence: GAG
tgtttgtttgttttgagacg

SEQ ID NO: 81687 - DNA, 20 bp, Artificial Sequence
  Description of Artificial Sequence: Synthetic oligonucleotide
  Target: ATXN1; (-) strand; PAM type: NRG; PAM sequence: CGG
tttgtttgtttgttttgaga

SEQ ID NO: 81688 - DNA, 20 bp, Artificial Sequence
  Description of Artificial Sequence: Synthetic oligonucleotide
  Target: ATXN1; (-) strand; PAM type: NRG; PAM sequence: GAG
tttgtttgtttgtttgtttt

SEQ ID NO: 81689 - DNA, 20 bp, Artificial Sequence
  Description of Artificial Sequence: Synthetic oligonucleotide
  Target: ATXN1; (-) strand; PAM type: NRG; PAM sequence: TGG
attacatctcatgaaaccac

SEQ ID NO: 81690 - DNA, 20 bp, Artificial Sequence
  Description of Artificial Sequence: Synthetic oligonucleotide
  Target: ATXN1; (-) strand; PAM type: NRG; PAM sequence: TAG
cacagtatcttcatcaggag

SEQ ID NO: 81691 - DNA, 20 bp, Artificial Sequence
  Description of Artificial Sequence: Synthetic oligonucleotide
  Target: ATXN1; (-) strand; PAM type: NRG; PAM sequence: GAG
gttcacagtatcttcatcag

SEQ ID NO: 81692 - DNA, 20 bp, Artificial Sequence
  Description of Artificial Sequence: Synthetic oligonucleotide
  Target: ATXN1; (-) strand; PAM type: NRG; PAM sequence: AGG
gtgttcacagtatcttcatc

SEQ ID NO: 81693 - DNA, 20 bp, Artificial Sequence
  Description of Artificial Sequence: Synthetic oligonucleotide
  Target: ATXN1; (-) strand; PAM type: NRG; PAM sequence: CAG
agtgttcacagtatcttcat

SEQ ID NO: 81694 - DNA, 20 bp, Artificial Sequence
  Description of Artificial Sequence: Synthetic oligonucleotide
  Target: ATXN1; (-) strand; PAM type: NRG; PAM sequence: CAG
tgtcattttaacagtgttca

SEQ ID NO: 81695 - DNA, 20 bp, Artificial Sequence
  Description of Artificial Sequence: Synthetic oligonucleotide
  Target: ATXN1; (-) strand; PAM type: NRG; PAM sequence: CAG
atcctttgttgtcattttaa

SEQ ID NO: 81696 - DNA, 20 bp, Artificial Sequence
  Description of Artificial Sequence: Synthetic oligonucleotide
  Target: ATXN1; (-) strand; PAM type: NRG; PAM sequence: AAG
aacctgtcactgcatcaatt

SEQ ID NO: 81697 - DNA, 20 bp, Artificial Sequence
  Description of Artificial Sequence: Synthetic oligonucleotide
  Target: ATXN1; (-) strand; PAM type: NRG; PAM sequence: CAG
agaactttcaaagttagagt

SEQ ID NO: 81698 - DNA, 20 bp, Artificial Sequence
  Description of Artificial Sequence: Synthetic oligonucleotide
  Target: ATXN1; (-) strand; PAM type: NRG; PAM sequence: GAG
tagtagaactttcaaagtta

SEQ ID NO: 81699 - DNA, 20 bp, Artificial Sequence
  Description of Artificial Sequence: Synthetic oligonucleotide
  Target: ATXN1; (-) strand; PAM type: NRG; PAM sequence: TAG
catagtagaactttcaaagt

SEQ ID NO: 81700 - DNA, 20 bp, Artificial Sequence
  Description of Artificial Sequence: Synthetic oligonucleotide
  Target: ATXN1; (-) strand; PAM type: NRG; PAM sequence: AAG
tacccatagtagaactttca

SEQ ID NO: 81701 - DNA, 20 bp, Artificial Sequence
  Description of Artificial Sequence: Synthetic oligonucleotide
  Target: ATXN1; (-) strand; PAM type: NRG; PAM sequence: TAG
tgagagcattttacccatag

SEQ ID NO: 81702 - DNA, 20 bp, Artificial Sequence
  Description of Artificial Sequence: Synthetic oligonucleotide
  Target: ATXN1; (-) strand; PAM type: NRG; PAM sequence: TAG
gtttgagagcattttaccca

SEQ ID NO: 81703 - DNA, 20 bp, Artificial Sequence
  Description of Artificial Sequence: Synthetic oligonucleotide
  Target: ATXN1; (-) strand; PAM type: NRG; PAM sequence: GAG
tagtatgcaccattgtttga

SEQ ID NO: 81704 - DNA, 20 bp, Artificial Sequence
  Description of Artificial Sequence: Synthetic oligonucleotide
  Target: ATXN1; (-) strand; PAM type: NRG; PAM sequence: GAG
tgtagtatgcaccattgttt

SEQ ID NO: 81705 - DNA, 20 bp, Artificial Sequence
  Description of Artificial Sequence: Synthetic oligonucleotide
  Target: ATXN1; (-) strand; PAM type: NRG; PAM sequence: TAG
tttcatgaaagatttctctg

SEQ ID NO: 81706 - DNA, 20 bp, Artificial Sequence
  Description of Artificial Sequence: Synthetic oligonucleotide
  Target: ATXN1; (-) strand; PAM type: NRG; PAM sequence: AAG
attgactcttcctttcatga

SEQ ID NO: 81707 - DNA, 20 bp, Artificial Sequence
  Description of Artificial Sequence: Synthetic oligonucleotide
  Target: ATXN1; (-) strand; PAM type: NRG; PAM sequence: TAG
cggtggcaatttcttaaaat

SEQ ID NO: 81708 - DNA, 20 bp, Artificial Sequence
  Description of Artificial Sequence: Synthetic oligonucleotide
  Target: ATXN1; (-) strand; PAM type: NRG; PAM sequence: TGG
gctgaaagctggggtggcgg

SEQ ID NO: 81709 - DNA, 20 bp, Artificial Sequence
  Description of Artificial Sequence: Synthetic oligonucleotide
  Target: ATXN1; (-) strand; PAM type: NRG; PAM sequence: CGG
gttgctgaaagctggggtgg

SEQ ID NO: 81710 - DNA, 20 bp, Artificial Sequence
  Description of Artificial Sequence: Synthetic oligonucleotide
  Target: ATXN1; (-) strand; PAM type: NRG; PAM sequence: TGG
gtggttgctgaaagctgggg

SEQ ID NO: 81711 - DNA, 20 bp, Artificial Sequence
  Description of Artificial Sequence: Synthetic oligonucleotide
  Target: ATXN1; (-) strand; PAM type: NRG; PAM sequence: GGG
gaggtggttgctgaaagctg

SEQ ID NO: 81712 - DNA, 20 bp, Artificial Sequence
  Description of Artificial Sequence: Synthetic oligonucleotide
  Target: ATXN1; (-) strand; PAM type: NRG; PAM sequence: GGG
ggaggtggttgctgaaagct

SEQ ID NO: 81713 - DNA, 20 bp, Artificial Sequence
  Description of Artificial Sequence: Synthetic oligonucleotide
  Target: ATXN1; (-) strand; PAM type: NRG; PAM sequence: TGG
gggaggtggttgctgaaagc

SEQ ID NO: 81714 - DNA, 20 bp, Artificial Sequence
  Description of Artificial Sequence: Synthetic oligonucleotide
  Target: ATXN1; (-) strand; PAM type: NRG; PAM sequence: AAG
tttagggaggtggttgctga

SEQ ID NO: 81715 - DNA, 20 bp, Artificial Sequence
  Description of Artificial Sequence: Synthetic oligonucleotide
  Target: ATXN1; (-) strand; PAM type: NRG; PAM sequence: TGG
tgctgactgatttagggagg

SEQ ID NO: 81716 - DNA, 20 bp, Artificial Sequence
  Description of Artificial Sequence: Synthetic oligonucleotide
  Target: ATXN1; (-) strand; PAM type: NRG; PAM sequence: AGG
ggctgctgactgatttaggg

SEQ ID NO: 81717 - DNA, 20 bp, Artificial Sequence
  Description of Artificial Sequence: Synthetic oligonucleotide
  Target: ATXN1; (-) strand; PAM type: NRG; PAM sequence: GAG
tggctgctgactgatttagg

SEQ ID NO: 81718 - DNA, 20 bp, Artificial Sequence
  Description of Artificial Sequence: Synthetic oligonucleotide
  Target: ATXN1; (-) strand; PAM type: NRG; PAM sequence: GGG
gatggctgctgactgattta

SEQ ID NO: 81719 - DNA, 20 bp, Artificial Sequence
  Description of Artificial Sequence: Synthetic oligonucleotide
  Target: ATXN1; (-) strand; PAM type: NRG; PAM sequence: AGG
tgatggctgctgactgattt

SEQ ID NO: 81720 - DNA, 20 bp, Artificial Sequence
  Description of Artificial Sequence: Synthetic oligonucleotide
  Target: ATXN1; (-) strand; PAM type: NRG; PAM sequence: TAG
ttgatggctgctgactgatt

SEQ ID NO: 81721 - DNA, 20 bp, Artificial Sequence
  Description of Artificial Sequence: Synthetic oligonucleotide
  Target: ATXN1; (-) strand; PAM type: NRG; PAM sequence: TGG
gtaaagggtctttacgttga

SEQ ID NO: 81722 - DNA, 20 bp, Artificial Sequence
  Description of Artificial Sequence: Synthetic oligonucleotide
  Target: ATXN1; (-) strand; PAM type: NRG; PAM sequence: GGG
ataatcgttttgttggtaaa

SEQ ID NO: 81723 - DNA, 20 bp, Artificial Sequence
  Description of Artificial Sequence: Synthetic oligonucleotide
  Target: ATXN1; (-) strand; PAM type: NRG; PAM sequence: AGG
cataatcgttttgttggtaa

SEQ ID NO: 81724 - DNA, 20 bp, Artificial Sequence
  Description of Artificial Sequence: Synthetic oligonucleotide
  Target: ATXN1; (-) strand; PAM type: NRG; PAM sequence: AAG
ccataatcgttttgttggta

SEQ ID NO: 81725 - DNA, 20 bp, Artificial Sequence
  Description of Artificial Sequence: Synthetic oligonucleotide
  Target: ATXN1; (-) strand; PAM type: NRG; PAM sequence: TGG
ttgaaccataatcgttttgt

SEQ ID NO: 81726 - DNA, 20 bp, Artificial Sequence
  Description of Artificial Sequence: Synthetic oligonucleotide
  Target: ATXN1; (-) strand; PAM type: NRG; PAM sequence: AAG
ataacattttgtctaaacaa

SEQ ID NO: 81727 - DNA, 20 bp, Artificial Sequence
  Description of Artificial Sequence: Synthetic oligonucleotide
  Target: ATXN1; (-) strand; PAM type: NRG; PAM sequence: TAG
gttatgtttacaccatacta

SEQ ID NO: 81728 - DNA, 20 bp, Artificial Sequence
  Description of Artificial Sequence: Synthetic oligonucleotide
  Target: ATXN1; (-) strand; PAM type: NRG; PAM sequence: AAG
tttggttttccagtgcatat

SEQ ID NO: 81729 - DNA, 20 bp, Artificial Sequence
  Description of Artificial Sequence: Synthetic oligonucleotide
  Target: ATXN1; (-) strand; PAM type: NRG; PAM sequence: CAG
acacaaattttttggttttc

SEQ ID NO: 81730 - DNA, 20 bp, Artificial Sequence
  Description of Artificial Sequence: Synthetic oligonucleotide
  Target: ATXN1; (-) strand; PAM type: NRG; PAM sequence: TGG
agcaaatcacacaaattttt

SEQ ID NO: 81731 - DNA, 20 bp, Artificial Sequence
  Description of Artificial Sequence: Synthetic oligonucleotide
  Target: ATXN1; (-) strand; PAM type: NRG; PAM sequence: CAG
gtaaagcaagtattgcaata

SEQ ID NO: 81732 - DNA, 20 bp, Artificial Sequence
  Description of Artificial Sequence: Synthetic oligonucleotide
  Target: ATXN1; (-) strand; PAM type: NRG; PAM sequence: AAG
atagaccacagcagtaaagc

SEQ ID NO: 81733 - DNA, 20 bp, Artificial Sequence
  Description of Artificial Sequence: Synthetic oligonucleotide
  Target: ATXN1; (-) strand; PAM type: NRG; PAM sequence: AAG
acttatagaccacagcagta

SEQ ID NO: 81734 - DNA, 20 bp, Artificial Sequence
  Description of Artificial Sequence: Synthetic oligonucleotide
  Target: ATXN1; (-) strand; PAM type: NRG; PAM sequence: CAG
ggttcacttatagaccacag

SEQ ID NO: 81735 - DNA, 20 bp, Artificial Sequence
  Description of Artificial Sequence: Synthetic oligonucleotide
  Target: ATXN1; (-) strand; PAM type: NRG; PAM sequence: CAG
ttgggttcacttatagacca

SEQ ID NO: 81736 - DNA, 20 bp, Artificial Sequence
  Description of Artificial Sequence: Synthetic oligonucleotide
  Target: ATXN1; (-) strand; PAM type: NRG; PAM sequence: TAG
agatattttgggttcactta

SEQ ID NO: 81737 - DNA, 20 bp, Artificial Sequence
  Description of Artificial Sequence: Synthetic oligonucleotide
  Target: ATXN1; (-) strand; PAM type: NRG; PAM sequence: GGG
tggacactcagagatatttt

SEQ ID NO: 81738 - DNA, 20 bp, Artificial Sequence
  Description of Artificial Sequence: Synthetic oligonucleotide
  Target: ATXN1; (-) strand; PAM type: NRG; PAM sequence: TGG
ctggacactcagagatattt

SEQ ID NO: 81739 - DNA, 20 bp, Artificial Sequence
  Description of Artificial Sequence: Synthetic oligonucleotide
  Target: ATXN1; (-) strand; PAM type: NRG; PAM sequence: GAG
ccactgtgcctggacactca

SEQ ID NO: 81740 - DNA, 20 bp, Artificial Sequence
  Description of Artificial Sequence: Synthetic oligonucleotide
  Target: ATXN1; (-) strand; PAM type: NRG; PAM sequence: CAG
agccactgtgcctggacact

SEQ ID NO: 81741 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccactgtgcc

SEQ ID NO: 81742 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 81743 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 81744 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 81745 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 81746 - DNA, 20 bp, Artificial Sequence
  Description of Artificial Sequence: Synthetic oligonucleotide
  Target: ATXN1; (-) strand; PAM type: NRG; PAM sequence: TGG
acctcagcctcccaaagtgc

SEQ ID NO: 81747 - DNA, 20 bp, Artificial Sequence
  Description of Artificial Sequence: Synthetic oligonucleotide
  Target: ATXN1; (-) strand; PAM type: NRG; PAM sequence: AAG
ccacccacctcagcctccca

SEQ ID NO: 81748 - DNA, 20 bp, Artificial Sequence
  Description of Artificial Sequence: Synthetic oligonucleotide
  Target: ATXN1; (-) strand; PAM type: NRG; PAM sequence: CAG
cccaggtgatccacccacct

SEQ ID NO: 81749 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacccc

SEQ ID NO: 81750 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgaccc

SEQ ID NO: 81751 - DNA, 20 bp, Artificial Sequence
  Description of Artificial Sequence: Synthetic oligonucleotide
  Target: ATXN1; (-) strand; PAM type: NRG; PAM sequence: TGG
tttcaccatattggtgaggc

SEQ ID NO: 81752 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatattggtg

SEQ ID NO: 81753 - DNA, 20 bp, Artificial Sequence
  Description of Artificial Sequence: Synthetic oligonucleotide
  Target: ATXN1; (-) strand; PAM type: NRG; PAM sequence: GAG
tggggtttcaccatattggt

SEQ ID NO: 81754 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcaccatat

SEQ ID NO: 81755 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 81756 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 81757 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 81758 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 81759 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 81760 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 81761 - DNA, 20 bp, Artificial Sequence
  Description of Artificial Sequence: Synthetic oligonucleotide
  Target: ATXN1; (-) strand; PAM type: NRG; PAM sequence: CAG
taggtgcctgccaccatgcc

SEQ ID NO: 81762 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggactat

SEQ ID NO: 81763 - DNA, 20 bp, Artificial Sequence
  Description of Artificial Sequence: Synthetic oligonucleotide
  Target: ATXN1; (-) strand; PAM type: NRG; PAM sequence: TAG
ctcccaagtagctgggacta

SEQ ID NO: 81764 - DNA, 20 bp, Artificial Sequence
  Description of Artificial Sequence: Synthetic oligonucleotide
  Target: ATXN1; (-) strand; PAM type: NRG; PAM sequence: GGG
ttcaagcctcccaagtagct

SEQ ID NO: 81765 - DNA, 20 bp, Artificial Sequence
  Description of Artificial Sequence: Synthetic oligonucleotide
  Target: ATXN1; (-) strand; PAM type: NRG; PAM sequence: TGG
gttcaagcctcccaagtagc

SEQ ID NO: 81766 - DNA, 20 bp, Artificial Sequence
  Description of Artificial Sequence: Synthetic oligonucleotide
  Target: ATXN1; (-) strand; PAM type: NRG; PAM sequence: TAG
ctgggttcaagcctcccaag

SEQ ID NO: 81767 - DNA, 20 bp, Artificial Sequence
  Description of Artificial Sequence: Synthetic oligonucleotide
  Target: ATXN1; (-) strand; PAM type: NRG; PAM sequence: AAG
ctcctgggttcaagcctccc

SEQ ID NO: 81768 - DNA, 20 bp, Artificial Sequence
  Description of Artificial Sequence: Synthetic oligonucleotide
  Target: ATXN1; (-) strand; PAM type: NRG; PAM sequence: AAG
aagctccgcctcctgggttc

SEQ ID NO: 81769 - DNA, 20 bp, Artificial Sequence
  Description of Artificial Sequence: Synthetic oligonucleotide
  Target: ATXN1; (-) strand; PAM type: NRG; PAM sequence: GGG
cactgcaagctccgcctcct

SEQ ID NO: 81770 - DNA, 20 bp, Artificial Sequence
  Description of Artificial Sequence: Synthetic oligonucleotide
  Target: ATXN1; (-) strand; PAM type: NRG; PAM sequence: TGG
tcactgcaagctccgcctcc

SEQ ID NO: 81771 - DNA, 20 bp, Artificial Sequence
  Description of Artificial Sequence: Synthetic oligonucleotide
  Target: ATXN1; (-) strand; PAM type: NRG; PAM sequence: AAG
gcacgatctctgctcactgc

SEQ ID NO: 81772 - DNA, 20 bp, Artificial Sequence
  Description of Artificial Sequence: Synthetic oligonucleotide
  Target: ATXN1; (-) strand; PAM type: NRG; PAM sequence: TGG
gttgccaggctggagtgcag

SEQ ID NO: 81773 - DNA, 20 bp, Artificial Sequence
  Description of Artificial Sequence: Synthetic oligonucleotide
  Target: ATXN1; (-) strand; PAM type: NRG; PAM sequence: CAG
tttgttgccaggctggagtg

SEQ ID NO: 81774 - DNA, 20 bp, Artificial Sequence
  Description of Artificial Sequence: Synthetic oligonucleotide
  Target: ATXN1; (-) strand; PAM type: NRG; PAM sequence: GAG
cttgctttgttgccaggctg

SEQ ID NO: 81775 - DNA, 20 bp, Artificial Sequence
  Description of Artificial Sequence: Synthetic oligonucleotide
  Target: ATXN1; (-) strand; PAM type: NRG; PAM sequence: TGG
gtcttgctttgttgccaggc

SEQ ID NO: 81776 - DNA, 20 bp, Artificial Sequence
  Description of Artificial Sequence: Synthetic oligonucleotide
  Target: ATXN1; (-) strand; PAM type: NRG; PAM sequence: AGG
gggagtcttgctttgttgcc

SEQ ID NO: 81777 - DNA, 20 bp, Artificial Sequence
  Description of Artificial Sequence: Synthetic oligonucleotide
  Target: ATXN1; (-) strand; PAM type: NRG; PAM sequence: CAG
tgggagtcttgctttgttgc

SEQ ID NO: 81778 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttgagttgg

SEQ ID NO: 81779 - DNA, 20 bp, Artificial Sequence
  Description of Artificial Sequence: Synthetic oligonucleotide
  Target: ATXN1; (-) strand; PAM type: NRG; PAM sequence: GGG
tttttttttttttttgagtt

SEQ ID NO: 81780 - DNA, 20 bp, Artificial Sequence
  Description of Artificial Sequence: Synthetic oligonucleotide
  Target: ATXN1; (-) strand; PAM type: NRG; PAM sequence: TGG
ttttttttttttttttgagt

SEQ ID NO: 81781 - DNA, 20 bp, Artificial Sequence
  Description of Artificial Sequence: Synthetic oligonucleotide
  Target: ATXN1; (-) strand; PAM type: NRG; PAM sequence: GAG
tgtctttttttttttttttt

SEQ ID NO: 81782 - DNA, 20 bp, Artificial Sequence
  Description of Artificial Sequence: Synthetic oligonucleotide
  Target: ATXN1; (-) strand; PAM type: NRG; PAM sequence: GAG
ttagacacaggcatagctca

SEQ ID NO: 81783 - DNA, 20 bp, Artificial Sequence
  Description of Artificial Sequence: Synthetic oligonucleotide
  Target: ATXN1; (-) strand; PAM type: NRG; PAM sequence: CAG
ttttagacacaggcatagct

SEQ ID NO: 81784 - DNA, 20 bp, Artificial Sequence
  Description of Artificial Sequence: Synthetic oligonucleotide
  Target: ATXN1; (-) strand; PAM type: NRG; PAM sequence: TAG
gaattttttagacacaggca

SEQ ID NO: 81785 - DNA, 20 bp, Artificial Sequence
  Description of Artificial Sequence: Synthetic oligonucleotide
  Target: ATXN1; (-) strand; PAM type: NRG; PAM sequence: AGG
gttcagaattttttagacac

SEQ ID NO: 81786 - DNA, 20 bp, Artificial Sequence
  Description of Artificial Sequence: Synthetic oligonucleotide
  Target: ATXN1; (-) strand; PAM type: NRG; PAM sequence: CAG
agttcagaattttttagaca

SEQ ID NO: 81787 - DNA, 20 bp, Artificial Sequence
  Description of Artificial Sequence: Synthetic oligonucleotide
  Target: ATXN1; (-) strand; PAM type: NRG; PAM sequence: TAG
aggaagagttcagaattttt

SEQ ID NO: 81788 - DNA, 20 bp, Artificial Sequence
  Description of Artificial Sequence: Synthetic oligonucleotide
  Target: ATXN1; (-) strand; PAM type: NRG; PAM sequence: CAG
agtgcctgttaggaagagtt

SEQ ID NO: 81789 - DNA, 20 bp, Artificial Sequence
  Description of Artificial Sequence: Synthetic oligonucleotide
  Target: ATXN1; (-) strand; PAM type: NRG; PAM sequence: GAG
tctgtagtgcctgttaggaa

SEQ ID NO: 81790 - DNA, 20 bp, Artificial Sequence
  Description of Artificial Sequence: Synthetic oligonucleotide
  Target: ATXN1; (-) strand; PAM type: NRG; PAM sequence: AAG
tttctgtagtgcctgttagg

SEQ ID NO: 81791 - DNA, 20 bp, Artificial Sequence
  Description of Artificial Sequence: Synthetic oligonucleotide
  Target: ATXN1; (-) strand; PAM type: NRG; PAM sequence: AGG
acatttctgtagtgcctgtt

SEQ ID NO: 81792 - DNA, 20 bp, Artificial Sequence
  Description of Artificial Sequence: Synthetic oligonucleotide
  Target: ATXN1; (-) strand; PAM type: NRG; PAM sequence: TAG
tacatttctgtagtgcctgt

SEQ ID NO: 81793 - DNA, 20 bp, Artificial Sequence
  Description of Artificial Sequence: Synthetic oligonucleotide
  Target: ATXN1; (-) strand; PAM type: NRG; PAM sequence: TAG
tggccaggcttacatttctg

SEQ ID NO: 81794 - DNA, 20 bp, Artificial Sequence
  Description of Artificial Sequence: Synthetic oligonucleotide
  Target: ATXN1; (-) strand; PAM type: NRG; PAM sequence: AGG
gtgagccaccgcagctggcc

SEQ ID NO: 81795 - DNA, 20 bp, Artificial Sequence
  Description of Artificial Sequence: Synthetic oligonucleotide
  Target: ATXN1; (-) strand; PAM type: NRG; PAM sequence: CAG
cgtgagccaccgcagctggc

SEQ ID NO: 81796 - DNA, 20 bp, Artificial Sequence
  Description of Artificial Sequence: Synthetic oligonucleotide
  Target: ATXN1; (-) strand; PAM type: NRG; PAM sequence: TGG
caggcgtgagccaccgcagc

SEQ ID NO: 81797 - DNA, 20 bp, Artificial Sequence
  Description of Artificial Sequence: Synthetic oligonucleotide
  Target: ATXN1; (-) strand; PAM type: NRG; PAM sequence: CAG
attacaggcgtgagccaccg

SEQ ID NO: 81798 - DNA, 20 bp, Artificial Sequence
  Description of Artificial Sequence: Synthetic oligonucleotide
  Target: ATXN1; (-) strand; PAM type: NRG; PAM sequence: GAG
agtgctggaattacaggcgt

SEQ ID NO: 81799 - DNA, 20 bp, Artificial Sequence
  Description of Artificial Sequence: Synthetic oligonucleotide
  Target: ATXN1; (-) strand; PAM type: NRG; PAM sequence: AGG
tctcaaagtgctggaattac

SEQ ID NO: 81800 - DNA, 20 bp, Artificial Sequence
  Description of Artificial Sequence: Synthetic oligonucleotide
  Target: ATXN1; (-) strand; PAM type: NRG; PAM sequence: CAG
ctctcaaagtgctggaatta

SEQ ID NO: 81801 - DNA, 20 bp, Artificial Sequence
  Description of Artificial Sequence: Synthetic oligonucleotide
  Target: ATXN1; (-) strand; PAM type: NRG; PAM sequence: TGG
gtcttggcctctcaaagtgc

SEQ ID NO: 81802 - DNA, 20 bp, Artificial Sequence
  Description of Artificial Sequence: Synthetic oligonucleotide
  Target: ATXN1; (-) strand; PAM type: NRG; PAM sequence: AAG
ctacccgtcttggcctctca

SEQ ID NO: 81803 - DNA, 20 bp, Artificial Sequence
  Description of Artificial Sequence: Synthetic oligonucleotide
  Target: ATXN1; (-) strand; PAM type: NRG; PAM sequence: TGG
ctcaagcagtctacccgtct

SEQ ID NO: 81804 - DNA, 20 bp, Artificial Sequence
  Description of Artificial Sequence: Synthetic oligonucleotide
  Target: ATXN1; (-) strand; PAM type: NRG; PAM sequence: CAG
cttaaactcctgggctcaag

SEQ ID NO: 81805 - DNA, 20 bp, Artificial Sequence
  Description of Artificial Sequence: Synthetic oligonucleotide
  Target: ATXN1; (-) strand; PAM type: NRG; PAM sequence: AAG
tgtcttaaactcctgggctc

SEQ ID NO: 81806 - DNA, 20 bp, Artificial Sequence
  Description of Artificial Sequence: Synthetic oligonucleotide
  Target: ATXN1; (-) strand; PAM type: NRG; PAM sequence: GGG
caggcttgtcttaaactcct

SEQ ID NO: 81807 - DNA, 20 bp, Artificial Sequence
  Description of Artificial Sequence: Synthetic oligonucleotide
  Target: ATXN1; (-) strand; PAM type: NRG; PAM sequence: TGG
ccaggcttgtcttaaactcc

SEQ ID NO: 81808 - DNA, 20 bp, Artificial Sequence
  Description of Artificial Sequence: Synthetic oligonucleotide
  Target: ATXN1; (-) strand; PAM type: NRG; PAM sequence: AGG
gaggtttcatcatgttgccc

SEQ ID NO: 81809 - DNA, 20 bp, Artificial Sequence
  Description of Artificial Sequence: Synthetic oligonucleotide
  Target: ATXN1; (-) strand; PAM type: NRG; PAM sequence: CAG
cgaggtttcatcatgttgcc

SEQ ID NO: 81810 - DNA, 20 bp, Artificial Sequence
  Description of Artificial Sequence: Synthetic oligonucleotide
  Target: ATXN1; (-) strand; PAM type: NRG; PAM sequence: AGG
ttgtattttttgtagagacg

SEQ ID NO: 81811 - DNA, 20 bp, Artificial Sequence
  Description of Artificial Sequence: Synthetic oligonucleotide
  Target: ATXN1; (-) strand; PAM type: NRG; PAM sequence: GAG
tttgtattttttgtagagac

SEQ ID NO: 81812 - DNA, 20 bp, Artificial Sequence
  Description of Artificial Sequence: Synthetic oligonucleotide
  Target: ATXN1; (-) strand; PAM type: NRG; PAM sequence: GAG
taatttttgtattttttgta

SEQ ID NO: 81813 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtattttttg

SEQ ID NO: 81814 - DNA, 20 bp, Artificial Sequence
  Description of Artificial Sequence: Synthetic oligonucleotide
  Target: ATXN1; (-) strand; PAM type: NRG; PAM sequence: TGG
catgtgtgcacgacaacacc

SEQ ID NO: 81815 - DNA, 20 bp, Artificial Sequence
  Description of Artificial Sequence: Synthetic oligonucleotide
  Target: ATXN1; (-) strand; PAM type: NRG; PAM sequence: GAG
cctcagcctcccaagtagct

SEQ ID NO: 81816 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 81817 - DNA, 20 bp, Artificial Sequence
  Description of Artificial Sequence: Synthetic oligonucleotide
  Target: ATXN1; (-) strand; PAM type: NRG; PAM sequence: AAG
tcttcctgcctcagcctccc

SEQ ID NO: 81818 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatcttcctgcct

SEQ ID NO: 81819 - DNA, 20 bp, Artificial Sequence
  Description of Artificial Sequence: Synthetic oligonucleotide
  Target: ATXN1; (-) strand; PAM type: NRG; PAM sequence: AAG
agcctcgacctccgggcctc

SEQ ID NO: 81820 - DNA, 20 bp, Artificial Sequence
  Description of Artificial Sequence: Synthetic oligonucleotide
  Target: ATXN1; (-) strand; PAM type: NRG; PAM sequence: GGG
tcactgcagcctcgacctcc

SEQ ID NO: 81821 - DNA, 20 bp, Artificial Sequence
  Description of Artificial Sequence: Synthetic oligonucleotide
  Target: ATXN1; (-) strand; PAM type: NRG; PAM sequence: CGG
ctcactgcagcctcgacctc

SEQ ID NO: 81822 - DNA, 20 bp, Artificial Sequence
  Description of Artificial Sequence: Synthetic oligonucleotide
  Target: ATXN1; (-) strand; PAM type: NRG; PAM sequence: CAG
ggtgcaatctcagctcactg

SEQ ID NO: 81823 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtgcaatct

SEQ ID NO: 81824 - DNA, 20 bp, Artificial Sequence
  Description of Artificial Sequence: Synthetic oligonucleotide
  Target: ATXN1; (-) strand; PAM type: NRG; PAM sequence: TGG
tctcccaggctggagtgcag

SEQ ID NO: 81825 - DNA, 20 bp, Artificial Sequence
  Description of Artificial Sequence: Synthetic oligonucleotide
  Target: ATXN1; (-) strand; PAM type: NRG; PAM sequence: CAG
ttgtctcccaggctggagtg

SEQ ID NO: 81826 - DNA, 20 bp, Artificial Sequence
  Description of Artificial Sequence: Synthetic oligonucleotide
  Target: ATXN1; (-) strand; PAM type: NRG; PAM sequence: GAG
cactcttgtctcccaggctg

SEQ ID NO: 81827 - DNA, 20 bp, Artificial Sequence
  Description of Artificial Sequence: Synthetic oligonucleotide
  Target: ATXN1; (-) strand; PAM type: NRG; PAM sequence: TGG
ctcactcttgtctcccaggc

SEQ ID NO: 81828 - DNA, 20 bp, Artificial Sequence
  Description of Artificial Sequence: Synthetic oligonucleotide
  Target: ATXN1; (-) strand; PAM type: NRG; PAM sequence: AGG
gggtctcactcttgtctccc

SEQ ID NO: 81829 - DNA, 20 bp, Artificial Sequence
  Description of Artificial Sequence: Synthetic oligonucleotide
  Target: ATXN1; (-) strand; PAM type: NRG; PAM sequence: CAG
agggtctcactcttgtctcc

SEQ ID NO: 81830 - DNA, 20 bp, Artificial Sequence
  Description of Artificial Sequence: Synthetic oligonucleotide
  Target: ATXN1; (-) strand; PAM type: NRG; PAM sequence: GGG
ttttttttttttttttggca

SEQ ID NO: 81831 - DNA, 20 bp, Artificial Sequence
  Description of Artificial Sequence: Synthetic oligonucleotide
  Target: ATXN1; (-) strand; PAM type: NRG; PAM sequence: AGG
tttttttttttttttttggc

SEQ ID NO: 81832 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttttgg

SEQ ID NO: 81833 - DNA, 20 bp, Artificial Sequence
  Description of Artificial Sequence: Synthetic oligonucleotide
  Target: ATXN1; (-) strand; PAM type: NRG; PAM sequence: TGG
tttttttttttttttttttt

SEQ ID NO: 81834 - DNA, 20 bp, Artificial Sequence
  Description of Artificial Sequence: Synthetic oligonucleotide
  Target: ATXN1; (-) strand; PAM type: NRG; PAM sequence: TAG
aatttctgcaagcaggctca

SEQ ID NO: 81835 - DNA, 20 bp, Artificial Sequence
  Description of Artificial Sequence: Synthetic oligonucleotide
  Target: ATXN1; (-) strand; PAM type: NRG; PAM sequence: AGG
ttctcagaatttctgcaagc

SEQ ID NO: 81836 - DNA, 20 bp, Artificial Sequence
  Description of Artificial Sequence: Synthetic oligonucleotide
  Target: ATXN1; (-) strand; PAM type: NRG; PAM sequence: CAG
cttctcagaatttctgcaag

SEQ ID NO: 81837 - DNA, 20 bp, Artificial Sequence
  Description of Artificial Sequence: Synthetic oligonucleotide
  Target: ATXN1; (-) strand; PAM type: NRG; PAM sequence: AAG
attcttctcagaatttctgc

SEQ ID NO: 81838 - DNA, 20 bp, Artificial Sequence
  Description of Artificial Sequence: Synthetic oligonucleotide
  Target: ATXN1; (-) strand; PAM type: NRG; PAM sequence: CAG
tatttggcccgaattcttct

SEQ ID NO: 81839 - DNA, 20 bp, Artificial Sequence
  Description of Artificial Sequence: Synthetic oligonucleotide
  Target: ATXN1; (-) strand; PAM type: NRG; PAM sequence: TGG
actttattttaactcctatt

SEQ ID NO: 81840 - DNA, 20 bp, Artificial Sequence
  Description of Artificial Sequence: Synthetic oligonucleotide
  Target: ATXN1; (-) strand; PAM type: NRG; PAM sequence: GAG
tagtttcatgtgcctctttg

SEQ ID NO: 81841 - DNA, 20 bp, Artificial Sequence
  Description of Artificial Sequence: Synthetic oligonucleotide
  Target: ATXN1; (-) strand; PAM type: NRG; PAM sequence: TGG
catagtttcatgtgcctctt

SEQ ID NO: 81842 - DNA, 20 bp, Artificial Sequence
  Description of Artificial Sequence: Synthetic oligonucleotide
  Target: ATXN1; (-) strand; PAM type: NRG; PAM sequence: TAG
atcgaactctttctgagaca

SEQ ID NO: 81843 - DNA, 20 bp, Artificial Sequence
  Description of Artificial Sequence: Synthetic oligonucleotide
  Target: ATXN1; (-) strand; PAM type: NRG; PAM sequence: GAG
caaacgatcgaactctttct

SEQ ID NO: 81844 - DNA, 20 bp, Artificial Sequence
  Description of Artificial Sequence: Synthetic oligonucleotide
  Target: ATXN1; (-) strand; PAM type: NRG; PAM sequence: GAG
ttttcttcttaataactgaa

SEQ ID NO: 81845 - DNA, 20 bp, Artificial Sequence
  Description of Artificial Sequence: Synthetic oligonucleotide
  Target: ATXN1; (-) strand; PAM type: NRG; PAM sequence: AAG
ttttttcttcttaataactg

SEQ ID NO: 81846 - DNA, 20 bp, Artificial Sequence
  Description of Artificial Sequence: Synthetic oligonucleotide
  Target: ATXN1; (-) strand; PAM type: NRG; PAM sequence: CAG
atatgggcatagagaagata

SEQ ID NO: 81847 - DNA, 20 bp, Artificial Sequence
  Description of Artificial Sequence: Synthetic oligonucleotide
  Target: ATXN1; (-) strand; PAM type: NRG; PAM sequence: AAG
attggaatatgggcatagag

SEQ ID NO: 81848 - DNA, 20 bp, Artificial Sequence
  Description of Artificial Sequence: Synthetic oligonucleotide
  Target: ATXN1; (-) strand; PAM type: NRG; PAM sequence: GAG
tgtattggaatatgggcata

SEQ ID NO: 81849 - DNA, 20 bp, Artificial Sequence
  Description of Artificial Sequence: Synthetic oligonucleotide
  Target: ATXN1; (-) strand; PAM type: NRG; PAM sequence: TAG
gttgtattggaatatgggca

SEQ ID NO: 81850 - DNA, 20 bp, Artificial Sequence
  Description of Artificial Sequence: Synthetic oligonucleotide
  Target: ATXN1; (-) strand; PAM type: NRG; PAM sequence: GGG
actgggttgtattggaatat

SEQ ID NO: 81851 - DNA, 20 bp, Artificial Sequence
  Description of Artificial Sequence: Synthetic oligonucleotide
  Target: ATXN1; (-) strand; PAM type: NRG; PAM sequence: TGG
aactgggttgtattggaata

SEQ ID NO: 81852 - DNA, 20 bp, Artificial Sequence
  Description of Artificial Sequence: Synthetic oligonucleotide
  Target: ATXN1; (-) strand; PAM type: NRG; PAM sequence: TGG
tttcagaaactgggttgtat

SEQ ID NO: 81853 - DNA, 20 bp, Artificial Sequence
  Description of Artificial Sequence: Synthetic oligonucleotide
  Target: ATXN1; (-) strand; PAM type: NRG; PAM sequence: GGG
tcattctaatttcagaaact

SEQ ID NO: 81854 - DNA, 20 bp, Artificial Sequence
  Description of Artificial Sequence: Synthetic oligonucleotide
  Target: ATXN1; (-) strand; PAM type: NRG; PAM sequence: TGG
ctcattctaatttcagaaac

SEQ ID NO: 81855 - DNA, 20 bp, Artificial Sequence
  Description of Artificial Sequence: Synthetic oligonucleotide
  Target: ATXN1; (-) strand; PAM type: NRG; PAM sequence: CAG
ataagttctcattctaattt

SEQ ID NO: 81856 - DNA, 20 bp, Artificial Sequence
  Description of Artificial Sequence: Synthetic oligonucleotide
  Target: ATXN1; (-) strand; PAM type: NRG; PAM sequence: AAG
ttatgtcagtaattatcaat

SEQ ID NO: 81857 - DNA, 20 bp, Artificial Sequence
  Description of Artificial Sequence: Synthetic oligonucleotide
  Target: ATXN1; (-) strand; PAM type: NRG; PAM sequence: CAG
ttatcaatactttattatgt

SEQ ID NO: 81858 - DNA, 20 bp, Artificial Sequence
  Description of Artificial Sequence: Synthetic oligonucleotide
  Target: ATXN1; (-) strand; PAM type: NRG; PAM sequence: AAG
aaatatactgttcttttcca

SEQ ID NO: 81859 - DNA, 20 bp, Artificial Sequence
  Description of Artificial Sequence: Synthetic oligonucleotide
  Target: ATXN1; (-) strand; PAM type: NRG; PAM sequence: CAG
cataatttaatttttaataa

SEQ ID NO: 81860 - DNA, 20 bp, Artificial Sequence
  Description of Artificial Sequence: Synthetic oligonucleotide
  Target: ATXN1; (-) strand; PAM type: NRG; PAM sequence: TGG
aatatttgtccttttatgtc

SEQ ID NO: 81861 - DNA, 20 bp, Artificial Sequence
  Description of Artificial Sequence: Synthetic oligonucleotide
  Target: ATXN1; (-) strand; PAM type: NRG; PAM sequence: TGG
ttcttattttagggaccaca

SEQ ID NO: 81862 - DNA, 20 bp, Artificial Sequence
  Description of Artificial Sequence: Synthetic oligonucleotide
  Target: ATXN1; (-) strand; PAM type: NRG; PAM sequence: GGG
ctatgaagtttcttatttta

SEQ ID NO: 81863 - DNA, 20 bp, Artificial Sequence
  Description of Artificial Sequence: Synthetic oligonucleotide
  Target: ATXN1; (-) strand; PAM type: NRG; PAM sequence: AGG
tctatgaagtttcttatttt

SEQ ID NO: 81864 - DNA, 20 bp, Artificial Sequence
  Description of Artificial Sequence: Synthetic oligonucleotide
  Target: ATXN1; (-) strand; PAM type: NRG; PAM sequence: TAG
ctctatgaagtttcttattt

SEQ ID NO: 81865 - DNA, 20 bp, Artificial Sequence
  Description of Artificial Sequence: Synthetic oligonucleotide
  Target: ATXN1; (-) strand; PAM type: NRG; PAM sequence: AAG
ttgtacactgtgtctctatg

SEQ ID NO: 81866 - DNA, 20 bp, Artificial Sequence
  Description of Artificial Sequence: Synthetic oligonucleotide
  Target: ATXN1; (-) strand; PAM type: NRG; PAM sequence: TGG
cattctctcctcccagcccc

SEQ ID NO: 81867 - DNA, 20 bp, Artificial Sequence
  Description of Artificial Sequence: Synthetic oligonucleotide
  Target: ATXN1; (-) strand; PAM type: NRG; PAM sequence: CAG
aacactccattctctcctcc

SEQ ID NO: 81868 - DNA, 20 bp, Artificial Sequence
  Description of Artificial Sequence: Synthetic oligonucleotide
  Target: ATXN1; (-) strand; PAM type: NRG; PAM sequence: TAG
aacagaagctctgcattcat

SEQ ID NO: 81869 - DNA, 20 bp, Artificial Sequence
  Description of Artificial Sequence: Synthetic oligonucleotide
  Target: ATXN1; (-) strand; PAM type: NRG; PAM sequence: AAG
tttttcatcatcccgaacag

SEQ ID NO: 81870 - DNA, 20 bp, Artificial Sequence
  Description of Artificial Sequence: Synthetic oligonucleotide
  Target: ATXN1; (-) strand; PAM type: NRG; PAM sequence: CAG
aactttttcatcatcccgaa

SEQ ID NO: 81871 - DNA, 20 bp, Artificial Sequence
  Description of Artificial Sequence: Synthetic oligonucleotide
  Target: ATXN1; (-) strand; PAM type: NRG; PAM sequence: CAG
tcatctccactatccatttc

SEQ ID NO: 81872 - DNA, 20 bp, Artificial Sequence
  Description of Artificial Sequence: Synthetic oligonucleotide
  Target: ATXN1; (-) strand; PAM type: NRG; PAM sequence: TAG
cattatgtacatttccagtg

SEQ ID NO: 81873 - DNA, 20 bp, Artificial Sequence
  Description of Artificial Sequence: Synthetic oligonucleotide
  Target: ATXN1; (-) strand; PAM type: NRG; PAM sequence: CAG
agtggcattatgtacatttc

SEQ ID NO: 81874 - DNA, 20 bp, Artificial Sequence
  Description of Artificial Sequence: Synthetic oligonucleotide
  Target: ATXN1; (-) strand; PAM type: NRG; PAM sequence: TGG
tttttaagtgtacaattcag

SEQ ID NO: 81875 - DNA, 20 bp, Artificial Sequence
  Description of Artificial Sequence: Synthetic oligonucleotide
  Target: ATXN1; (-) strand; PAM type: NRG; PAM sequence: CAG
ccatttttaagtgtacaatt

SEQ ID NO: 81876 - DNA, 20 bp, Artificial Sequence
  Description of Artificial Sequence: Synthetic oligonucleotide
  Target: ATXN1; (-) strand; PAM type: NRG; PAM sequence: AAG
ggcccagtttaaccattttt

SEQ ID NO: 81877 - DNA, 20 bp, Artificial Sequence
  Description of Artificial Sequence: Synthetic oligonucleotide
  Target: ATXN1; (-) strand; PAM type: NRG; PAM sequence: CAG
gtgagccaccacacctggcc

SEQ ID NO: 81878 - DNA, 20 bp, Artificial Sequence
  Description of Artificial Sequence: Synthetic oligonucleotide
  Target: ATXN1; (-) strand; PAM type: NRG; PAM sequence: TGG
ggggcgtgagccaccacacc

SEQ ID NO: 81879 - DNA, 20 bp, Artificial Sequence
  Description of Artificial Sequence: Synthetic oligonucleotide
  Target: ATXN1; (-) strand; PAM type: NRG; PAM sequence: GAG
ctcccaaagtgctggggcgt

SEQ ID NO: 81880 - DNA, 20 bp, Artificial Sequence
  Description of Artificial Sequence: Synthetic oligonucleotide
  Target: ATXN1; (-) strand; PAM type: NRG; PAM sequence: GGG
ctcagcctcccaaagtgctg

SEQ ID NO: 81881 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 81882 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaagtgc

SEQ ID NO: 81883 - DNA, 20 bp, Artificial Sequence
  Description of Artificial Sequence: Synthetic oligonucleotide
  Target: ATXN1; (-) strand; PAM type: NRG; PAM sequence: AAG
ctgcccgcctcagcctccca

SEQ ID NO: 81884 - DNA, 20 bp, Artificial Sequence
  Description of Artificial Sequence: Synthetic oligonucleotide
  Target: ATXN1; (-) strand; PAM type: NRG; PAM sequence: CAG
acctcgtgatctgcccgcct

SEQ ID NO: 81885 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccagga

SEQ ID NO: 81886 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 81887 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggc

SEQ ID NO: 81888 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcaccatgt

SEQ ID NO: 81889 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 81890 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 81891 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 81892 - DNA, 20 bp, Artificial Sequence
  Description of Artificial Sequence: Synthetic oligonucleotide
  Target: ATXN1; (-) strand; PAM type: NRG; PAM sequence: GAG
gaatttttgtatttttagta

SEQ ID NO: 81893 - DNA, 20 bp, Artificial Sequence
  Description of Artificial Sequence: Synthetic oligonucleotide
  Target: ATXN1; (-) strand; PAM type: NRG; PAM sequence: TAG
gggaatttttgtatttttag

SEQ ID NO: 81894 - DNA, 20 bp, Artificial Sequence
  Description of Artificial Sequence: Synthetic oligonucleotide
  Target: ATXN1; (-) strand; PAM type: NRG; PAM sequence: TAG
ccagggaatttttgtatttt

SEQ ID NO: 81895 - DNA, 20 bp, Artificial Sequence
  Description of Artificial Sequence: Synthetic oligonucleotide
  Target: ATXN1; (-) strand; PAM type: NRG; PAM sequence: GGG
ggcgcatgccgccacgccca

SEQ ID NO: 81896 - DNA, 20 bp, Artificial Sequence
  Description of Artificial Sequence: Synthetic oligonucleotide
  Target: ATXN1; (-) strand; PAM type: NRG; PAM sequence: AGG
aggcgcatgccgccacgccc

SEQ ID NO: 81897 - DNA, 20 bp, Artificial Sequence
  Description of Artificial Sequence: Synthetic oligonucleotide
  Target: ATXN1; (-) strand; PAM type: NRG; PAM sequence: CAG
caggcgcatgccgccacgcc

SEQ ID NO: 81898 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggactac

SEQ ID NO: 81899 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggacta

SEQ ID NO: 81900 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccgagtagct

SEQ ID NO: 81901 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccgagtagc

SEQ ID NO: 81902 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcggcctcccgag

SEQ ID NO: 81903 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcggcctccc

SEQ ID NO: 81904 - DNA, 20 bp, Artificial Sequence
  Description of Artificial Sequence: Synthetic oligonucleotide
  Target: ATXN1; (-) strand; PAM type: NRG; PAM sequence: CGG
ttcaagcaattctcctgcct

SEQ ID NO: 81905 - DNA, 20 bp, Artificial Sequence
  Description of Artificial Sequence: Synthetic oligonucleotide
  Target: ATXN1; (-) strand; PAM type: NRG; PAM sequence: AAG
agcctccgcctcctgggttc

SEQ ID NO: 81906 - DNA, 20 bp, Artificial Sequence
  Description of Artificial Sequence: Synthetic oligonucleotide
  Target: ATXN1; (-) strand; PAM type: NRG; PAM sequence: GGG
cactgcagcctccgcctcct

SEQ ID NO: 81907 - DNA, 20 bp, Artificial Sequence
  Description of Artificial Sequence: Synthetic oligonucleotide
  Target: ATXN1; (-) strand; PAM type: NRG; PAM sequence: TGG
tcactgcagcctccgcctcc

SEQ ID NO: 81908 - DNA, 20 bp, Artificial Sequence
  Description of Artificial Sequence: Synthetic oligonucleotide
  Target: ATXN1; (-) strand; PAM type: NRG; PAM sequence: CAG
ggcatgatctcagctcactg

SEQ ID NO: 81909 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcatgatct

SEQ ID NO: 81910 - DNA, 20 bp, Artificial Sequence
  Description of Artificial Sequence: Synthetic oligonucleotide
  Target: ATXN1; (-) strand; PAM type: NRG; PAM sequence: TGG
gtcgccaggctggagtgcag

SEQ ID NO: 81911 - DNA, 20 bp, Artificial Sequence
  Description of Artificial Sequence: Synthetic oligonucleotide
  Target: ATXN1; (-) strand; PAM type: NRG; PAM sequence: CAG
tctgtcgccaggctggagtg

SEQ ID NO: 81912 - DNA, 20 bp, Artificial Sequence
  Description of Artificial Sequence: Synthetic oligonucleotide
  Target: ATXN1; (-) strand; PAM type: NRG; PAM sequence: GAG
cttgctctgtcgccaggctg

SEQ ID NO: 81913 - DNA, 20 bp, Artificial Sequence
  Description of Artificial Sequence: Synthetic oligonucleotide
  Target: ATXN1; (-) strand; PAM type: NRG; PAM sequence: TGG
gtcttgctctgtcgccaggc

SEQ ID NO: 81914 - DNA, 20 bp, Artificial Sequence
  Description of Artificial Sequence: Synthetic oligonucleotide
  Target: ATXN1; (-) strand; PAM type: NRG; PAM sequence: AGG
cggagtcttgctctgtcgcc

SEQ ID NO: 81915 - DNA, 20 bp, Artificial Sequence
  Description of Artificial Sequence: Synthetic oligonucleotide
  Target: ATXN1; (-) strand; PAM type: NRG; PAM sequence: CAG
acggagtcttgctctgtcgc

SEQ ID NO: 81916 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgaaacg

SEQ ID NO: 81917 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttttgaaa

SEQ ID NO: 81918 - DNA, 20 bp, Artificial Sequence
  Description of Artificial Sequence: Synthetic oligonucleotide
  Target: ATXN1; (-) strand; PAM type: NRG; PAM sequence: TAG
ttaaaatatatataaatata

SEQ ID NO: 81919 - DNA, 20 bp, Artificial Sequence
  Description of Artificial Sequence: Synthetic oligonucleotide
  Target: ATXN1; (-) strand; PAM type: NRG; PAM sequence: AAG
catcagataccctactctga

SEQ ID NO: 81920 - DNA, 20 bp, Artificial Sequence
  Description of Artificial Sequence: Synthetic oligonucleotide
  Target: ATXN1; (-) strand; PAM type: NRG; PAM sequence: CAG
tcagggaccaggctatccat

SEQ ID NO: 81921 - DNA, 20 bp, Artificial Sequence
  Description of Artificial Sequence: Synthetic oligonucleotide
  Target: ATXN1; (-) strand; PAM type: NRG; PAM sequence: AGG
cacgctgtgtctcagggacc

SEQ ID NO: 81922 - DNA, 20 bp, Artificial Sequence
  Description of Artificial Sequence: Synthetic oligonucleotide
  Target: ATXN1; (-) strand; PAM type: NRG; PAM sequence: CAG
gcacgctgtgtctcagggac

SEQ ID NO: 81923 - DNA, 20 bp, Artificial Sequence
  Description of Artificial Sequence: Synthetic oligonucleotide
  Target: ATXN1; (-) strand; PAM type: NRG; PAM sequence: GGG
gagcagcacgctgtgtctca

SEQ ID NO: 81924 - DNA, 20 bp, Artificial Sequence
  Description of Artificial Sequence: Synthetic oligonucleotide
  Target: ATXN1; (-) strand; PAM type: NRG; PAM sequence: AGG
agagcagcacgctgtgtctc

SEQ ID NO: 81925 - DNA, 20 bp, Artificial Sequence
  Description of Artificial Sequence: Synthetic oligonucleotide
  Target: ATXN1; (-) strand; PAM type: NRG; PAM sequence: CAG
tagagcagcacgctgtgtct

SEQ ID NO: 81926 - DNA, 20 bp, Artificial Sequence
  Description of Artificial Sequence: Synthetic oligonucleotide
  Target: ATXN1; (-) strand; PAM type: NRG; PAM sequence: CAG
tttggagagccagcatagag

SEQ ID NO: 81927 - DNA, 20 bp, Artificial Sequence
  Description of Artificial Sequence: Synthetic oligonucleotide
  Target: ATXN1; (-) strand; PAM type: NRG; PAM sequence: GAG
cactttggagagccagcata

SEQ ID NO: 81928 - DNA, 20 bp, Artificial Sequence
  Description of Artificial Sequence: Synthetic oligonucleotide
  Target: ATXN1; (-) strand; PAM type: NRG; PAM sequence: TAG
cccactttggagagccagca

SEQ ID NO: 81929 - DNA, 20 bp, Artificial Sequence
  Description of Artificial Sequence: Synthetic oligonucleotide
  Target: ATXN1; (-) strand; PAM type: NRG; PAM sequence: CAG
tctcacccactttggagagc

SEQ ID NO: 81930 - DNA, 20 bp, Artificial Sequence
  Description of Artificial Sequence: Synthetic oligonucleotide
  Target: ATXN1; (-) strand; PAM type: NRG; PAM sequence: GAG
ccactctcacccactttgga

SEQ ID NO: 81931 - DNA, 20 bp, Artificial Sequence
  Description of Artificial Sequence: Synthetic oligonucleotide
  Target: ATXN1; (-) strand; PAM type: NRG; PAM sequence: GAG
caccactctcacccactttg

SEQ ID NO: 81932 - DNA, 20 bp, Artificial Sequence
  Description of Artificial Sequence: Synthetic oligonucleotide
  Target: ATXN1; (-) strand; PAM type: NRG; PAM sequence: TGG
ggcaccactctcacccactt

SEQ ID NO: 81933 - DNA, 20 bp, Artificial Sequence
  Description of Artificial Sequence: Synthetic oligonucleotide
  Target: ATXN1; (-) strand; PAM type: NRG; PAM sequence: TGG
gtatcatcccttcccgttcc

SEQ ID NO: 81934 - DNA, 20 bp, Artificial Sequence
  Description of Artificial Sequence: Synthetic oligonucleotide
  Target: ATXN1; (-) strand; PAM type: NRG; PAM sequence: CAG
ttcctggtgagtggccacgt

SEQ ID NO: 81935 - DNA, 20 bp, Artificial Sequence
  Description of Artificial Sequence: Synthetic oligonucleotide
  Target: ATXN1; (-) strand; PAM type: NRG; PAM sequence: TGG
acctctactttcctggtgag

SEQ ID NO: 81936 - DNA, 20 bp, Artificial Sequence
  Description of Artificial Sequence: Synthetic oligonucleotide
  Target: ATXN1; (-) strand; PAM type: NRG; PAM sequence: GAG
gtgacctctactttcctggt

SEQ ID NO: 81937 - DNA, 20 bp, Artificial Sequence
  Description of Artificial Sequence: Synthetic oligonucleotide
  Target: ATXN1; (-) strand; PAM type: NRG; PAM sequence: TGG
catggtgacctctactttcc

SEQ ID NO: 81938 - DNA, 20 bp, Artificial Sequence
  Description of Artificial Sequence: Synthetic oligonucleotide
  Target: ATXN1; (-) strand; PAM type: NRG; PAM sequence: TGG
tcactttgcgaaaatggaca

SEQ ID NO: 81939 - DNA, 20 bp, Artificial Sequence
  Description of Artificial Sequence: Synthetic oligonucleotide
  Target: ATXN1; (-) strand; PAM type: NRG; PAM sequence: TGG
ctgtgctcactttgcgaaaa

SEQ ID NO: 81940 - DNA, 20 bp, Artificial Sequence
  Description of Artificial Sequence: Synthetic oligonucleotide
  Target: ATXN1; (-) strand; PAM type: NRG; PAM sequence: CAG
tcagaggctttgctcacctg

SEQ ID NO: 81941 - DNA, 20 bp, Artificial Sequence
  Description of Artificial Sequence: Synthetic oligonucleotide
  Target: ATXN1; (-) strand; PAM type: NRG; PAM sequence: AGG
atgctagtgctgattttcag

SEQ ID NO: 81942 - DNA, 20 bp, Artificial Sequence
  Description of Artificial Sequence: Synthetic oligonucleotide
  Target: ATXN1; (-) strand; PAM type: NRG; PAM sequence: GAG
catgctagtgctgattttca

SEQ ID NO: 81943 - DNA, 20 bp, Artificial Sequence
  Description of Artificial Sequence: Synthetic oligonucleotide
  Target: ATXN1; (-) strand; PAM type: NRG; PAM sequence: CAG
tccatgctagtgctgatttt

SEQ ID NO: 81944 - DNA, 20 bp, Artificial Sequence
  Description of Artificial Sequence: Synthetic oligonucleotide
  Target: ATXN1; (-) strand; PAM type: NRG; PAM sequence: TAG
taaatatttggcatccatgc

SEQ ID NO: 81945 - DNA, 20 bp, Artificial Sequence
  Description of Artificial Sequence: Synthetic oligonucleotide
  Target: ATXN1; (-) strand; PAM type: NRG; PAM sequence: TGG
aatcaggaagcgtaaatatt

SEQ ID NO: 81946 - DNA, 20 bp, Artificial Sequence
  Description of Artificial Sequence: Synthetic oligonucleotide
  Target: ATXN1; (-) strand; PAM type: NRG; PAM sequence: AAG
cttgatgcatttaaatcagg

SEQ ID NO: 81947 - DNA, 20 bp, Artificial Sequence
  Description of Artificial Sequence: Synthetic oligonucleotide
  Target: ATXN1; (-) strand; PAM type: NRG; PAM sequence: AGG
ctgcttgatgcatttaaatc

SEQ ID NO: 81948 - DNA, 20 bp, Artificial Sequence
  Description of Artificial Sequence: Synthetic oligonucleotide
  Target: ATXN1; (-) strand; PAM type: NRG; PAM sequence: CAG
tctgcttgatgcatttaaat

SEQ ID NO: 81949 - DNA, 20 bp, Artificial Sequence
  Description of Artificial Sequence: Synthetic oligonucleotide
  Target: ATXN1; (-) strand; PAM type: NRG; PAM sequence: AAG
ttaagagtctcaaaaatatc

SEQ ID NO: 81950 - DNA, 20 bp, Artificial Sequence
  Description of Artificial Sequence: Synthetic oligonucleotide
  Target: ATXN1; (-) strand; PAM type: NRG; PAM sequence: GAG
caaaaatgatctaccgttaa

SEQ ID NO: 81951 - DNA, 20 bp, Artificial Sequence
  Description of Artificial Sequence: Synthetic oligonucleotide
  Target: ATXN1; (-) strand; PAM type: NRG; PAM sequence: AAG
tacaaaaatgatctaccgtt

SEQ ID NO: 81952 - DNA, 20 bp, Artificial Sequence
  Description of Artificial Sequence: Synthetic oligonucleotide
  Target: ATXN1; (-) strand; PAM type: NRG; PAM sequence: TGG
tagcttgaacagttttggag

SEQ ID NO: 81953 - DNA, 20 bp, Artificial Sequence
  Description of Artificial Sequence: Synthetic oligonucleotide
  Target: ATXN1; (-) strand; PAM type: NRG; PAM sequence: GAG
tattagcttgaacagttttg

SEQ ID NO: 81954 - DNA, 20 bp, Artificial Sequence
  Description of Artificial Sequence: Synthetic oligonucleotide
  Target: ATXN1; (-) strand; PAM type: NRG; PAM sequence: TGG
tttattagcttgaacagttt

SEQ ID NO: 81955 - DNA, 20 bp, Artificial Sequence
  Description of Artificial Sequence: Synthetic oligonucleotide
  Target: ATXN1; (-) strand; PAM type: NRG; PAM sequence: CAG
tctgtatttattagcttgaa

SEQ ID NO: 81956 - DNA, 20 bp, Artificial Sequence
  Description of Artificial Sequence: Synthetic oligonucleotide
  Target: ATXN1; (-) strand; PAM type: NRG; PAM sequence: TAG
tggcccaaatctgtatttat

SEQ ID NO: 81957 - DNA, 20 bp, Artificial Sequence
  Description of Artificial Sequence: Synthetic oligonucleotide
  Target: ATXN1; (-) strand; PAM type: NRG; PAM sequence: TGG
aagcacatattatgtaaatt

SEQ ID NO: 81958 - DNA, 20 bp, Artificial Sequence
  Description of Artificial Sequence: Synthetic oligonucleotide
  Target: ATXN1; (-) strand; PAM type: NRG; PAM sequence: AAG
gtcatggccagtgaacctac

SEQ ID NO: 81959 - DNA, 20 bp, Artificial Sequence
  Description of Artificial Sequence: Synthetic oligonucleotide
  Target: ATXN1; (-) strand; PAM type: NRG; PAM sequence: CAG
cagctatcaaaggtcatggc

SEQ ID NO: 81960 - DNA, 20 bp, Artificial Sequence
  Description of Artificial Sequence: Synthetic oligonucleotide
  Target: ATXN1; (-) strand; PAM type: NRG; PAM sequence: TGG
atttcagctatcaaaggtca

SEQ ID NO: 81961 - DNA, 20 bp, Artificial Sequence
  Description of Artificial Sequence: Synthetic oligonucleotide
  Target: ATXN1; (-) strand; PAM type: NRG; PAM sequence: AGG
agttcaatttcagctatcaa

SEQ ID NO: 81962 - DNA, 20 bp, Artificial Sequence
  Description of Artificial Sequence: Synthetic oligonucleotide
  Target: ATXN1; (-) strand; PAM type: NRG; PAM sequence: AAG
aagttcaatttcagctatca

SEQ ID NO: 81963 - DNA, 20 bp, Artificial Sequence
  Description of Artificial Sequence: Synthetic oligonucleotide
  Target: ATXN1; (-) strand; PAM type: NRG; PAM sequence: CAG
gaaaggggaaagttcaattt

SEQ ID NO: 81964 - DNA, 20 bp, Artificial Sequence
  Description of Artificial Sequence: Synthetic oligonucleotide
  Target: ATXN1; (-) strand; PAM type: NRG; PAM sequence: AAG
tgacatttagtgaaagggga

SEQ ID NO: 81965 - DNA, 20 bp, Artificial Sequence
  Description of Artificial Sequence: Synthetic oligonucleotide
  Target: ATXN1; (-) strand; PAM type: NRG; PAM sequence: GGG
ggaatgacatttagtgaaag

SEQ ID NO: 81966 - DNA, 20 bp, Artificial Sequence
  Description of Artificial Sequence: Synthetic oligonucleotide
  Target: ATXN1; (-) strand; PAM type: NRG; PAM sequence: GGG
tggaatgacatttagtgaaa

SEQ ID NO: 81967 - DNA, 20 bp, Artificial Sequence
  Description of Artificial Sequence: Synthetic oligonucleotide
  Target: ATXN1; (-) strand; PAM type: NRG; PAM sequence: AGG
ttggaatgacatttagtgaa

SEQ ID NO: 81968 - DNA, 20 bp, Artificial Sequence
  Description of Artificial Sequence: Synthetic oligonucleotide
  Target: ATXN1; (-) strand; PAM type: NRG; PAM sequence: AAG
tttggaatgacatttagtga

SEQ ID NO: 81969 - DNA, 20 bp, Artificial Sequence
  Description of Artificial Sequence: Synthetic oligonucleotide
  Target: ATXN1; (-) strand; PAM type: NRG; PAM sequence: TAG
ctggaatttggaatgacatt

SEQ ID NO: 81970 - DNA, 20 bp, Artificial Sequence
  Description of Artificial Sequence: Synthetic oligonucleotide
  Target: ATXN1; (-) strand; PAM type: NRG; PAM sequence: TGG
tccaaagacagcctggaatt

SEQ ID NO: 81971 - DNA, 20 bp, Artificial Sequence
  Description of Artificial Sequence: Synthetic oligonucleotide
  Target: ATXN1; (-) strand; PAM type: NRG; PAM sequence: TGG
gtttgcttccaaagacagcc

SEQ ID NO: 81972 - DNA, 20 bp, Artificial Sequence
  Description of Artificial Sequence: Synthetic oligonucleotide
  Target: ATXN1; (-) strand; PAM type: NRG; PAM sequence: CAG
gcagtgtttgcttccaaaga

SEQ ID NO: 81973 - DNA, 20 bp, Artificial Sequence
  Description of Artificial Sequence: Synthetic oligonucleotide
  Target: ATXN1; (-) strand; PAM type: NRG; PAM sequence: AAG
caatgcagtgtttgcttcca

SEQ ID NO: 81974 - DNA, 20 bp, Artificial Sequence
  Description of Artificial Sequence: Synthetic oligonucleotide
  Target: ATXN1; (-) strand; PAM type: NRG; PAM sequence: CAG
acacatggcaacaggcaatg

SEQ ID NO: 81975 - DNA, 20 bp, Artificial Sequence
  Description of Artificial Sequence: Synthetic oligonucleotide
  Target: ATXN1; (-) strand; PAM type: NRG; PAM sequence: AGG
tctaaaagacacatggcaac

SEQ ID NO: 81976 - DNA, 20 bp, Artificial Sequence
  Description of Artificial Sequence: Synthetic oligonucleotide
  Target: ATXN1; (-) strand; PAM type: NRG; PAM sequence: CAG
atctaaaagacacatggcaa

SEQ ID NO: 81977 - DNA, 20 bp, Artificial Sequence
  Description of Artificial Sequence: Synthetic oligonucleotide
  Target: ATXN1; (-) strand; PAM type: NRG; PAM sequence: TGG
tttattatctaaaagacaca

SEQ ID NO: 81978 - DNA, 20 bp, Artificial Sequence
  Description of Artificial Sequence: Synthetic oligonucleotide
  Target: ATXN1; (-) strand; PAM type: NRG; PAM sequence: AAG
aacccacgtttattatctaa

SEQ ID NO: 81979 - DNA, 20 bp, Artificial Sequence
  Description of Artificial Sequence: Synthetic oligonucleotide
  Target: ATXN1; (-) strand; PAM type: NRG; PAM sequence: TGG
actttgcttcttccatctgg

SEQ ID NO: 81980 - DNA, 20 bp, Artificial Sequence
  Description of Artificial Sequence: Synthetic oligonucleotide
  Target: ATXN1; (-) strand; PAM type: NRG; PAM sequence: TGG
agcactttgcttcttccatc

SEQ ID NO: 81981 - DNA, 20 bp, Artificial Sequence
  Description of Artificial Sequence: Synthetic oligonucleotide
  Target: ATXN1; (-) strand; PAM type: NRG; PAM sequence: AAG
gaaccctagatatttggggc

SEQ ID NO: 81982 - DNA, 20 bp, Artificial Sequence
  Description of Artificial Sequence: Synthetic oligonucleotide
  Target: ATXN1; (-) strand; PAM type: NRG; PAM sequence: GGG
gcaggaaccctagatatttg

SEQ ID NO: 81983 - DNA, 20 bp, Artificial Sequence
  Description of Artificial Sequence: Synthetic oligonucleotide
  Target: ATXN1; (-) strand; PAM type: NRG; PAM sequence: GGG
agcaggaaccctagatattt

SEQ ID NO: 81984 - DNA, 20 bp, Artificial Sequence
  Description of Artificial Sequence: Synthetic oligonucleotide
  Target: ATXN1; (-) strand; PAM type: NRG; PAM sequence: TGG
tagcaggaaccctagatatt

SEQ ID NO: 81985 - DNA, 20 bp, Artificial Sequence
  Description of Artificial Sequence: Synthetic oligonucleotide
  Target: ATXN1; (-) strand; PAM type: NRG; PAM sequence: TAG
tgagtacctagcaggaaccc

SEQ ID NO: 81986 - DNA, 20 bp, Artificial Sequence
  Description of Artificial Sequence: Synthetic oligonucleotide
  Target: ATXN1; (-) strand; PAM type: NRG; PAM sequence: AGG
tttgggcgtgagtacctagc

SEQ ID NO: 81987 - DNA, 20 bp, Artificial Sequence
  Description of Artificial Sequence: Synthetic oligonucleotide
  Target: ATXN1; (-) strand; PAM type: NRG; PAM sequence: CAG
gtttgggcgtgagtacctag

SEQ ID NO: 81988 - DNA, 20 bp, Artificial Sequence
  Description of Artificial Sequence: Synthetic oligonucleotide
  Target: ATXN1; (-) strand; PAM type: NRG; PAM sequence: TAG
gcagtttgggcgtgagtacc

SEQ ID NO: 81989 - DNA, 20 bp, Artificial Sequence
  Description of Artificial Sequence: Synthetic oligonucleotide
  Target: ATXN1; (-) strand; PAM type: NRG; PAM sequence: GAG
agtagatgcagtttgggcgt

SEQ ID NO: 81990 - DNA, 20 bp, Artificial Sequence
  Description of Artificial Sequence: Synthetic oligonucleotide
  Target: ATXN1; (-) strand; PAM type: NRG; PAM sequence: GGG
cttcacagtagatgcagttt

SEQ ID NO: 81991 - DNA, 20 bp, Artificial Sequence
  Description of Artificial Sequence: Synthetic oligonucleotide
  Target: ATXN1; (-) strand; PAM type: NRG; PAM sequence: TGG
tcttcacagtagatgcagtt

SEQ ID NO: 81992 - DNA, 20 bp, Artificial Sequence
  Description of Artificial Sequence: Synthetic oligonucleotide
  Target: ATXN1; (-) strand; PAM type: NRG; PAM sequence: CAG
ctaactcttcacagtagatg

SEQ ID NO: 81993 - DNA, 20 bp, Artificial Sequence
  Description of Artificial Sequence: Synthetic oligonucleotide
  Target: ATXN1; (-) strand; PAM type: NRG; PAM sequence: TAG
agtcaactaactcttcacag

SEQ ID NO: 81994 - DNA, 20 bp, Artificial Sequence
  Description of Artificial Sequence: Synthetic oligonucleotide
  Target: ATXN1; (-) strand; PAM type: NRG; PAM sequence: CAG
caaagtcaactaactcttca

SEQ ID NO: 81995 - DNA, 20 bp, Artificial Sequence
  Description of Artificial Sequence: Synthetic oligonucleotide
  Target: ATXN1; (-) strand; PAM type: NRG; PAM sequence: AAG
ctgcattgggtcagaatgca

SEQ ID NO: 81996 - DNA, 20 bp, Artificial Sequence
  Description of Artificial Sequence: Synthetic oligonucleotide
  Target: ATXN1; (-) strand; PAM type: NRG; PAM sequence: CAG
cccagcatcctgcattgggt

SEQ ID NO: 81997 - DNA, 20 bp, Artificial Sequence
  Description of Artificial Sequence: Synthetic oligonucleotide
  Target: ATXN1; (-) strand; PAM type: NRG; PAM sequence: GGG
ggagcccagcatcctgcatt

SEQ ID NO: 81998 - DNA, 20 bp, Artificial Sequence
  Description of Artificial Sequence: Synthetic oligonucleotide
  Target: ATXN1; (-) strand; PAM type: NRG; PAM sequence: TGG
aggagcccagcatcctgcat

SEQ ID NO: 81999 - DNA, 20 bp, Artificial Sequence
  Description of Artificial Sequence: Synthetic oligonucleotide
  Target: ATXN1; (-) strand; PAM type: NRG; PAM sequence: CAG
acaaaccacttgtaggagcc

SEQ ID NO: 82000 - DNA, 20 bp, Artificial Sequence
  Description of Artificial Sequence: Synthetic oligonucleotide
  Target: ATXN1; (-) strand; PAM type: NRG; PAM sequence: GAG
atcagacaaaccacttgtag

SEQ ID NO: 82001 - DNA, 20 bp, Artificial Sequence
  Description of Artificial Sequence: Synthetic oligonucleotide
  Target: ATXN1; (-) strand; PAM type: NRG; PAM sequence: AGG
ccatcagacaaaccacttgt

SEQ ID NO: 82002 - DNA, 20 bp, Artificial Sequence
  Description of Artificial Sequence: Synthetic oligonucleotide
  Target: ATXN1; (-) strand; PAM type: NRG; PAM sequence: TAG
cccatcagacaaaccacttg

SEQ ID NO: 82003 - DNA, 20 bp, Artificial Sequence
  Description of Artificial Sequence: Synthetic oligonucleotide
  Target: ATXN1; (-) strand; PAM type: NRG; PAM sequence: CAG
ggccatctctgggagcccat

SEQ ID NO: 82004 - DNA, 20 bp, Artificial Sequence
  Description of Artificial Sequence: Synthetic oligonucleotide
  Target: ATXN1; (-) strand; PAM type: NRG; PAM sequence: GAG
tggcagctggccatctctgg

SEQ ID NO: 82005 - DNA, 20 bp, Artificial Sequence
  Description of Artificial Sequence: Synthetic oligonucleotide
  Target: ATXN1; (-) strand; PAM type: NRG; PAM sequence: GGG
gctggcagctggccatctct

SEQ ID NO: 82006 - DNA, 20 bp, Artificial Sequence
  Description of Artificial Sequence: Synthetic oligonucleotide
  Target: ATXN1; (-) strand; PAM type: NRG; PAM sequence: TGG
tgctggcagctggccatctc

SEQ ID NO: 82007 - DNA, 20 bp, Artificial Sequence
  Description of Artificial Sequence: Synthetic oligonucleotide
  Target: ATXN1; (-) strand; PAM type: NRG; PAM sequence: TGG
taaatgatgctgctggcagc

SEQ ID NO: 82008 - DNA, 20 bp, Artificial Sequence
  Description of Artificial Sequence: Synthetic oligonucleotide
  Target: ATXN1; (-) strand; PAM type: NRG; PAM sequence: CAG
cttctaaatgatgctgctgg

SEQ ID NO: 82009 - DNA, 20 bp, Artificial Sequence
  Description of Artificial Sequence: Synthetic oligonucleotide
  Target: ATXN1; (-) strand; PAM type: NRG; PAM sequence: TGG
attcttctaaatgatgctgc

SEQ ID NO: 82010 - DNA, 20 bp, Artificial Sequence
  Description of Artificial Sequence: Synthetic oligonucleotide
  Target: ATXN1; (-) strand; PAM type: NRG; PAM sequence: CAG
caataatctgtcctcaggac

SEQ ID NO: 82011 - DNA, 20 bp, Artificial Sequence
  Description of Artificial Sequence: Synthetic oligonucleotide
  Target: ATXN1; (-) strand; PAM type: NRG; PAM sequence: AGG
attttcaataatctgtcctc

SEQ ID NO: 82012 - DNA, 20 bp, Artificial Sequence
  Description of Artificial Sequence: Synthetic oligonucleotide
  Target: ATXN1; (-) strand; PAM type: NRG; PAM sequence: CAG
tattttcaataatctgtcct

SEQ ID NO: 82013 - DNA, 20 bp, Artificial Sequence
  Description of Artificial Sequence: Synthetic oligonucleotide
  Target: ATXN1; (-) strand; PAM type: NRG; PAM sequence: TAG
ttgcagaggttaaatggaaa

SEQ ID NO: 82014 - DNA, 20 bp, Artificial Sequence
  Description of Artificial Sequence: Synthetic oligonucleotide
  Target: ATXN1; (-) strand; PAM type: NRG; PAM sequence: TGG
tctactttgcagaggttaaa

SEQ ID NO: 82015 - DNA, 20 bp, Artificial Sequence
  Description of Artificial Sequence: Synthetic oligonucleotide
  Target: ATXN1; (-) strand; PAM type: NRG; PAM sequence: AGG
ggacccagtctactttgcag

SEQ ID NO: 82016 - DNA, 20 bp, Artificial Sequence
  Description of Artificial Sequence: Synthetic oligonucleotide
  Target: ATXN1; (-) strand; PAM type: NRG; PAM sequence: GAG
aggacccagtctactttgca

SEQ ID NO: 82017 - DNA, 20 bp, Artificial Sequence
  Description of Artificial Sequence: Synthetic oligonucleotide
  Target: ATXN1; (-) strand; PAM type: NRG; PAM sequence: CAG
caaggacccagtctactttg

SEQ ID NO: 82018 - DNA, 20 bp, Artificial Sequence
  Description of Artificial Sequence: Synthetic oligonucleotide
  Target: ATXN1; (-) strand; PAM type: NRG; PAM sequence: CAG
acgaaagccccacaaggacc

SEQ ID NO: 82019 - DNA, 20 bp, Artificial Sequence
  Description of Artificial Sequence: Synthetic oligonucleotide
  Target: ATXN1; (-) strand; PAM type: NRG; PAM sequence: AGG
aaggaaacgaaagccccaca

SEQ ID NO: 82020 - DNA, 20 bp, Artificial Sequence
  Description of Artificial Sequence: Synthetic oligonucleotide
  Target: ATXN1; (-) strand; PAM type: NRG; PAM sequence: AAG
taaggaaacgaaagccccac

SEQ ID NO: 82021 - DNA, 20 bp, Artificial Sequence
  Description of Artificial Sequence: Synthetic oligonucleotide
  Target: ATXN1; (-) strand; PAM type: NRG; PAM sequence: AAG
agttgcttttaaggaaacga

SEQ ID NO: 82022 - DNA, 20 bp, Artificial Sequence
  Description of Artificial Sequence: Synthetic oligonucleotide
  Target: ATXN1; (-) strand; PAM type: NRG; PAM sequence: AGG
caagtacacagttgctttta

SEQ ID NO: 82023 - DNA, 20 bp, Artificial Sequence
  Description of Artificial Sequence: Synthetic oligonucleotide
  Target: ATXN1; (-) strand; PAM type: NRG; PAM sequence: AAG
gcaagtacacagttgctttt

SEQ ID NO: 82024 - DNA, 20 bp, Artificial Sequence
  Description of Artificial Sequence: Synthetic oligonucleotide
  Target: ATXN1; (-) strand; PAM type: NRG; PAM sequence: CAG
cacgttgctaagcaagtaca

SEQ ID NO: 82025 - DNA, 20 bp, Artificial Sequence
  Description of Artificial Sequence: Synthetic oligonucleotide
  Target: ATXN1; (-) strand; PAM type: NRG; PAM sequence: AAG
ttaagtccacgttgctaagc

SEQ ID NO: 82026 - DNA, 20 bp, Artificial Sequence
  Description of Artificial Sequence: Synthetic oligonucleotide
  Target: ATXN1; (-) strand; PAM type: NRG; PAM sequence: AAG
tggtttaagtccacgttgct

SEQ ID NO: 82027 - DNA, 20 bp, Artificial Sequence
  Description of Artificial Sequence: Synthetic oligonucleotide
  Target: ATXN1; (-) strand; PAM type: NRG; PAM sequence: AAG
agtatttcttccactggttt

SEQ ID NO: 82028 - DNA, 20 bp, Artificial Sequence
  Description of Artificial Sequence: Synthetic oligonucleotide
  Target: ATXN1; (-) strand; PAM type: NRG; PAM sequence: TGG
ccactaagtatttcttccac

SEQ ID NO: 82029 - DNA, 20 bp, Artificial Sequence
  Description of Artificial Sequence: Synthetic oligonucleotide
  Target: ATXN1; (-) strand; PAM type: NRG; PAM sequence: AAG
gctgttttccagtctccact

SEQ ID NO: 82030 - DNA, 20 bp, Artificial Sequence
  Description of Artificial Sequence: Synthetic oligonucleotide
  Target: ATXN1; (-) strand; PAM type: NRG; PAM sequence: CAG
tctcttttattgctgttttc

SEQ ID NO: 82031 - DNA, 20 bp, Artificial Sequence
  Description of Artificial Sequence: Synthetic oligonucleotide
  Target: ATXN1; (-) strand; PAM type: NRG; PAM sequence: CGG
cctcacccttggtctgtagt

SEQ ID NO: 82032 - DNA, 20 bp, Artificial Sequence
  Description of Artificial Sequence: Synthetic oligonucleotide
  Target: ATXN1; (-) strand; PAM type: NRG; PAM sequence: TAG
gctccctcacccttggtctg

SEQ ID NO: 82033 - DNA, 20 bp, Artificial Sequence
  Description of Artificial Sequence: Synthetic oligonucleotide
  Target: ATXN1; (-) strand; PAM type: NRG; PAM sequence: TGG
atctgtggctccctcaccct

SEQ ID NO: 82034 - DNA, 20 bp, Artificial Sequence
  Description of Artificial Sequence: Synthetic oligonucleotide
  Target: ATXN1; (-) strand; PAM type: NRG; PAM sequence: TGG
taaagctgggattcaatctg

SEQ ID NO: 82035 - DNA, 20 bp, Artificial Sequence
  Description of Artificial Sequence: Synthetic oligonucleotide
  Target: ATXN1; (-) strand; PAM type: NRG; PAM sequence: GGG
tgcttggagatggtaaagct

SEQ ID NO: 82036 - DNA, 20 bp, Artificial Sequence
  Description of Artificial Sequence: Synthetic oligonucleotide
  Target: ATXN1; (-) strand; PAM type: NRG; PAM sequence: TGG
ctgcttggagatggtaaagc

SEQ ID NO: 82037 - DNA, 20 bp, Artificial Sequence
  Description of Artificial Sequence: Synthetic oligonucleotide
  Target: ATXN1; (-) strand; PAM type: NRG; PAM sequence: AAG
aatgctgcttggagatggta

SEQ ID NO: 82038 - DNA, 20 bp, Artificial Sequence
  Description of Artificial Sequence: Synthetic oligonucleotide
  Target: ATXN1; (-) strand; PAM type: NRG; PAM sequence: TGG
aaagtaatgctgcttggaga

SEQ ID NO: 82039 - DNA, 20 bp, Artificial Sequence
  Description of Artificial Sequence: Synthetic oligonucleotide
  Target: ATXN1; (-) strand; PAM type: NRG; PAM sequence: GAG
gaagaaagtaatgctgcttg

SEQ ID NO: 82040 - DNA, 20 bp, Artificial Sequence
  Description of Artificial Sequence: Synthetic oligonucleotide
  Target: ATXN1; (-) strand; PAM type: NRG; PAM sequence: TGG
ctgaagaaagtaatgctgct

SEQ ID NO: 82041 - DNA, 20 bp, Artificial Sequence
  Description of Artificial Sequence: Synthetic oligonucleotide
  Target: ATXN1; (-) strand; PAM type: NRG; PAM sequence: AAG
gaggtcactgggactgaaga

SEQ ID NO: 82042 - DNA, 20 bp, Artificial Sequence
  Description of Artificial Sequence: Synthetic oligonucleotide
  Target: ATXN1; (-) strand; PAM type: NRG; PAM sequence: AAG
ggatgaggtcactgggactg

SEQ ID NO: 82043 - DNA, 20 bp, Artificial Sequence
  Description of Artificial Sequence: Synthetic oligonucleotide
  Target: ATXN1; (-) strand; PAM type: NRG; PAM sequence: GGG
ttataatggatgaggtcact

SEQ ID NO: 82044 - DNA, 20 bp, Artificial Sequence
  Description of Artificial Sequence: Synthetic oligonucleotide
  Target: ATXN1; (-) strand; PAM type: NRG; PAM sequence: TGG
attataatggatgaggtcac

SEQ ID NO: 82045 - DNA, 20 bp, Artificial Sequence
  Description of Artificial Sequence: Synthetic oligonucleotide
  Target: ATXN1; (-) strand; PAM type: NRG; PAM sequence: AGG
tattaatattataatggatg

SEQ ID NO: 82046 - DNA, 20 bp, Artificial Sequence
  Description of Artificial Sequence: Synthetic oligonucleotide
  Target: ATXN1; (-) strand; PAM type: NRG; PAM sequence: GAG
ttattaatattataatggat

SEQ ID NO: 82047 - DNA, 20 bp, Artificial Sequence
  Description of Artificial Sequence: Synthetic oligonucleotide
  Target: ATXN1; (-) strand; PAM type: NRG; PAM sequence: TGG
atatgttattaatattataa

SEQ ID NO: 82048 - DNA, 20 bp, Artificial Sequence
  Description of Artificial Sequence: Synthetic oligonucleotide
  Target: ATXN1; (-) strand; PAM type: NRG; PAM sequence: GAG
taggaaatcttaaaggtaga

SEQ ID NO: 82049 - DNA, 20 bp, Artificial Sequence
  Description of Artificial Sequence: Synthetic oligonucleotide
  Target: ATXN1; (-) strand; PAM type: NRG; PAM sequence: GAG
cataggaaatcttaaaggta

SEQ ID NO: 82050 - DNA, 20 bp, Artificial Sequence
  Description of Artificial Sequence: Synthetic oligonucleotide
  Target: ATXN1; (-) strand; PAM type: NRG; PAM sequence: TAG
cccataggaaatcttaaagg

SEQ ID NO: 82051 - DNA, 20 bp, Artificial Sequence
  Description of Artificial Sequence: Synthetic oligonucleotide
  Target: ATXN1; (-) strand; PAM type: NRG; PAM sequence: AGG
atccccataggaaatcttaa

SEQ ID NO: 82052 - DNA, 20 bp, Artificial Sequence
  Description of Artificial Sequence: Synthetic oligonucleotide
  Target: ATXN1; (-) strand; PAM type: NRG; PAM sequence: AAG
gatccccataggaaatctta

SEQ ID NO: 82053 - DNA, 20 bp, Artificial Sequence
  Description of Artificial Sequence: Synthetic oligonucleotide
  Target: ATXN1; (-) strand; PAM type: NRG; PAM sequence: AGG
tcatctcatttgatccccat

SEQ ID NO: 82054 - DNA, 20 bp, Artificial Sequence
  Description of Artificial Sequence: Synthetic oligonucleotide
  Target: ATXN1; (-) strand; PAM type: NRG; PAM sequence: TAG
ttcatctcatttgatcccca

SEQ ID NO: 82055 - DNA, 20 bp, Artificial Sequence
  Description of Artificial Sequence: Synthetic oligonucleotide
  Target: ATXN1; (-) strand; PAM type: NRG; PAM sequence: GAG
aataaactggttaagttact

SEQ ID NO: 82056 - DNA, 20 bp, Artificial Sequence
  Description of Artificial Sequence: Synthetic oligonucleotide
  Target: ATXN1; (-) strand; PAM type: NRG; PAM sequence: AAG
aaagaagaaataaactggtt

SEQ ID NO: 82057 - DNA, 20 bp, Artificial Sequence
  Description of Artificial Sequence: Synthetic oligonucleotide
  Target: ATXN1; (-) strand; PAM type: NRG; PAM sequence: TGG
tttttaaagaagaaataaac

SEQ ID NO: 82058 - DNA, 20 bp, Artificial Sequence
  Description of Artificial Sequence: Synthetic oligonucleotide
  Target: ATXN1; (-) strand; PAM type: NRG; PAM sequence: AAG
gtacaatttcctttttaaag

SEQ ID NO: 82059 - DNA, 20 bp, Artificial Sequence
  Description of Artificial Sequence: Synthetic oligonucleotide
  Target: ATXN1; (-) strand; PAM type: NRG; PAM sequence: AAG
tttgtacaatttccttttta

SEQ ID NO: 82060 - DNA, 20 bp, Artificial Sequence
  Description of Artificial Sequence: Synthetic oligonucleotide
  Target: ATXN1; (-) strand; PAM type: NRG; PAM sequence: TGG
aagcttccttaacaaaactc

SEQ ID NO: 82061 - DNA, 20 bp, Artificial Sequence
  Description of Artificial Sequence: Synthetic oligonucleotide
  Target: ATXN1; (-) strand; PAM type: NRG; PAM sequence: AAG
actggtggagtctgttttca

SEQ ID NO: 82062 - DNA, 20 bp, Artificial Sequence
  Description of Artificial Sequence: Synthetic oligonucleotide
  Target: ATXN1; (-) strand; PAM type: NRG; PAM sequence: GAG
atactccataaatactggtg

SEQ ID NO: 82063 - DNA, 20 bp, Artificial Sequence
  Description of Artificial Sequence: Synthetic oligonucleotide
  Target: ATXN1; (-) strand; PAM type: NRG; PAM sequence: TGG
gaatactccataaatactgg

SEQ ID NO: 82064 - DNA, 20 bp, Artificial Sequence
  Description of Artificial Sequence: Synthetic oligonucleotide
  Target: ATXN1; (-) strand; PAM type: NRG; PAM sequence: TGG
ggtgaatactccataaatac

SEQ ID NO: 82065 - DNA, 20 bp, Artificial Sequence
  Description of Artificial Sequence: Synthetic oligonucleotide
  Target: ATXN1; (-) strand; PAM type: NRG; PAM sequence: TGG
gtggtattagactgtcagta

SEQ ID NO: 82066 - DNA, 20 bp, Artificial Sequence
  Description of Artificial Sequence: Synthetic oligonucleotide
  Target: ATXN1; (-) strand; PAM type: NRG; PAM sequence: CAG
gaggagtggtattagactgt

SEQ ID NO: 82067 - DNA, 20 bp, Artificial Sequence
  Description of Artificial Sequence: Synthetic oligonucleotide
  Target: ATXN1; (-) strand; PAM type: NRG; PAM sequence: TAG
gctccccagaggagtggtat

SEQ ID NO: 82068 - DNA, 20 bp, Artificial Sequence
  Description of Artificial Sequence: Synthetic oligonucleotide
  Target: ATXN1; (-) strand; PAM type: NRG; PAM sequence: TGG
tcctgggctccccagaggag

SEQ ID NO: 82069 - DNA, 20 bp, Artificial Sequence
  Description of Artificial Sequence: Synthetic oligonucleotide
  Target: ATXN1; (-) strand; PAM type: NRG; PAM sequence: GAG
ccatcctgggctccccagag

SEQ ID NO: 82070 - DNA, 20 bp, Artificial Sequence
  Description of Artificial Sequence: Synthetic oligonucleotide
  Target: ATXN1; (-) strand; PAM type: NRG; PAM sequence: AGG
caccatcctgggctccccag

SEQ ID NO: 82071 - DNA, 20 bp, Artificial Sequence
  Description of Artificial Sequence: Synthetic oligonucleotide
  Target: ATXN1; (-) strand; PAM type: NRG; PAM sequence: GAG
gcaccatcctgggctcccca

SEQ ID NO: 82072 - DNA, 20 bp, Artificial Sequence
  Description of Artificial Sequence: Synthetic oligonucleotide
  Target: ATXN1; (-) strand; PAM type: NRG; PAM sequence: CAG
ttgcaccatcctgggctccc

SEQ ID NO: 82073 - DNA, 20 bp, Artificial Sequence
  Description of Artificial Sequence: Synthetic oligonucleotide
  Target: ATXN1; (-) strand; PAM type: NRG; PAM sequence: GGG
gatacatcttgcaccatcct

SEQ ID NO: 82074 - DNA, 20 bp, Artificial Sequence
  Description of Artificial Sequence: Synthetic oligonucleotide
  Target: ATXN1; (-) strand; PAM type: NRG; PAM sequence: TGG
agatacatcttgcaccatcc

SEQ ID NO: 82075 - DNA, 20 bp, Artificial Sequence
  Description of Artificial Sequence: Synthetic oligonucleotide
  Target: ATXN1; (-) strand; PAM type: NRG; PAM sequence: GAG
tgccaccacacatagccttg

SEQ ID NO: 82076 - DNA, 20 bp, Artificial Sequence
  Description of Artificial Sequence: Synthetic oligonucleotide
  Target: ATXN1; (-) strand; PAM type: NRG; PAM sequence: TGG
tgtgccaccacacatagcct

SEQ ID NO: 82077 - DNA, 20 bp, Artificial Sequence
  Description of Artificial Sequence: Synthetic oligonucleotide
  Target: ATXN1; (-) strand; PAM type: NRG; PAM sequence: TAG
tgggcatgtgccaccacaca

SEQ ID NO: 82078 - DNA, 20 bp, Artificial Sequence
  Description of Artificial Sequence: Synthetic oligonucleotide
  Target: ATXN1; (-) strand; PAM type: NRG; PAM sequence: GGG
tctcagagtgctgggattat

SEQ ID NO: 82079 - DNA, 20 bp, Artificial Sequence
  Description of Artificial Sequence: Synthetic oligonucleotide
  Target: ATXN1; (-) strand; PAM type: NRG; PAM sequence: TGG
ctctcagagtgctgggatta

SEQ ID NO: 82080 - DNA, 20 bp, Artificial Sequence
  Description of Artificial Sequence: Synthetic oligonucleotide
  Target: ATXN1; (-) strand; PAM type: NRG; PAM sequence: GGG
ctttggcctctcagagtgct

SEQ ID NO: 82081 - DNA, 20 bp, Artificial Sequence
  Description of Artificial Sequence: Synthetic oligonucleotide
  Target: ATXN1; (-) strand; PAM type: NRG; PAM sequence: TGG
gctttggcctctcagagtgc

SEQ ID NO: 82082 - DNA, 20 bp, Artificial Sequence
  Description of Artificial Sequence: Synthetic oligonucleotide
  Target: ATXN1; (-) strand; PAM type: NRG; PAM sequence: GAG
tctcctgctttggcctctca

SEQ ID NO: 82083 - DNA, 20 bp, Artificial Sequence
  Description of Artificial Sequence: Synthetic oligonucleotide
  Target: ATXN1; (-) strand; PAM type: NRG; PAM sequence: CAG
attctcctgctttggcctct

SEQ ID NO: 82084 - DNA, 20 bp, Artificial Sequence
  Description of Artificial Sequence: Synthetic oligonucleotide
  Target: ATXN1; (-) strand; PAM type: NRG; PAM sequence: TGG
ttccagcaattctcctgctt

SEQ ID NO: 82085 - DNA, 20 bp, Artificial Sequence
  Description of Artificial Sequence: Synthetic oligonucleotide
  Target: ATXN1; (-) strand; PAM type: NRG; PAM sequence: CAG
tgttctggagccctgtgttc

SEQ ID NO: 82086 - DNA, 20 bp, Artificial Sequence
  Description of Artificial Sequence: Synthetic oligonucleotide
  Target: ATXN1; (-) strand; PAM type: NRG; PAM sequence: GAG
atgttacccaggctgttctg

SEQ ID NO: 82087 - DNA, 20 bp, Artificial Sequence
  Description of Artificial Sequence: Synthetic oligonucleotide
  Target: ATXN1; (-) strand; PAM type: NRG; PAM sequence: TGG
ctatgttacccaggctgttc

SEQ ID NO: 82088 - DNA, 20 bp, Artificial Sequence
  Description of Artificial Sequence: Synthetic oligonucleotide
  Target: ATXN1; (-) strand; PAM type: NRG; PAM sequence: AGG
ggattcttgctatgttaccc

SEQ ID NO: 82089 - DNA, 20 bp, Artificial Sequence
  Description of Artificial Sequence: Synthetic oligonucleotide
  Target: ATXN1; (-) strand; PAM type: NRG; PAM sequence: CAG
tggattcttgctatgttacc

SEQ ID NO: 82090 - DNA, 20 bp, Artificial Sequence
  Description of Artificial Sequence: Synthetic oligonucleotide
  Target: ATXN1; (-) strand; PAM type: NRG; PAM sequence: TGG
taattttttttttgtagaga

SEQ ID NO: 82091 - DNA, 20 bp, Artificial Sequence
  Description of Artificial Sequence: Synthetic oligonucleotide
  Target: ATXN1; (-) strand; PAM type: NRG; PAM sequence: GAG
tttttaattttttttttgta

SEQ ID NO: 82092 - DNA, 20 bp, Artificial Sequence
  Description of Artificial Sequence: Synthetic oligonucleotide
  Target: ATXN1; (-) strand; PAM type: NRG; PAM sequence: TAG
catttttaattttttttttg

SEQ ID NO: 82093 - DNA, 20 bp, Artificial Sequence
  Description of Artificial Sequence: Synthetic oligonucleotide
  Target: ATXN1; (-) strand; PAM type: NRG; PAM sequence: TGG
gaggcatgtgccaccacacc

SEQ ID NO: 82094 - DNA, 20 bp, Artificial Sequence
  Description of Artificial Sequence: Synthetic oligonucleotide
  Target: ATXN1; (-) strand; PAM type: NRG; PAM sequence: AGG
tcccagagctctggaattag

SEQ ID NO: 82095 - DNA, 20 bp, Artificial Sequence
  Description of Artificial Sequence: Synthetic oligonucleotide
  Target: ATXN1; (-) strand; PAM type: NRG; PAM sequence: GAG
ttcccagagctctggaatta

SEQ ID NO: 82096 - DNA, 20 bp, Artificial Sequence
  Description of Artificial Sequence: Synthetic oligonucleotide
  Target: ATXN1; (-) strand; PAM type: NRG; PAM sequence: TAG
acttcccagagctctggaat

SEQ ID NO: 82097 - DNA, 20 bp, Artificial Sequence
  Description of Artificial Sequence: Synthetic oligonucleotide
  Target: ATXN1; (-) strand; PAM type: NRG; PAM sequence: TGG
accccaacttcccagagctc

SEQ ID NO: 82098 - DNA, 20 bp, Artificial Sequence
  Description of Artificial Sequence: Synthetic oligonucleotide
  Target: ATXN1; (-) strand; PAM type: NRG; PAM sequence: GAG
cctcccaccccaacttccca

SEQ ID NO: 82099 - DNA, 20 bp, Artificial Sequence
  Description of Artificial Sequence: Synthetic oligonucleotide
  Target: ATXN1; (-) strand; PAM type: NRG; PAM sequence: CAG
atcctcccaccccaacttcc

SEQ ID NO: 82100 - DNA, 20 bp, Artificial Sequence
  Description of Artificial Sequence: Synthetic oligonucleotide
  Target: ATXN1; (-) strand; PAM type: NRG; PAM sequence: AGG
atccttgacctcctgagccc

SEQ ID NO: 82101 - DNA, 20 bp, Artificial Sequence
  Description of Artificial Sequence: Synthetic oligonucleotide
  Target: ATXN1; (-) strand; PAM type: NRG; PAM sequence: CAG
catccttgacctcctgagcc

SEQ ID NO: 82102 - DNA, 20 bp, Artificial Sequence
  Description of Artificial Sequence: Synthetic oligonucleotide
  Target: ATXN1; (-) strand; PAM type: NRG; PAM sequence: GAG
cactgcatccttgacctcct

SEQ ID NO: 82103 - DNA, 20 bp, Artificial Sequence
  Description of Artificial Sequence: Synthetic oligonucleotide
  Target: ATXN1; (-) strand; PAM type: NRG; PAM sequence: TAG
tgagtacagtggtatcatca

SEQ ID NO: 82104 - DNA, 20 bp, Artificial Sequence
  Description of Artificial Sequence: Synthetic oligonucleotide
  Target: ATXN1; (-) strand; PAM type: NRG; PAM sequence: TGG
gtcacccaggctgagtacag

SEQ ID NO: 82105 - DNA, 20 bp, Artificial Sequence
  Description of Artificial Sequence: Synthetic oligonucleotide
  Target: ATXN1; (-) strand; PAM type: NRG; PAM sequence: CAG
tctgtcacccaggctgagta

SEQ ID NO: 82106 - DNA, 20 bp, Artificial Sequence
  Description of Artificial Sequence: Synthetic oligonucleotide
  Target: ATXN1; (-) strand; PAM type: NRG; PAM sequence: GAG
cttgctctgtcacccaggct

SEQ ID NO: 82107 - DNA, 20 bp, Artificial Sequence
  Description of Artificial Sequence: Synthetic oligonucleotide
  Target: ATXN1; (-) strand; PAM type: NRG; PAM sequence: AGG
agagtcttgctctgtcaccc

SEQ ID NO: 82108 - DNA, 20 bp, Artificial Sequence
  Description of Artificial Sequence: Synthetic oligonucleotide
  Target: ATXN1; (-) strand; PAM type: NRG; PAM sequence: CAG
cagagtcttgctctgtcacc

SEQ ID NO: 82109 - DNA, 20 bp, Artificial Sequence
  Description of Artificial Sequence: Synthetic oligonucleotide
  Target: ATXN1; (-) strand; PAM type: NRG; PAM sequence: GAG
tttgttttgtttaagagaca

SEQ ID NO: 82110 - DNA, 20 bp, Artificial Sequence
  Description of Artificial Sequence: Synthetic oligonucleotide
  Target: ATXN1; (-) strand; PAM type: NRG; PAM sequence: CAG
cttttgttttgtttaagaga

SEQ ID NO: 82111 - DNA, 20 bp, Artificial Sequence
  Description of Artificial Sequence: Synthetic oligonucleotide
  Target: ATXN1; (-) strand; PAM type: NRG; PAM sequence: GAG
acgtcttttgttttgtttaa

SEQ ID NO: 82112 - DNA, 20 bp, Artificial Sequence
  Description of Artificial Sequence: Synthetic oligonucleotide
  Target: ATXN1; (-) strand; PAM type: NRG; PAM sequence: AAG
acacgtcttttgttttgttt

SEQ ID NO: 82113 - DNA, 20 bp, Artificial Sequence
  Description of Artificial Sequence: Synthetic oligonucleotide
  Target: ATXN1; (-) strand; PAM type: NRG; PAM sequence: TAG
ttttcacttccctggagtgg

SEQ ID NO: 82114 - DNA, 20 bp, Artificial Sequence
  Description of Artificial Sequence: Synthetic oligonucleotide
  Target: ATXN1; (-) strand; PAM type: NRG; PAM sequence: TGG
gctttttcacttccctggag

SEQ ID NO: 82115 - DNA, 20 bp, Artificial Sequence
  Description of Artificial Sequence: Synthetic oligonucleotide
  Target: ATXN1; (-) strand; PAM type: NRG; PAM sequence: GAG
tctgctttttcacttccctg

SEQ ID NO: 82116 - DNA, 20 bp, Artificial Sequence
  Description of Artificial Sequence: Synthetic oligonucleotide
  Target: ATXN1; (-) strand; PAM type: NRG; PAM sequence: TGG
tatctgctttttcacttccc

SEQ ID NO: 82117 - DNA, 20 bp, Artificial Sequence
  Description of Artificial Sequence: Synthetic oligonucleotide
  Target: ATXN1; (-) strand; PAM type: NRG; PAM sequence: AGG
gggtcatgatcactcttagc

SEQ ID NO: 82118 - DNA, 20 bp, Artificial Sequence
  Description of Artificial Sequence: Synthetic oligonucleotide
  Target: ATXN1; (-) strand; PAM type: NRG; PAM sequence: CAG
agggtcatgatcactcttag

SEQ ID NO: 82119 - DNA, 20 bp, Artificial Sequence
  Description of Artificial Sequence: Synthetic oligonucleotide
  Target: ATXN1; (-) strand; PAM type: NRG; PAM sequence: TAG
gagagggtcatgatcactct

SEQ ID NO: 82120 - DNA, 20 bp, Artificial Sequence
  Description of Artificial Sequence: Synthetic oligonucleotide
  Target: ATXN1; (-) strand; PAM type: NRG; PAM sequence: GGG
gaaggttgttgaataggaga

SEQ ID NO: 82121 - DNA, 20 bp, Artificial Sequence
  Description of Artificial Sequence: Synthetic oligonucleotide
  Target: ATXN1; (-) strand; PAM type: NRG; PAM sequence: AGG
tgaaggttgttgaataggag

SEQ ID NO: 82122 - DNA, 20 bp, Artificial Sequence
  Description of Artificial Sequence: Synthetic oligonucleotide
  Target: ATXN1; (-) strand; PAM type: NRG; PAM sequence: GAG
ctgaaggttgttgaatagga

SEQ ID NO: 82123 - DNA, 20 bp, Artificial Sequence
  Description of Artificial Sequence: Synthetic oligonucleotide
  Target: ATXN1; (-) strand; PAM type: NRG; PAM sequence: GAG
cactgaaggttgttgaatag

SEQ ID NO: 82124 - DNA, 20 bp, Artificial Sequence
  Description of Artificial Sequence: Synthetic oligonucleotide
  Target: ATXN1; (-) strand; PAM type: NRG; PAM sequence: AGG
gccactgaaggttgttgaat

SEQ ID NO: 82125 - DNA, 20 bp, Artificial Sequence
  Description of Artificial Sequence: Synthetic oligonucleotide
  Target: ATXN1; (-) strand; PAM type: NRG; PAM sequence: TAG
agccactgaaggttgttgaa

SEQ ID NO: 82126 - DNA, 20 bp, Artificial Sequence
  Description of Artificial Sequence: Synthetic oligonucleotide
  Target: ATXN1; (-) strand; PAM type: NRG; PAM sequence: AGG
aagtggcggagagccactga

SEQ ID NO: 82127 - DNA, 20 bp, Artificial Sequence
  Description of Artificial Sequence: Synthetic oligonucleotide
  Target: ATXN1; (-) strand; PAM type: NRG; PAM sequence: AAG
taagtggcggagagccactg

SEQ ID NO: 82128 - DNA, 20 bp, Artificial Sequence
  Description of Artificial Sequence: Synthetic oligonucleotide
  Target: ATXN1; (-) strand; PAM type: NRG; PAM sequence: GAG
attttttcttaagtggcgga

SEQ ID NO: 82129 - DNA, 20 bp, Artificial Sequence
  Description of Artificial Sequence: Synthetic oligonucleotide
  Target: ATXN1; (-) strand; PAM type: NRG; PAM sequence: GAG
ccattttttcttaagtggcg

SEQ ID NO: 82130 - DNA, 20 bp, Artificial Sequence
  Description of Artificial Sequence: Synthetic oligonucleotide
  Target: ATXN1; (-) strand; PAM type: NRG; PAM sequence: CGG
ttccattttttcttaagtgg

SEQ ID NO: 82131 - DNA, 20 bp, Artificial Sequence
  Description of Artificial Sequence: Synthetic oligonucleotide
  Target: ATXN1; (-) strand; PAM type: NRG; PAM sequence: TGG
taattccattttttcttaag

SEQ ID NO: 82132 - DNA, 20 bp, Artificial Sequence
  Description of Artificial Sequence: Synthetic oligonucleotide
  Target: ATXN1; (-) strand; PAM type: NRG; PAM sequence: AAG
gattaattccattttttctt

SEQ ID NO: 82133 - DNA, 20 bp, Artificial Sequence
  Description of Artificial Sequence: Synthetic oligonucleotide
  Target: ATXN1; (-) strand; PAM type: NRG; PAM sequence: GGG
cattttacagatgagaaaat

SEQ ID NO: 82134 - DNA, 20 bp, Artificial Sequence
  Description of Artificial Sequence: Synthetic oligonucleotide
  Target: ATXN1; (-) strand; PAM type: NRG; PAM sequence: TGG
acattttacagatgagaaaa

SEQ ID NO: 82135 - DNA, 20 bp, Artificial Sequence
  Description of Artificial Sequence: Synthetic oligonucleotide
  Target: ATXN1; (-) strand; PAM type: NRG; PAM sequence: GAG
gctatccacattttacagat

SEQ ID NO: 82136 - DNA, 20 bp, Artificial Sequence
  Description of Artificial Sequence: Synthetic oligonucleotide
  Target: ATXN1; (-) strand; PAM type: NRG; PAM sequence: CAG
acatagctatccacatttta

SEQ ID NO: 82137 - DNA, 20 bp, Artificial Sequence
  Description of Artificial Sequence: Synthetic oligonucleotide
  Target: ATXN1; (-) strand; PAM type: NRG; PAM sequence: TAG
gattacaactcccttcaaca

SEQ ID NO: 82138 - DNA, 20 bp, Artificial Sequence
  Description of Artificial Sequence: Synthetic oligonucleotide
  Target: ATXN1; (-) strand; PAM type: NRG; PAM sequence: TAG
ggttggggctttacataaat

SEQ ID NO: 82139 - DNA, 20 bp, Artificial Sequence
  Description of Artificial Sequence: Synthetic oligonucleotide
  Target: ATXN1; (-) strand; PAM type: NRG; PAM sequence: GGG
tatatcagattctgtggttg

SEQ ID NO: 82140 - DNA, 20 bp, Artificial Sequence
  Description of Artificial Sequence: Synthetic oligonucleotide
  Target: ATXN1; (-) strand; PAM type: NRG; PAM sequence: GGG
atatatcagattctgtggtt

SEQ ID NO: 82141 - DNA, 20 bp, Artificial Sequence
  Description of Artificial Sequence: Synthetic oligonucleotide
  Target: ATXN1; (-) strand; PAM type: NRG; PAM sequence: TGG
catatatcagattctgtggt

SEQ ID NO: 82142 - DNA, 20 bp, Artificial Sequence
  Description of Artificial Sequence: Synthetic oligonucleotide
  Target: ATXN1; (-) strand; PAM type: NRG; PAM sequence: TGG
gtgccatatatcagattctg

SEQ ID NO: 82143 - DNA, 20 bp, Artificial Sequence
  Description of Artificial Sequence: Synthetic oligonucleotide
  Target: ATXN1; (-) strand; PAM type: NRG; PAM sequence: CAG
cactgagtggtgccatatat

SEQ ID NO: 82144 - DNA, 20 bp, Artificial Sequence
  Description of Artificial Sequence: Synthetic oligonucleotide
  Target: ATXN1; (-) strand; PAM type: NRG; PAM sequence: TGG
agtgtgaactattcactgag

SEQ ID NO: 82145 - DNA, 20 bp, Artificial Sequence
  Description of Artificial Sequence: Synthetic oligonucleotide
  Target: ATXN1; (-) strand; PAM type: NRG; PAM sequence: GAG
gtgagtgtgaactattcact

SEQ ID NO: 82146 - DNA, 20 bp, Artificial Sequence
  Description of Artificial Sequence: Synthetic oligonucleotide
  Target: ATXN1; (-) strand; PAM type: NRG; PAM sequence: GAG
atgataatgatgataacggt

SEQ ID NO: 82147 - DNA, 20 bp, Artificial Sequence
  Description of Artificial Sequence: Synthetic oligonucleotide
  Target: ATXN1; (-) strand; PAM type: NRG; PAM sequence: CGG
tttaatgataatgatgataa

SEQ ID NO: 82148 - DNA, 20 bp, Artificial Sequence
  Description of Artificial Sequence: Synthetic oligonucleotide
  Target: ATXN1; (-) strand; PAM type: NRG; PAM sequence: TAG
gtgggagactgggaggaaga

SEQ ID NO: 82149 - DNA, 20 bp, Artificial Sequence
  Description of Artificial Sequence: Synthetic oligonucleotide
  Target: ATXN1; (-) strand; PAM type: NRG; PAM sequence: AAG
aacagtgggagactgggagg

SEQ ID NO: 82150 - DNA, 20 bp, Artificial Sequence
  Description of Artificial Sequence: Synthetic oligonucleotide
  Target: ATXN1; (-) strand; PAM type: NRG; PAM sequence: AGG
tggaacagtgggagactggg

SEQ ID NO: 82151 - DNA, 20 bp, Artificial Sequence
  Description of Artificial Sequence: Synthetic oligonucleotide
  Target: ATXN1; (-) strand; PAM type: NRG; PAM sequence: GAG
gtggaacagtgggagactgg

SEQ ID NO: 82152 - DNA, 20 bp, Artificial Sequence
  Description of Artificial Sequence: Synthetic oligonucleotide
  Target: ATXN1; (-) strand; PAM type: NRG; PAM sequence: GGG
aggtggaacagtgggagact

SEQ ID NO: 82153 - DNA, 20 bp, Artificial Sequence
  Description of Artificial Sequence: Synthetic oligonucleotide
  Target: ATXN1; (-) strand; PAM type: NRG; PAM sequence: TGG
gaggtggaacagtgggagac

SEQ ID NO: 82154 - DNA, 20 bp, Artificial Sequence
  Description of Artificial Sequence: Synthetic oligonucleotide
  Target: ATXN1; (-) strand; PAM type: NRG; PAM sequence: GAG
tgtgtgaggtggaacagtgg

SEQ ID NO: 82155 - DNA, 20 bp, Artificial Sequence
  Description of Artificial Sequence: Synthetic oligonucleotide
  Target: ATXN1; (-) strand; PAM type: NRG; PAM sequence: GGG
ggtgtgtgaggtggaacagt

SEQ ID NO: 82156 - DNA, 20 bp, Artificial Sequence
  Description of Artificial Sequence: Synthetic oligonucleotide
  Target: ATXN1; (-) strand; PAM type: NRG; PAM sequence: TGG
aggtgtgtgaggtggaacag

SEQ ID NO: 82157 - DNA, 20 bp, Artificial Sequence
  Description of Artificial Sequence: Synthetic oligonucleotide
  Target: ATXN1; (-) strand; PAM type: NRG; PAM sequence: CAG
ttaaggtgtgtgaggtggaa

SEQ ID NO: 82158 - DNA, 20 bp, Artificial Sequence
  Description of Artificial Sequence: Synthetic oligonucleotide
  Target: ATXN1; (-) strand; PAM type: NRG; PAM sequence: TGG
cagggttaaggtgtgtgagg

SEQ ID NO: 82159 - DNA, 20 bp, Artificial Sequence
  Description of Artificial Sequence: Synthetic oligonucleotide
  Target: ATXN1; (-) strand; PAM type: NRG; PAM sequence: AGG
gcccagggttaaggtgtgtg

SEQ ID NO: 82160 - DNA, 20 bp, Artificial Sequence
  Description of Artificial Sequence: Synthetic oligonucleotide
  Target: ATXN1; (-) strand; PAM type: NRG; PAM sequence: GAG
agcccagggttaaggtgtgt

SEQ ID NO: 82161 - DNA, 20 bp, Artificial Sequence
  Description of Artificial Sequence: Synthetic oligonucleotide
  Target: ATXN1; (-) strand; PAM type: NRG; PAM sequence: AGG
ccagtttgagcccagggtta

SEQ ID NO: 82162 - DNA, 20 bp, Artificial Sequence
  Description of Artificial Sequence: Synthetic oligonucleotide
  Target: ATXN1; (-) strand; PAM type: NRG; PAM sequence: AAG
accagtttgagcccagggtt

SEQ ID NO: 82163 - DNA, 20 bp, Artificial Sequence
  Description of Artificial Sequence: Synthetic oligonucleotide
  Target: ATXN1; (-) strand; PAM type: NRG; PAM sequence: GGG
tgtggaccagtttgagccca

SEQ ID NO: 82164 - DNA, 20 bp, Artificial Sequence
  Description of Artificial Sequence: Synthetic oligonucleotide
  Target: ATXN1; (-) strand; PAM type: NRG; PAM sequence: AGG
ctgtggaccagtttgagccc

SEQ ID NO: 82165 - DNA, 20 bp, Artificial Sequence
  Description of Artificial Sequence: Synthetic oligonucleotide
  Target: ATXN1; (-) strand; PAM type: NRG; PAM sequence: CAG
gctgtggaccagtttgagcc

SEQ ID NO: 82166 - DNA, 20 bp, Artificial Sequence
  Description of Artificial Sequence: Synthetic oligonucleotide
  Target: ATXN1; (-) strand; PAM type: NRG; PAM sequence: GAG
ggaaagctgtggaccagttt

SEQ ID NO: 82167 - DNA, 20 bp, Artificial Sequence
  Description of Artificial Sequence: Synthetic oligonucleotide
  Target: ATXN1; (-) strand; PAM type: NRG; PAM sequence: CAG
atttgaggaaagctgtggac

SEQ ID NO: 82168 - DNA, 20 bp, Artificial Sequence
  Description of Artificial Sequence: Synthetic oligonucleotide
  Target: ATXN1; (-) strand; PAM type: NRG; PAM sequence: TGG
agcatatttgaggaaagctg

SEQ ID NO: 82169 - DNA, 20 bp, Artificial Sequence
  Description of Artificial Sequence: Synthetic oligonucleotide
  Target: ATXN1; (-) strand; PAM type: NRG; PAM sequence: AAG
gagcagagcatatttgagga

SEQ ID NO: 82170 - DNA, 20 bp, Artificial Sequence
  Description of Artificial Sequence: Synthetic oligonucleotide
  Target: ATXN1; (-) strand; PAM type: NRG; PAM sequence: AGG
tgcagagcagagcatatttg

SEQ ID NO: 82171 - DNA, 20 bp, Artificial Sequence
  Description of Artificial Sequence: Synthetic oligonucleotide
  Target: ATXN1; (-) strand; PAM type: NRG; PAM sequence: GAG
gtgcagagcagagcatattt

SEQ ID NO: 82172 - DNA, 20 bp, Artificial Sequence
  Description of Artificial Sequence: Synthetic oligonucleotide
  Target: ATXN1; (-) strand; PAM type: NRG; PAM sequence: GAG
agaagggagagtgcagagca

SEQ ID NO: 82173 - DNA, 20 bp, Artificial Sequence
  Description of Artificial Sequence: Synthetic oligonucleotide
  Target: ATXN1; (-) strand; PAM type: NRG; PAM sequence: CAG
ggagaagggagagtgcagag

SEQ ID NO: 82174 - DNA, 20 bp, Artificial Sequence
  Description of Artificial Sequence: Synthetic oligonucleotide
  Target: ATXN1; (-) strand; PAM type: NRG; PAM sequence: GAG
tgtggagaagggagagtgca

SEQ ID NO: 82175 - DNA, 20 bp, Artificial Sequence
  Description of Artificial Sequence: Synthetic oligonucleotide
  Target: ATXN1; (-) strand; PAM type: NRG; PAM sequence: CAG
ggtgtggagaagggagagtg

SEQ ID NO: 82176 - DNA, 20 bp, Artificial Sequence
  Description of Artificial Sequence: Synthetic oligonucleotide
  Target: ATXN1; (-) strand; PAM type: NRG; PAM sequence: GAG
ccaaaggtgtggagaaggga

SEQ ID NO: 82177 - DNA, 20 bp, Artificial Sequence
  Description of Artificial Sequence: Synthetic oligonucleotide
  Target: ATXN1; (-) strand; PAM type: NRG; PAM sequence: GAG
gcccaaaggtgtggagaagg

SEQ ID NO: 82178 - DNA, 20 bp, Artificial Sequence
  Description of Artificial Sequence: Synthetic oligonucleotide
  Target: ATXN1; (-) strand; PAM type: NRG; PAM sequence: GGG
gtgcccaaaggtgtggagaa

SEQ ID NO: 82179 - DNA, 20 bp, Artificial Sequence
  Description of Artificial Sequence: Synthetic oligonucleotide
  Target: ATXN1; (-) strand; PAM type: NRG; PAM sequence: AGG
tgtgcccaaaggtgtggaga

SEQ ID NO: 82180 - DNA, 20 bp, Artificial Sequence
  Description of Artificial Sequence: Synthetic oligonucleotide
  Target: ATXN1; (-) strand; PAM type: NRG; PAM sequence: AAG
gtgtgcccaaaggtgtggag

SEQ ID NO: 82181 - DNA, 20 bp, Artificial Sequence
  Description of Artificial Sequence: Synthetic oligonucleotide
  Target: ATXN1; (-) strand; PAM type: NRG; PAM sequence: GAG
ggcgtgtgcccaaaggtgtg

SEQ ID NO: 82182 - DNA, 20 bp, Artificial Sequence
  Description of Artificial Sequence: Synthetic oligonucleotide
  Target: ATXN1; (-) strand; PAM type: NRG; PAM sequence: TGG
agggcgtgtgcccaaaggtg

SEQ ID NO: 82183 - DNA, 20 bp, Artificial Sequence
  Description of Artificial Sequence: Synthetic oligonucleotide
  Target: ATXN1; (-) strand; PAM type: NRG; PAM sequence: AGG
acgggagggcgtgtgcccaa

SEQ ID NO: 82184 - DNA, 20 bp, Artificial Sequence
  Description of Artificial Sequence: Synthetic oligonucleotide
  Target: ATXN1; (-) strand; PAM type: NRG; PAM sequence: AAG
cacgggagggcgtgtgccca

SEQ ID NO: 82185 - DNA, 20 bp, Artificial Sequence
  Description of Artificial Sequence: Synthetic oligonucleotide
  Target: ATXN1; (-) strand; PAM type: NRG; PAM sequence: GGG
gcaaggcattccacacggga

SEQ ID NO: 82186 - DNA, 20 bp, Artificial Sequence
  Description of Artificial Sequence: Synthetic oligonucleotide
  Target: ATXN1; (-) strand; PAM type: NRG; PAM sequence: AGG
agcaaggcattccacacggg

SEQ ID NO: 82187 - DNA, 20 bp, Artificial Sequence
  Description of Artificial Sequence: Synthetic oligonucleotide
  Target: ATXN1; (-) strand; PAM type: NRG; PAM sequence: GAG
gagcaaggcattccacacgg

SEQ ID NO: 82188 - DNA, 20 bp, Artificial Sequence
  Description of Artificial Sequence: Synthetic oligonucleotide
  Target: ATXN1; (-) strand; PAM type: NRG; PAM sequence: GGG
gggagcaaggcattccacac

SEQ ID NO: 82189 - DNA, 20 bp, Artificial Sequence
  Description of Artificial Sequence: Synthetic oligonucleotide
  Target: ATXN1; (-) strand; PAM type: NRG; PAM sequence: CGG
tgggagcaaggcattccaca

SEQ ID NO: 82190 - DNA, 20 bp, Artificial Sequence
  Description of Artificial Sequence: Synthetic oligonucleotide
  Target: ATXN1; (-) strand; PAM type: NRG; PAM sequence: AGG
acctgacagagctgggagca

SEQ ID NO: 82191 - DNA, 20 bp, Artificial Sequence
  Description of Artificial Sequence: Synthetic oligonucleotide
  Target: ATXN1; (-) strand; PAM type: NRG; PAM sequence: AAG
cacctgacagagctgggagc

SEQ ID NO: 82192 - DNA, 20 bp, Artificial Sequence
  Description of Artificial Sequence: Synthetic oligonucleotide
  Target: ATXN1; (-) strand; PAM type: NRG; PAM sequence: GAG
attccacctgacagagctgg

SEQ ID NO: 82193 - DNA, 20 bp, Artificial Sequence
  Description of Artificial Sequence: Synthetic oligonucleotide
  Target: ATXN1; (-) strand; PAM type: NRG; PAM sequence: GGG
ggattccacctgacagagct

SEQ ID NO: 82194 - DNA, 20 bp, Artificial Sequence
  Description of Artificial Sequence: Synthetic oligonucleotide
  Target: ATXN1; (-) strand; PAM type: NRG; PAM sequence: TGG
aggattccacctgacagagc

SEQ ID NO: 82195 - DNA, 20 bp, Artificial Sequence
  Description of Artificial Sequence: Synthetic oligonucleotide
  Target: ATXN1; (-) strand; PAM type: NRG; PAM sequence: GAG
ggctaggattccacctgaca

SEQ ID NO: 82196 - DNA, 20 bp, Artificial Sequence
  Description of Artificial Sequence: Synthetic oligonucleotide
  Target: ATXN1; (-) strand; PAM type: NRG; PAM sequence: CAG
atggctaggattccacctga

SEQ ID NO: 82197 - DNA, 20 bp, Artificial Sequence
  Description of Artificial Sequence: Synthetic oligonucleotide
  Target: ATXN1; (-) strand; PAM type: NRG; PAM sequence: AGG
gctgacttggaagaatggct

SEQ ID NO: 82198 - DNA, 20 bp, Artificial Sequence
  Description of Artificial Sequence: Synthetic oligonucleotide
  Target: ATXN1; (-) strand; PAM type: NRG; PAM sequence: TAG
agctgacttggaagaatggc

SEQ ID NO: 82199 - DNA, 20 bp, Artificial Sequence
  Description of Artificial Sequence: Synthetic oligonucleotide
  Target: ATXN1; (-) strand; PAM type: NRG; PAM sequence: TGG
tcagagctgacttggaagaa

SEQ ID NO: 82200 - DNA, 20 bp, Artificial Sequence
  Description of Artificial Sequence: Synthetic oligonucleotide
  Target: ATXN1; (-) strand; PAM type: NRG; PAM sequence: AAG
aagcatcagagctgacttgg

SEQ ID NO: 82201 - DNA, 20 bp, Artificial Sequence
  Description of Artificial Sequence: Synthetic oligonucleotide
  Target: ATXN1; (-) strand; PAM type: NRG; PAM sequence: TGG
aggaagcatcagagctgact

SEQ ID NO: 82202 - DNA, 20 bp, Artificial Sequence
  Description of Artificial Sequence: Synthetic oligonucleotide
  Target: ATXN1; (-) strand; PAM type: NRG; PAM sequence: GAG
aggacttggaggaagcatca

SEQ ID NO: 82203 - DNA, 20 bp, Artificial Sequence
  Description of Artificial Sequence: Synthetic oligonucleotide
  Target: ATXN1; (-) strand; PAM type: NRG; PAM sequence: CAG
tgaggacttggaggaagcat

SEQ ID NO: 82204 - DNA, 20 bp, Artificial Sequence
  Description of Artificial Sequence: Synthetic oligonucleotide
  Target: ATXN1; (-) strand; PAM type: NRG; PAM sequence: AAG
gagtggtgaggacttggagg

SEQ ID NO: 82205 - DNA, 20 bp, Artificial Sequence
  Description of Artificial Sequence: Synthetic oligonucleotide
  Target: ATXN1; (-) strand; PAM type: NRG; PAM sequence: AGG
tgggagtggtgaggacttgg

SEQ ID NO: 82206 - DNA, 20 bp, Artificial Sequence
  Description of Artificial Sequence: Synthetic oligonucleotide
  Target: ATXN1; (-) strand; PAM type: NRG; PAM sequence: GAG
ttgggagtggtgaggacttg

SEQ ID NO: 82207 - DNA, 20 bp, Artificial Sequence
  Description of Artificial Sequence: Synthetic oligonucleotide
  Target: ATXN1; (-) strand; PAM type: NRG; PAM sequence: TGG
atttgggagtggtgaggact

SEQ ID NO: 82208 - DNA, 20 bp, Artificial Sequence
  Description of Artificial Sequence: Synthetic oligonucleotide
  Target: ATXN1; (-) strand; PAM type: NRG; PAM sequence: AGG
agtctgatttgggagtggtg

SEQ ID NO: 82209 - DNA, 20 bp, Artificial Sequence
  Description of Artificial Sequence: Synthetic oligonucleotide
  Target: ATXN1; (-) strand; PAM type: NRG; PAM sequence: GAG
tagtctgatttgggagtggt

SEQ ID NO: 82210 - DNA, 20 bp, Artificial Sequence
  Description of Artificial Sequence: Synthetic oligonucleotide
  Target: ATXN1; (-) strand; PAM type: NRG; PAM sequence: TGG
tatttagtctgatttgggag

SEQ ID NO: 82211 - DNA, 20 bp, Artificial Sequence
  Description of Artificial Sequence: Synthetic oligonucleotide
  Target: ATXN1; (-) strand; PAM type: NRG; PAM sequence: GAG
ggatatttagtctgatttgg

SEQ ID NO: 82212 - DNA, 20 bp, Artificial Sequence
  Description of Artificial Sequence: Synthetic oligonucleotide
  Target: ATXN1; (-) strand; PAM type: NRG; PAM sequence: GGG
tgggatatttagtctgattt

SEQ ID NO: 82213 - DNA, 20 bp, Artificial Sequence
  Description of Artificial Sequence: Synthetic oligonucleotide
  Target: ATXN1; (-) strand; PAM type: NRG; PAM sequence: TGG
gtgggatatttagtctgatt

SEQ ID NO: 82214 - DNA, 20 bp, Artificial Sequence
  Description of Artificial Sequence: Synthetic oligonucleotide
  Target: ATXN1; (-) strand; PAM type: NRG; PAM sequence: TAG
acacaaaggagtgggatatt

SEQ ID NO: 82215 - DNA, 20 bp, Artificial Sequence
  Description of Artificial Sequence: Synthetic oligonucleotide
  Target: ATXN1; (-) strand; PAM type: NRG; PAM sequence: GGG
ctgtgggaacacaaaggagt

SEQ ID NO: 82216 - DNA, 20 bp, Artificial Sequence
  Description of Artificial Sequence: Synthetic oligonucleotide
  Target: ATXN1; (-) strand; PAM type: NRG; PAM sequence: TGG
gctgtgggaacacaaaggag

SEQ ID NO: 82217 - DNA, 20 bp, Artificial Sequence
  Description of Artificial Sequence: Synthetic oligonucleotide
  Target: ATXN1; (-) strand; PAM type: NRG; PAM sequence: GAG
aatgctgtgggaacacaaag

SEQ ID NO: 82218 - DNA, 20 bp, Artificial Sequence
  Description of Artificial Sequence: Synthetic oligonucleotide
  Target: ATXN1; (-) strand; PAM type: NRG; PAM sequence: AGG
gcaatgctgtgggaacacaa

SEQ ID NO: 82219 - DNA, 20 bp, Artificial Sequence
  Description of Artificial Sequence: Synthetic oligonucleotide
  Target: ATXN1; (-) strand; PAM type: NRG; PAM sequence: AAG
agcaatgctgtgggaacaca

SEQ ID NO: 82220 - DNA, 20 bp, Artificial Sequence
  Description of Artificial Sequence: Synthetic oligonucleotide
  Target: ATXN1; (-) strand; PAM type: NRG; PAM sequence: GGG
ggaaggcgaagcaatgctgt

SEQ ID NO: 82221 - DNA, 20 bp, Artificial Sequence
  Description of Artificial Sequence: Synthetic oligonucleotide
  Target: ATXN1; (-) strand; PAM type: NRG; PAM sequence: TGG
gggaaggcgaagcaatgctg

SEQ ID NO: 82222 - DNA, 20 bp, Artificial Sequence
  Description of Artificial Sequence: Synthetic oligonucleotide
  Target: ATXN1; (-) strand; PAM type: NRG; PAM sequence: AAG
gaacccagctagggaaggcg

SEQ ID NO: 82223 - DNA, 20 bp, Artificial Sequence
  Description of Artificial Sequence: Synthetic oligonucleotide
  Target: ATXN1; (-) strand; PAM type: NRG; PAM sequence: AGG
taggtgaacccagctaggga

SEQ ID NO: 82224 - DNA, 20 bp, Artificial Sequence
  Description of Artificial Sequence: Synthetic oligonucleotide
  Target: ATXN1; (-) strand; PAM type: NRG; PAM sequence: AAG
gtaggtgaacccagctaggg

SEQ ID NO: 82225 - DNA, 20 bp, Artificial Sequence
  Description of Artificial Sequence: Synthetic oligonucleotide
  Target: ATXN1; (-) strand; PAM type: NRG; PAM sequence: GGG
catgtaggtgaacccagcta

SEQ ID NO: 82226 - DNA, 20 bp, Artificial Sequence
  Description of Artificial Sequence: Synthetic oligonucleotide
  Target: ATXN1; (-) strand; PAM type: NRG; PAM sequence: AGG
acatgtaggtgaacccagct

SEQ ID NO: 82227 - DNA, 20 bp, Artificial Sequence
  Description of Artificial Sequence: Synthetic oligonucleotide
  Target: ATXN1; (-) strand; PAM type: NRG; PAM sequence: TAG
aacatgtaggtgaacccagc

SEQ ID NO: 82228 - DNA, 20 bp, Artificial Sequence
  Description of Artificial Sequence: Synthetic oligonucleotide
  Target: ATXN1; (-) strand; PAM type: NRG; PAM sequence: CAG
gggaaacatgtaggtgaacc

SEQ ID NO: 82229 - DNA, 20 bp, Artificial Sequence
  Description of Artificial Sequence: Synthetic oligonucleotide
  Target: ATXN1; (-) strand; PAM type: NRG; PAM sequence: AGG
cactgttaggggaaacatgt

SEQ ID NO: 82230 - DNA, 20 bp, Artificial Sequence
  Description of Artificial Sequence: Synthetic oligonucleotide
  Target: ATXN1; (-) strand; PAM type: NRG; PAM sequence: TAG
acactgttaggggaaacatg

SEQ ID NO: 82231 - DNA, 20 bp, Artificial Sequence
  Description of Artificial Sequence: Synthetic oligonucleotide
  Target: ATXN1; (-) strand; PAM type: NRG; PAM sequence: GGG
ttaggaatttacactgttag

SEQ ID NO: 82232 - DNA, 20 bp, Artificial Sequence
  Description of Artificial Sequence: Synthetic oligonucleotide
  Target: ATXN1; (-) strand; PAM type: NRG; PAM sequence: GGG
tttaggaatttacactgtta

SEQ ID NO: 82233 - DNA, 20 bp, Artificial Sequence
  Description of Artificial Sequence: Synthetic oligonucleotide
  Target: ATXN1; (-) strand; PAM type: NRG; PAM sequence: AGG
gtttaggaatttacactgtt

SEQ ID NO: 82234 - DNA, 20 bp, Artificial Sequence
  Description of Artificial Sequence: Synthetic oligonucleotide
  Target: ATXN1; (-) strand; PAM type: NRG; PAM sequence: TAG
ggtttaggaatttacactgt

SEQ ID NO: 82235 - DNA, 20 bp, Artificial Sequence
  Description of Artificial Sequence: Synthetic oligonucleotide
  Target: ATXN1; (-) strand; PAM type: NRG; PAM sequence: AGG
ccttcctacaaacttggttt

SEQ ID NO: 82236 - DNA, 20 bp, Artificial Sequence
  Description of Artificial Sequence: Synthetic oligonucleotide
  Target: ATXN1; (-) strand; PAM type: NRG; PAM sequence: TAG
gccttcctacaaacttggtt

SEQ ID NO: 82237 - DNA, 20 bp, Artificial Sequence
  Description of Artificial Sequence: Synthetic oligonucleotide
  Target: ATXN1; (-) strand; PAM type: NRG; PAM sequence: TGG
ttcatgccttcctacaaact

SEQ ID NO: 82238 - DNA, 20 bp, Artificial Sequence
  Description of Artificial Sequence: Synthetic oligonucleotide
  Target: ATXN1; (-) strand; PAM type: NRG; PAM sequence: CAG
agtttgtggtaaaatttttc

SEQ ID NO: 82239 - DNA, 20 bp, Artificial Sequence
  Description of Artificial Sequence: Synthetic oligonucleotide
  Target: ATXN1; (-) strand; PAM type: NRG; PAM sequence: TGG
ttcgttagttactcagtttg

SEQ ID NO: 82240 - DNA, 20 bp, Artificial Sequence
  Description of Artificial Sequence: Synthetic oligonucleotide
  Target: ATXN1; (-) strand; PAM type: NRG; PAM sequence: CAG
atggaatttcgttagttact

SEQ ID NO: 82241 - DNA, 20 bp, Artificial Sequence
  Description of Artificial Sequence: Synthetic oligonucleotide
  Target: ATXN1; (-) strand; PAM type: NRG; PAM sequence: TAG
ccactttcatggaatttcgt

SEQ ID NO: 82242 - DNA, 20 bp, Artificial Sequence
  Description of Artificial Sequence: Synthetic oligonucleotide
  Target: ATXN1; (-) strand; PAM type: NRG; PAM sequence: TGG
ttattatcataccactttca

SEQ ID NO: 82243 - DNA, 20 bp, Artificial Sequence
  Description of Artificial Sequence: Synthetic oligonucleotide
  Target: ATXN1; (-) strand; PAM type: NRG; PAM sequence: TAG
gtaaagctttcaaaaaatgg

SEQ ID NO: 82244 - DNA, 20 bp, Artificial Sequence
  Description of Artificial Sequence: Synthetic oligonucleotide
  Target: ATXN1; (-) strand; PAM type: NRG; PAM sequence: TGG
cacgtaaagctttcaaaaaa

SEQ ID NO: 82245 - DNA, 20 bp, Artificial Sequence
  Description of Artificial Sequence: Synthetic oligonucleotide
  Target: ATXN1; (-) strand; PAM type: NRG; PAM sequence: AAG
aatgagtcttgatgcacgta

SEQ ID NO: 82246 - DNA, 20 bp, Artificial Sequence
  Description of Artificial Sequence: Synthetic oligonucleotide
  Target: ATXN1; (-) strand; PAM type: NRG; PAM sequence: GAG
acaaacaaaaaaacctaaat

SEQ ID NO: 82247 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtgacagagc

SEQ ID NO: 82248 - DNA, 20 bp, Artificial Sequence
  Description of Artificial Sequence: Synthetic oligonucleotide
  Target: ATXN1; (-) strand; PAM type: NRG; PAM sequence: GAG
gcattccagcctgggtgaca

SEQ ID NO: 82249 - DNA, 20 bp, Artificial Sequence
  Description of Artificial Sequence: Synthetic oligonucleotide
  Target: ATXN1; (-) strand; PAM type: NRG; PAM sequence: CAG
ctgcattccagcctgggtga

SEQ ID NO: 82250 - DNA, 20 bp, Artificial Sequence
  Description of Artificial Sequence: Synthetic oligonucleotide
  Target: ATXN1; (-) strand; PAM type: NRG; PAM sequence: GGG
gtgccactgcattccagcct

SEQ ID NO: 82251 - DNA, 20 bp, Artificial Sequence
  Description of Artificial Sequence: Synthetic oligonucleotide
  Target: ATXN1; (-) strand; PAM type: NRG; PAM sequence: TGG
ggtgccactgcattccagcc

SEQ ID NO: 82252 - DNA, 20 bp, Artificial Sequence
  Description of Artificial Sequence: Synthetic oligonucleotide
  Target: ATXN1; (-) strand; PAM type: NRG; PAM sequence: CAG
gagatggtgccactgcattc

SEQ ID NO: 82253 - DNA, 20 bp, Artificial Sequence
  Description of Artificial Sequence: Synthetic oligonucleotide
  Target: ATXN1; (-) strand; PAM type: NRG; PAM sequence: TGG
gaggttgcagtgagccgaga

SEQ ID NO: 82254 - DNA, 20 bp, Artificial Sequence
  Description of Artificial Sequence: Synthetic oligonucleotide
  Target: ATXN1; (-) strand; PAM type: NRG; PAM sequence: GAG
ggtggaggttgcagtgagcc

SEQ ID NO: 82255 - DNA, 20 bp, Artificial Sequence
  Description of Artificial Sequence: Synthetic oligonucleotide
  Target: ATXN1; (-) strand; PAM type: NRG; PAM sequence: GAG
tgggaggtggaggttgcagt

SEQ ID NO: 82256 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggtggaggttg

SEQ ID NO: 82257 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctgggaggtgg

SEQ ID NO: 82258 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaacctgggaggtg

SEQ ID NO: 82259 - DNA, 20 bp, Artificial Sequence
  Description of Artificial Sequence: Synthetic oligonucleotide
  Target: ATXN1; (-) strand; PAM type: NRG; PAM sequence: TGG
aattgcttgaacctgggagg

SEQ ID NO: 82260 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacctggg

SEQ ID NO: 82261 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcttgaacctgg

SEQ ID NO: 82262 - DNA, 20 bp, Artificial Sequence
  Description of Artificial Sequence: Synthetic oligonucleotide
  Target: ATXN1; (-) strand; PAM type: NRG; PAM sequence: GGG
caggagaattgcttgaacct

SEQ ID NO: 82263 - DNA, 20 bp, Artificial Sequence
  Description of Artificial Sequence: Synthetic oligonucleotide
  Target: ATXN1; (-) strand; PAM type: NRG; PAM sequence: TGG
acaggagaattgcttgaacc

SEQ ID NO: 82264 - DNA, 20 bp, Artificial Sequence
  Description of Artificial Sequence: Synthetic oligonucleotide
  Target: ATXN1; (-) strand; PAM type: NRG; PAM sequence: GAG
tacttgggcgtctgagacag

SEQ ID NO: 82265 - DNA, 20 bp, Artificial Sequence
  Description of Artificial Sequence: Synthetic oligonucleotide
  Target: ATXN1; (-) strand; PAM type: NRG; PAM sequence: AGG
gctacttgggcgtctgagac

SEQ ID NO: 82266 - DNA, 20 bp, Artificial Sequence
  Description of Artificial Sequence: Synthetic oligonucleotide
  Target: ATXN1; (-) strand; PAM type: NRG; PAM sequence: CAG
agctacttgggcgtctgaga

SEQ ID NO: 82267 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggcgtct

SEQ ID NO: 82268 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagctactt

SEQ ID NO: 82269 - DNA, 20 bp, Artificial Sequence
  Description of Artificial Sequence: Synthetic oligonucleotide
  Target: ATXN1; (-) strand; PAM type: NRG; PAM sequence: TGG
tgcctgtagtcccagctact

SEQ ID NO: 82270 - DNA, 20 bp, Artificial Sequence
  Description of Artificial Sequence: Synthetic oligonucleotide
  Target: ATXN1; (-) strand; PAM type: NRG; PAM sequence: CAG
gtggcaggtgcctgtagtcc

SEQ ID NO: 82271 - DNA, 20 bp, Artificial Sequence
  Description of Artificial Sequence: Synthetic oligonucleotide
  Target: ATXN1; (-) strand; PAM type: NRG; PAM sequence: TAG
ggcgtggtggcaggtgcctg

SEQ ID NO: 82272 - DNA, 20 bp, Artificial Sequence
  Description of Artificial Sequence: Synthetic oligonucleotide
  Target: ATXN1; (-) strand; PAM type: NRG; PAM sequence: AGG
aattagccgggcgtggtggc

SEQ ID NO: 82273 - DNA, 20 bp, Artificial Sequence
  Description of Artificial Sequence: Synthetic oligonucleotide
  Target: ATXN1; (-) strand; PAM type: NRG; PAM sequence: CAG
aaattagccgggcgtggtgg

SEQ ID NO: 82274 - DNA, 20 bp, Artificial Sequence
  Description of Artificial Sequence: Synthetic oligonucleotide
  Target: ATXN1; (-) strand; PAM type: NRG; PAM sequence: TGG
taaaaattagccgggcgtgg

SEQ ID NO: 82275 - DNA, 20 bp, Artificial Sequence
  Description of Artificial Sequence: Synthetic oligonucleotide
  Target: ATXN1; (-) strand; PAM type: NRG; PAM sequence: TGG
atataaaaattagccgggcg

SEQ ID NO: 82276 - DNA, 20 bp, Artificial Sequence
  Description of Artificial Sequence: Synthetic oligonucleotide
  Target: ATXN1; (-) strand; PAM type: NRG; PAM sequence: GGG
taaaaatataaaaattagcc

SEQ ID NO: 82277 - DNA, 20 bp, Artificial Sequence
  Description of Artificial Sequence: Synthetic oligonucleotide
  Target: ATXN1; (-) strand; PAM type: NRG; PAM sequence: CGG
ctaaaaatataaaaattagc

SEQ ID NO: 82278 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatataaaaat

SEQ ID NO: 82279 - DNA, 20 bp, Artificial Sequence
  Description of Artificial Sequence: Synthetic oligonucleotide
  Target: ATXN1; (-) strand; PAM type: NRG; PAM sequence: TGG
taagaccaccctggccaata

SEQ ID NO: 82280 - DNA, 20 bp, Artificial Sequence
  Description of Artificial Sequence: Synthetic oligonucleotide
  Target: ATXN1; (-) strand; PAM type: NRG; PAM sequence: TGG
gtcaggggttaagaccaccc

SEQ ID NO: 82281 - DNA, 20 bp, Artificial Sequence
  Description of Artificial Sequence: Synthetic oligonucleotide
  Target: ATXN1; (-) strand; PAM type: NRG; PAM sequence: AAG
ggatcacaaggtcaggggtt

SEQ ID NO: 82282 - DNA, 20 bp, Artificial Sequence
  Description of Artificial Sequence: Synthetic oligonucleotide
  Target: ATXN1; (-) strand; PAM type: NRG; PAM sequence: GGG
tgggtggatcacaaggtcag

SEQ ID NO: 82283 - DNA, 20 bp, Artificial Sequence
  Description of Artificial Sequence: Synthetic oligonucleotide
  Target: ATXN1; (-) strand; PAM type: NRG; PAM sequence: GGG
gtgggtggatcacaaggtca

SEQ ID NO: 82284 - DNA, 20 bp, Artificial Sequence
  Description of Artificial Sequence: Synthetic oligonucleotide
  Target: ATXN1; (-) strand; PAM type: NRG; PAM sequence: AGG
ggtgggtggatcacaaggtc

SEQ ID NO: 82285 - DNA, 20 bp, Artificial Sequence
  Description of Artificial Sequence: Synthetic oligonucleotide
  Target: ATXN1; (-) strand; PAM type: NRG; PAM sequence: CAG
tggtgggtggatcacaaggt

SEQ ID NO: 82286 - DNA, 20 bp, Artificial Sequence
  Description of Artificial Sequence: Synthetic oligonucleotide
  Target: ATXN1; (-) strand; PAM type: NRG; PAM sequence: AGG
gccatggtgggtggatcaca

SEQ ID NO: 82287 - DNA, 20 bp, Artificial Sequence
  Description of Artificial Sequence: Synthetic oligonucleotide
  Target: ATXN1; (-) strand; PAM type: NRG; PAM sequence: AAG
ggccatggtgggtggatcac

SEQ ID NO: 82288 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccatggtggg

SEQ ID NO: 82289 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccatggt

SEQ ID NO: 82290 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggccatgg

SEQ ID NO: 82291 - DNA, 20 bp, Artificial Sequence
  Description of Artificial Sequence: Synthetic oligonucleotide
  Target: ATXN1; (-) strand; PAM type: NRG; PAM sequence: TGG
cccagcactttgggaggcca

SEQ ID NO: 82292 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 82293 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 82294 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 82295 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 82296 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 82297 - DNA, 20 bp, Artificial Sequence
  Description of Artificial Sequence: Synthetic oligonucleotide
  Target: ATXN1; (-) strand; PAM type: NRG; PAM sequence: TGG
ataaaacaggccaggcacgg

SEQ ID NO: 82298 - DNA, 20 bp, Artificial Sequence
  Description of Artificial Sequence: Synthetic oligonucleotide
  Target: ATXN1; (-) strand; PAM type: NRG; PAM sequence: CGG
aaaataaaacaggccaggca

SEQ ID NO: 82299 - DNA, 20 bp, Artificial Sequence
  Description of Artificial Sequence: Synthetic oligonucleotide
  Target: ATXN1; (-) strand; PAM type: NRG; PAM sequence: AGG
taagaaaaataaaacaggcc

SEQ ID NO: 82300 - DNA, 20 bp, Artificial Sequence
  Description of Artificial Sequence: Synthetic oligonucleotide
  Target: ATXN1; (-) strand; PAM type: NRG; PAM sequence: CAG
ataagaaaaataaaacaggc

SEQ ID NO: 82301 - DNA, 20 bp, Artificial Sequence
  Description of Artificial Sequence: Synthetic oligonucleotide
  Target: ATXN1; (-) strand; PAM type: NRG; PAM sequence: AGG
tgaaataagaaaaataaaac

SEQ ID NO: 82302 - DNA, 20 bp, Artificial Sequence
  Description of Artificial Sequence: Synthetic oligonucleotide
  Target: ATXN1; (-) strand; PAM type: NRG; PAM sequence: CAG
atgaaataagaaaaataaaa

SEQ ID NO: 82303 - DNA, 20 bp, Artificial Sequence
  Description of Artificial Sequence: Synthetic oligonucleotide
  Target: ATXN1; (-) strand; PAM type: NRG; PAM sequence: AAG
agtttatcaatccatgaaat

SEQ ID NO: 82304 - DNA, 20 bp, Artificial Sequence
  Description of Artificial Sequence: Synthetic oligonucleotide
  Target: ATXN1; (-) strand; PAM type: NRG; PAM sequence: CAG
gacttaatctctttgggtct

SEQ ID NO: 82305 - DNA, 20 bp, Artificial Sequence
  Description of Artificial Sequence: Synthetic oligonucleotide
  Target: ATXN1; (-) strand; PAM type: NRG; PAM sequence: GGG
gcaagtgacttaatctcttt

SEQ ID NO: 82306 - DNA, 20 bp, Artificial Sequence
  Description of Artificial Sequence: Synthetic oligonucleotide
  Target: ATXN1; (-) strand; PAM type: NRG; PAM sequence: TGG
agcaagtgacttaatctctt

SEQ ID NO: 82307 - DNA, 20 bp, Artificial Sequence
  Description of Artificial Sequence: Synthetic oligonucleotide
  Target: ATXN1; (-) strand; PAM type: NRG; PAM sequence: AAG
atggctgtgtaatgttgagc

SEQ ID NO: 82308 - DNA, 20 bp, Artificial Sequence
  Description of Artificial Sequence: Synthetic oligonucleotide
  Target: ATXN1; (-) strand; PAM type: NRG; PAM sequence: GAG
cttaatggctgtgtaatgtt

SEQ ID NO: 82309 - DNA, 20 bp, Artificial Sequence
  Description of Artificial Sequence: Synthetic oligonucleotide
  Target: ATXN1; (-) strand; PAM type: NRG; PAM sequence: TGG
aataccgaacttccacttaa

SEQ ID NO: 82310 - DNA, 20 bp, Artificial Sequence
  Description of Artificial Sequence: Synthetic oligonucleotide
  Target: ATXN1; (-) strand; PAM type: NRG; PAM sequence: GGG
gttcttgaggcaaacttcct

SEQ ID NO: 82311 - DNA, 20 bp, Artificial Sequence
  Description of Artificial Sequence: Synthetic oligonucleotide
  Target: ATXN1; (-) strand; PAM type: NRG; PAM sequence: TGG
ggttcttgaggcaaacttcc

SEQ ID NO: 82312 - DNA, 20 bp, Artificial Sequence
  Description of Artificial Sequence: Synthetic oligonucleotide
  Target: ATXN1; (-) strand; PAM type: NRG; PAM sequence: AGG
ttgaaaagtgtaggttcttg

SEQ ID NO: 82313 - DNA, 20 bp, Artificial Sequence
  Description of Artificial Sequence: Synthetic oligonucleotide
  Target: ATXN1; (-) strand; PAM type: NRG; PAM sequence: GAG
gttgaaaagtgtaggttctt

SEQ ID NO: 82314 - DNA, 20 bp, Artificial Sequence
  Description of Artificial Sequence: Synthetic oligonucleotide
  Target: ATXN1; (-) strand; PAM type: NRG; PAM sequence: AGG
tatgatgtgttgaaaagtgt

SEQ ID NO: 82315 - DNA, 20 bp, Artificial Sequence
  Description of Artificial Sequence: Synthetic oligonucleotide
  Target: ATXN1; (-) strand; PAM type: NRG; PAM sequence: TAG
gtatgatgtgttgaaaagtg

SEQ ID NO: 82316 - DNA, 20 bp, Artificial Sequence
  Description of Artificial Sequence: Synthetic oligonucleotide
  Target: ATXN1; (-) strand; PAM type: NRG; PAM sequence: AAG
aaacagtatgatgtgttgaa

SEQ ID NO: 82317 - DNA, 20 bp, Artificial Sequence
  Description of Artificial Sequence: Synthetic oligonucleotide
  Target: ATXN1; (-) strand; PAM type: NRG; PAM sequence: CAG
gttataatgctgctgagaaa

SEQ ID NO: 82318 - DNA, 20 bp, Artificial Sequence
  Description of Artificial Sequence: Synthetic oligonucleotide
  Target: ATXN1; (-) strand; PAM type: NRG; PAM sequence: GAG
taaatagttataatgctgct

SEQ ID NO: 82319 - DNA, 20 bp, Artificial Sequence
  Description of Artificial Sequence: Synthetic oligonucleotide
  Target: ATXN1; (-) strand; PAM type: NRG; PAM sequence: TAG
cttaggtagttcacaataaa

SEQ ID NO: 82320 - DNA, 20 bp, Artificial Sequence
  Description of Artificial Sequence: Synthetic oligonucleotide
  Target: ATXN1; (-) strand; PAM type: NRG; PAM sequence: TAG
ccaccatatgttttcttagg

SEQ ID NO: 82321 - DNA, 20 bp, Artificial Sequence
  Description of Artificial Sequence: Synthetic oligonucleotide
  Target: ATXN1; (-) strand; PAM type: NRG; PAM sequence: AGG
cagccaccatatgttttctt

SEQ ID NO: 82322 - DNA, 20 bp, Artificial Sequence
  Description of Artificial Sequence: Synthetic oligonucleotide
  Target: ATXN1; (-) strand; PAM type: NRG; PAM sequence: TAG
acagccaccatatgttttct

SEQ ID NO: 82323 - DNA, 20 bp, Artificial Sequence
  Description of Artificial Sequence: Synthetic oligonucleotide
  Target: ATXN1; (-) strand; PAM type: NRG; PAM sequence: CAG
agccctgagacaactgatta

SEQ ID NO: 82324 - DNA, 20 bp, Artificial Sequence
  Description of Artificial Sequence: Synthetic oligonucleotide
  Target: ATXN1; (-) strand; PAM type: NRG; PAM sequence: GAG
aagatttaaaatctagccct

SEQ ID NO: 82325 - DNA, 20 bp, Artificial Sequence
  Description of Artificial Sequence: Synthetic oligonucleotide
  Target: ATXN1; (-) strand; PAM type: NRG; PAM sequence: TAG
gatctcaaagatttaaaatc

SEQ ID NO: 82326 - DNA, 20 bp, Artificial Sequence
  Description of Artificial Sequence: Synthetic oligonucleotide
  Target: ATXN1; (-) strand; PAM type: NRG; PAM sequence: AAG
tattcaatccccagatctca

SEQ ID NO: 82327 - DNA, 20 bp, Artificial Sequence
  Description of Artificial Sequence: Synthetic oligonucleotide
  Target: ATXN1; (-) strand; PAM type: NRG; PAM sequence: CAG
tgtgctgtatattcaatccc

SEQ ID NO: 82328 - DNA, 20 bp, Artificial Sequence
  Description of Artificial Sequence: Synthetic oligonucleotide
  Target: ATXN1; (-) strand; PAM type: NRG; PAM sequence: TAG
acaaatatcattattaacca

SEQ ID NO: 82329 - DNA, 20 bp, Artificial Sequence
  Description of Artificial Sequence: Synthetic oligonucleotide
  Target: ATXN1; (-) strand; PAM type: NRG; PAM sequence: AAG
ttactgtctcagcaaatttc

SEQ ID NO: 82330 - DNA, 20 bp, Artificial Sequence
  Description of Artificial Sequence: Synthetic oligonucleotide
  Target: ATXN1; (-) strand; PAM type: NRG; PAM sequence: CAG
acatttaagatttactgtct

SEQ ID NO: 82331 - DNA, 20 bp, Artificial Sequence
  Description of Artificial Sequence: Synthetic oligonucleotide
  Target: ATXN1; (-) strand; PAM type: NRG; PAM sequence: AAG
cttgcatggtgagaacattt

SEQ ID NO: 82332 - DNA, 20 bp, Artificial Sequence
  Description of Artificial Sequence: Synthetic oligonucleotide
  Target: ATXN1; (-) strand; PAM type: NRG; PAM sequence: GAG
gttattttttcttgcatggt

SEQ ID NO: 82333 - DNA, 20 bp, Artificial Sequence
  Description of Artificial Sequence: Synthetic oligonucleotide
  Target: ATXN1; (-) strand; PAM type: NRG; PAM sequence: TGG
catagttattttttcttgca

SEQ ID NO: 82334 - DNA, 20 bp, Artificial Sequence
  Description of Artificial Sequence: Synthetic oligonucleotide
  Target: ATXN1; (-) strand; PAM type: NRG; PAM sequence: TAG
aacactttcatcacctcaca

SEQ ID NO: 82335 - DNA, 20 bp, Artificial Sequence
  Description of Artificial Sequence: Synthetic oligonucleotide
  Target: ATXN1; (-) strand; PAM type: NRG; PAM sequence: TAG
aatgtttattatcatcaagt

SEQ ID NO: 82336 - DNA, 20 bp, Artificial Sequence
  Description of Artificial Sequence: Synthetic oligonucleotide
  Target: ATXN1; (-) strand; PAM type: NRG; PAM sequence: AAG
gtgaaatgtttattatcatc

SEQ ID NO: 82337 - DNA, 20 bp, Artificial Sequence
  Description of Artificial Sequence: Synthetic oligonucleotide
  Target: ATXN1; (-) strand; PAM type: NRG; PAM sequence: GAG
tttatttttccagcattatt

SEQ ID NO: 82338 - DNA, 20 bp, Artificial Sequence
  Description of Artificial Sequence: Synthetic oligonucleotide
  Target: ATXN1; (-) strand; PAM type: NRG; PAM sequence: CAG
ccggccttattttatttttc

SEQ ID NO: 82339 - DNA, 20 bp, Artificial Sequence
  Description of Artificial Sequence: Synthetic oligonucleotide
  Target: ATXN1; (-) strand; PAM type: NRG; PAM sequence: CGG
caggcgtgagccactgcgcc

SEQ ID NO: 82340 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 82341 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 82342 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 82343 - DNA, 20 bp, Artificial Sequence
  Description of Artificial Sequence: Synthetic oligonucleotide
  Target: ATXN1; (-) strand; PAM type: NRG; PAM sequence: GGG
tctcagcctcccaaagtgct

SEQ ID NO: 82344 - DNA, 20 bp, Artificial Sequence
  Description of Artificial Sequence: Synthetic oligonucleotide
  Target: ATXN1; (-) strand; PAM type: NRG; PAM sequence: TGG
gtctcagcctcccaaagtgc

SEQ ID NO: 82345 - DNA, 20 bp, Artificial Sequence
  Description of Artificial Sequence: Synthetic oligonucleotide
  Target: ATXN1; (-) strand; PAM type: NRG; PAM sequence: AAG
ccacccgtctcagcctccca

SEQ ID NO: 82346 - DNA, 20 bp, Artificial Sequence
  Description of Artificial Sequence: Synthetic oligonucleotide
  Target: ATXN1; (-) strand; PAM type: NRG; PAM sequence: CAG
ctcagatgatccacccgtct

SEQ ID NO: 82347 - DNA, 20 bp, Artificial Sequence
  Description of Artificial Sequence: Synthetic oligonucleotide
  Target: ATXN1; (-) strand; PAM type: NRG; PAM sequence: CAG
tggcctcaaactcctgacct

SEQ ID NO: 82348 - DNA, 20 bp, Artificial Sequence
  Description of Artificial Sequence: Synthetic oligonucleotide
  Target: ATXN1; (-) strand; PAM type: NRG; PAM sequence: TGG
tctcaccgtattggccagga

SEQ ID NO: 82349 - DNA, 20 bp, Artificial Sequence
  Description of Artificial Sequence: Synthetic oligonucleotide
  Target: ATXN1; (-) strand; PAM type: NRG; PAM sequence: AGG
ggggtctcaccgtattggcc

SEQ ID NO: 82350 - DNA, 20 bp, Artificial Sequence
  Description of Artificial Sequence: Synthetic oligonucleotide
  Target: ATXN1; (-) strand; PAM type: NRG; PAM sequence: CAG
gggggtctcaccgtattggc

SEQ ID NO: 82351 - DNA, 20 bp, Artificial Sequence
  Description of Artificial Sequence: Synthetic oligonucleotide
  Target: ATXN1; (-) strand; PAM type: NRG; PAM sequence: TGG
gagagggggtctcaccgtat

SEQ ID NO: 82352 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagagg

SEQ ID NO: 82353 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagag

SEQ ID NO: 82354 - DNA, 20 bp, Artificial Sequence
  Description of Artificial Sequence: Synthetic oligonucleotide
  Target: ATXN1; (-) strand; PAM type: NRG; PAM sequence: GGG
ttttgtatttttagtagaga

SEQ ID NO: 82355 - DNA, 20 bp, Artificial Sequence
  Description of Artificial Sequence: Synthetic oligonucleotide
  Target: ATXN1; (-) strand; PAM type: NRG; PAM sequence: AGG
tttttgtatttttagtagag

SEQ ID NO: 82356 - DNA, 20 bp, Artificial Sequence
  Description of Artificial Sequence: Synthetic oligonucleotide
  Target: ATXN1; (-) strand; PAM type: NRG; PAM sequence: GAG
atttttgtatttttagtaga

SEQ ID NO: 82357 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 82358 - DNA, 20 bp, Artificial Sequence
  Description of Artificial Sequence: Synthetic oligonucleotide
  Target: ATXN1; (-) strand; PAM type: NRG; PAM sequence: TAG
gataatttttgtatttttag

SEQ ID NO: 82359 - DNA, 20 bp, Artificial Sequence
  Description of Artificial Sequence: Synthetic oligonucleotide
  Target: ATXN1; (-) strand; PAM type: NRG; PAM sequence: TAG
ccagataatttttgtatttt

SEQ ID NO: 82360 - DNA, 20 bp, Artificial Sequence
  Description of Artificial Sequence: Synthetic oligonucleotide
  Target: ATXN1; (-) strand; PAM type: NRG; PAM sequence: CAG
caggcacctgccactacacc

SEQ ID NO: 82361 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 82362 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 82363 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 82364 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 82365 - DNA, 20 bp, Artificial Sequence
  Description of Artificial Sequence: Synthetic oligonucleotide
  Target: ATXN1; (-) strand; PAM type: NRG; PAM sequence: TAG
ttctgcctcagcctcccaag

SEQ ID NO: 82366 - DNA, 20 bp, Artificial Sequence
  Description of Artificial Sequence: Synthetic oligonucleotide
  Target: ATXN1; (-) strand; PAM type: NRG; PAM sequence: AAG
atcttctgcctcagcctccc

SEQ ID NO: 82367 - DNA, 20 bp, Artificial Sequence
  Description of Artificial Sequence: Synthetic oligonucleotide
  Target: ATXN1; (-) strand; PAM type: NRG; PAM sequence: CAG
gttcaagagatcttctgcct

SEQ ID NO: 82368 - DNA, 20 bp, Artificial Sequence
  Description of Artificial Sequence: Synthetic oligonucleotide
  Target: ATXN1; (-) strand; PAM type: NRG; PAM sequence: GAG
cctccgcctcctgggttcaa

SEQ ID NO: 82369 - DNA, 20 bp, Artificial Sequence
  Description of Artificial Sequence: Synthetic oligonucleotide
  Target: ATXN1; (-) strand; PAM type: NRG; PAM sequence: AAG
agcctccgcctcctgggttc

SEQ ID NO: 82370 - DNA, 20 bp, Artificial Sequence
  Description of Artificial Sequence: Synthetic oligonucleotide
  Target: ATXN1; (-) strand; PAM type: NRG; PAM sequence: GGG
cactgcagcctccgcctcct

SEQ ID NO: 82371 - DNA, 20 bp, Artificial Sequence
  Description of Artificial Sequence: Synthetic oligonucleotide
  Target: ATXN1; (-) strand; PAM type: NRG; PAM sequence: TGG
tcactgcagcctccgcctcc

SEQ ID NO: 82372 - DNA, 20 bp, Artificial Sequence
  Description of Artificial Sequence: Synthetic oligonucleotide
  Target: ATXN1; (-) strand; PAM type: NRG; PAM sequence: CAG
agcgcaatttcggctcactg

SEQ ID NO: 82373 - DNA, 20 bp, Artificial Sequence
  Description of Artificial Sequence: Synthetic oligonucleotide
  Target: ATXN1; (-) strand; PAM type: NRG; PAM sequence: CGG
ggagtgcaatagcgcaattt

SEQ ID NO: 82374 - DNA, 20 bp, Artificial Sequence
  Description of Artificial Sequence: Synthetic oligonucleotide
  Target: ATXN1; (-) strand; PAM type: NRG; PAM sequence: TAG
ttgcccaggctggagtgcaa

SEQ ID NO: 82375 - DNA, 20 bp, Artificial Sequence
  Description of Artificial Sequence: Synthetic oligonucleotide
  Target: ATXN1; (-) strand; PAM type: NRG; PAM sequence: GAG
cgttcttgttgcccaggctg

SEQ ID NO: 82376 - DNA, 20 bp, Artificial Sequence
  Description of Artificial Sequence: Synthetic oligonucleotide
  Target: ATXN1; (-) strand; PAM type: NRG; PAM sequence: TGG
ttcgttcttgttgcccaggc

SEQ ID NO: 82377 - DNA, 20 bp, Artificial Sequence
  Description of Artificial Sequence: Synthetic oligonucleotide
  Target: ATXN1; (-) strand; PAM type: NRG; PAM sequence: AGG
gagtttcgttcttgttgccc

SEQ ID NO: 82378 - DNA, 20 bp, Artificial Sequence
  Description of Artificial Sequence: Synthetic oligonucleotide
  Target: ATXN1; (-) strand; PAM type: NRG; PAM sequence: CAG
ggagtttcgttcttgttgcc

SEQ ID NO: 82379 - DNA, 20 bp, Artificial Sequence
  Description of Artificial Sequence: Synthetic oligonucleotide
  Target: ATXN1; (-) strand; PAM type: NRG; PAM sequence: GAG
tttattttgtttttgagatg

SEQ ID NO: 82380 - DNA, 20 bp, Artificial Sequence
  Description of Artificial Sequence: Synthetic oligonucleotide
  Target: ATXN1; (-) strand; PAM type: NRG; PAM sequence: TGG
attttattttgtttttgaga

SEQ ID NO: 82381 - DNA, 20 bp, Artificial Sequence
  Description of Artificial Sequence: Synthetic oligonucleotide
  Target: ATXN1; (-) strand; PAM type: NRG; PAM sequence: GAG
ttttattttattttgttttt

SEQ ID NO: 82382 - DNA, 20 bp, Artificial Sequence
  Description of Artificial Sequence: Synthetic oligonucleotide
  Target: ATXN1; (-) strand; PAM type: NRG; PAM sequence: AAG
gagtaccttgatggatccca

SEQ ID NO: 82383 - DNA, 20 bp, Artificial Sequence
  Description of Artificial Sequence: Synthetic oligonucleotide
  Target: ATXN1; (-) strand; PAM type: NRG; PAM sequence: TGG
tacagaccagagtaccttga

SEQ ID NO: 82384 - DNA, 20 bp, Artificial Sequence
  Description of Artificial Sequence: Synthetic oligonucleotide
  Target: ATXN1; (-) strand; PAM type: NRG; PAM sequence: GAG
aaggatctacatacagacca

SEQ ID NO: 82385 - DNA, 20 bp, Artificial Sequence
  Description of Artificial Sequence: Synthetic oligonucleotide
  Target: ATXN1; (-) strand; PAM type: NRG; PAM sequence: CAG
ttaaggatctacatacagac

SEQ ID NO: 82386 - DNA, 20 bp, Artificial Sequence
  Description of Artificial Sequence: Synthetic oligonucleotide
  Target: ATXN1; (-) strand; PAM type: NRG; PAM sequence: CAG
aaatcttaaggatctacata

SEQ ID NO: 82387 - DNA, 20 bp, Artificial Sequence
  Description of Artificial Sequence: Synthetic oligonucleotide
  Target: ATXN1; (-) strand; PAM type: NRG; PAM sequence: AGG
gaactagtcctgaaatctta

SEQ ID NO: 82388 - DNA, 20 bp, Artificial Sequence
  Description of Artificial Sequence: Synthetic oligonucleotide
  Target: ATXN1; (-) strand; PAM type: NRG; PAM sequence: AAG
tgaactagtcctgaaatctt

SEQ ID NO: 82389 - DNA, 20 bp, Artificial Sequence
  Description of Artificial Sequence: Synthetic oligonucleotide
  Target: ATXN1; (-) strand; PAM type: NRG; PAM sequence: TAG
gatataaaagagaagtgaac

SEQ ID NO: 82390 - DNA, 20 bp, Artificial Sequence
  Description of Artificial Sequence: Synthetic oligonucleotide
  Target: ATXN1; (-) strand; PAM type: NRG; PAM sequence: AAG
tgaggaaggatataaaagag

SEQ ID NO: 82391 - DNA, 20 bp, Artificial Sequence
  Description of Artificial Sequence: Synthetic oligonucleotide
  Target: ATXN1; (-) strand; PAM type: NRG; PAM sequence: GAG
caatgaggaaggatataaaa

SEQ ID NO: 82392 - DNA, 20 bp, Artificial Sequence
  Description of Artificial Sequence: Synthetic oligonucleotide
  Target: ATXN1; (-) strand; PAM type: NRG; PAM sequence: AAG
ttcaatgaggaaggatataa

SEQ ID NO: 82393 - DNA, 20 bp, Artificial Sequence
  Description of Artificial Sequence: Synthetic oligonucleotide
  Target: ATXN1; (-) strand; PAM type: NRG; PAM sequence: AGG
aatagtagcttcaatgagga

SEQ ID NO: 82394 - DNA, 20 bp, Artificial Sequence
  Description of Artificial Sequence: Synthetic oligonucleotide
  Target: ATXN1; (-) strand; PAM type: NRG; PAM sequence: AAG
caatagtagcttcaatgagg

SEQ ID NO: 82395 - DNA, 20 bp, Artificial Sequence
  Description of Artificial Sequence: Synthetic oligonucleotide
  Target: ATXN1; (-) strand; PAM type: NRG; PAM sequence: AGG
aagcaatagtagcttcaatg

SEQ ID NO: 82396 - DNA, 20 bp, Artificial Sequence
  Description of Artificial Sequence: Synthetic oligonucleotide
  Target: ATXN1; (-) strand; PAM type: NRG; PAM sequence: GAG
taagcaatagtagcttcaat

SEQ ID NO: 82397 - DNA, 20 bp, Artificial Sequence
  Description of Artificial Sequence: Synthetic oligonucleotide
  Target: ATXN1; (-) strand; PAM type: NRG; PAM sequence: TAG
gaagtgtctgtaagcaatag

SEQ ID NO: 82398 - DNA, 20 bp, Artificial Sequence
  Description of Artificial Sequence: Synthetic oligonucleotide
  Target: ATXN1; (-) strand; PAM type: NRG; PAM sequence: TAG
aaggaagtgtctgtaagcaa

SEQ ID NO: 82399 - DNA, 20 bp, Artificial Sequence
  Description of Artificial Sequence: Synthetic oligonucleotide
  Target: ATXN1; (-) strand; PAM type: NRG; PAM sequence: AAG
gcaggaaaggaagtgtctgt

SEQ ID NO: 82400 - DNA, 20 bp, Artificial Sequence
  Description of Artificial Sequence: Synthetic oligonucleotide
  Target: ATXN1; (-) strand; PAM type: NRG; PAM sequence: AAG
gttggctgtagcaggaaagg

SEQ ID NO: 82401 - DNA, 20 bp, Artificial Sequence
  Description of Artificial Sequence: Synthetic oligonucleotide
  Target: ATXN1; (-) strand; PAM type: NRG; PAM sequence: AGG
agtgttggctgtagcaggaa

SEQ ID NO: 82402 - DNA, 20 bp, Artificial Sequence
  Description of Artificial Sequence: Synthetic oligonucleotide
  Target: ATXN1; (-) strand; PAM type: NRG; PAM sequence: AAG
tagtgttggctgtagcagga

SEQ ID NO: 82403 - DNA, 20 bp, Artificial Sequence
  Description of Artificial Sequence: Synthetic oligonucleotide
  Target: ATXN1; (-) strand; PAM type: NRG; PAM sequence: AGG
tgcctagtgttggctgtagc

SEQ ID NO: 82404 - DNA, 20 bp, Artificial Sequence
  Description of Artificial Sequence: Synthetic oligonucleotide
  Target: ATXN1; (-) strand; PAM type: NRG; PAM sequence: CAG
ttgcctagtgttggctgtag

SEQ ID NO: 82405 - DNA, 20 bp, Artificial Sequence
  Description of Artificial Sequence: Synthetic oligonucleotide
  Target: ATXN1; (-) strand; PAM type: NRG; PAM sequence: TAG
aggttgcctagtgttggctg

SEQ ID NO: 82406 - DNA, 20 bp, Artificial Sequence
  Description of Artificial Sequence: Synthetic oligonucleotide
  Target: ATXN1; (-) strand; PAM type: NRG; PAM sequence: TGG
tctccaaggttgcctagtgt

SEQ ID NO: 82407 - DNA, 20 bp, Artificial Sequence
  Description of Artificial Sequence: Synthetic oligonucleotide
  Target: ATXN1; (-) strand; PAM type: NRG; PAM sequence: TAG
gtaccctctccaaggttgcc

SEQ ID NO: 82408 - DNA, 20 bp, Artificial Sequence
  Description of Artificial Sequence: Synthetic oligonucleotide
  Target: ATXN1; (-) strand; PAM type: NRG; PAM sequence: AGG
ttgtggctgtaccctctcca

SEQ ID NO: 82409 - DNA, 20 bp, Artificial Sequence
  Description of Artificial Sequence: Synthetic oligonucleotide
  Target: ATXN1; (-) strand; PAM type: NRG; PAM sequence: AAG
attgtggctgtaccctctcc

SEQ ID NO: 82410 - DNA, 20 bp, Artificial Sequence
  Description of Artificial Sequence: Synthetic oligonucleotide
  Target: ATXN1; (-) strand; PAM type: NRG; PAM sequence: TGG
gggtccatgtggtgatattg

SEQ ID NO: 82411 - DNA, 20 bp, Artificial Sequence
  Description of Artificial Sequence: Synthetic oligonucleotide
  Target: ATXN1; (-) strand; PAM type: NRG; PAM sequence: TGG
actgtatgtgtgggtccatg

SEQ ID NO: 82412 - DNA, 20 bp, Artificial Sequence
  Description of Artificial Sequence: Synthetic oligonucleotide
  Target: ATXN1; (-) strand; PAM type: NRG; PAM sequence: GGG
cctctgcagactgtatgtgt

SEQ ID NO: 82413 - DNA, 20 bp, Artificial Sequence
  Description of Artificial Sequence: Synthetic oligonucleotide
  Target: ATXN1; (-) strand; PAM type: NRG; PAM sequence: TGG
ccctctgcagactgtatgtg

SEQ ID NO: 82414 - DNA, 20 bp, Artificial Sequence
  Description of Artificial Sequence: Synthetic oligonucleotide
  Target: ATXN1; (-) strand; PAM type: NRG; PAM sequence: CAG
ttatgttgaactgccctctg

SEQ ID NO: 82415 - DNA, 20 bp, Artificial Sequence
  Description of Artificial Sequence: Synthetic oligonucleotide
  Target: ATXN1; (-) strand; PAM type: NRG; PAM sequence: AGG
aaggtgcctctcaatatagt

SEQ ID NO: 82416 - DNA, 20 bp, Artificial Sequence
  Description of Artificial Sequence: Synthetic oligonucleotide
  Target: ATXN1; (-) strand; PAM type: NRG; PAM sequence: TAG
taaggtgcctctcaatatag

SEQ ID NO: 82417 - DNA, 20 bp, Artificial Sequence
  Description of Artificial Sequence: Synthetic oligonucleotide
  Target: ATXN1; (-) strand; PAM type: NRG; PAM sequence: TAG
acctaaggtgcctctcaata

SEQ ID NO: 82418 - DNA, 20 bp, Artificial Sequence
  Description of Artificial Sequence: Synthetic oligonucleotide
  Target: ATXN1; (-) strand; PAM type: NRG; PAM sequence: AGG
acgcttttcattacaaccta

SEQ ID NO: 82419 - DNA, 20 bp, Artificial Sequence
  Description of Artificial Sequence: Synthetic oligonucleotide
  Target: ATXN1; (-) strand; PAM type: NRG; PAM sequence: AAG
gacgcttttcattacaacct

SEQ ID NO: 82420 - DNA, 20 bp, Artificial Sequence
  Description of Artificial Sequence: Synthetic oligonucleotide
  Target: ATXN1; (-) strand; PAM type: NRG; PAM sequence: TAG
caaaaactcaggaaggcaat

SEQ ID NO: 82421 - DNA, 20 bp, Artificial Sequence
  Description of Artificial Sequence: Synthetic oligonucleotide
  Target: ATXN1; (-) strand; PAM type: NRG; PAM sequence: AGG
ctagtgacaaaaactcagga

SEQ ID NO: 82422 - DNA, 20 bp, Artificial Sequence
  Description of Artificial Sequence: Synthetic oligonucleotide
  Target: ATXN1; (-) strand; PAM type: NRG; PAM sequence: AAG
cctagtgacaaaaactcagg

SEQ ID NO: 82423 - DNA, 20 bp, Artificial Sequence
  Description of Artificial Sequence: Synthetic oligonucleotide
  Target: ATXN1; (-) strand; PAM type: NRG; PAM sequence: AGG
gtacctagtgacaaaaactc

SEQ ID NO: 82424 - DNA, 20 bp, Artificial Sequence
  Description of Artificial Sequence: Synthetic oligonucleotide
  Target: ATXN1; (-) strand; PAM type: NRG; PAM sequence: CAG
agtacctagtgacaaaaact

SEQ ID NO: 82425 - DNA, 20 bp, Artificial Sequence
  Description of Artificial Sequence: Synthetic oligonucleotide
  Target: ATXN1; (-) strand; PAM type: NRG; PAM sequence: TAG
tcagaagcatcctaagtacc

SEQ ID NO: 82426 - DNA, 20 bp, Artificial Sequence
  Description of Artificial Sequence: Synthetic oligonucleotide
  Target: ATXN1; (-) strand; PAM type: NRG; PAM sequence: AAG
ccagggctcagaagcatcct

SEQ ID NO: 82427 - DNA, 20 bp, Artificial Sequence
  Description of Artificial Sequence: Synthetic oligonucleotide
  Target: ATXN1; (-) strand; PAM type: NRG; PAM sequence: AAG
tcatgagagccagggctcag

SEQ ID NO: 82428 - DNA, 20 bp, Artificial Sequence
  Description of Artificial Sequence: Synthetic oligonucleotide
  Target: ATXN1; (-) strand; PAM type: NRG; PAM sequence: CAG
ctttcatgagagccagggct

SEQ ID NO: 82429 - DNA, 20 bp, Artificial Sequence
  Description of Artificial Sequence: Synthetic oligonucleotide
  Target: ATXN1; (-) strand; PAM type: NRG; PAM sequence: GGG
ttgcactttcatgagagcca

SEQ ID NO: 82430 - DNA, 20 bp, Artificial Sequence
  Description of Artificial Sequence: Synthetic oligonucleotide
  Target: ATXN1; (-) strand; PAM type: NRG; PAM sequence: AGG
gttgcactttcatgagagcc

SEQ ID NO: 82431 - DNA, 20 bp, Artificial Sequence
  Description of Artificial Sequence: Synthetic oligonucleotide
  Target: ATXN1; (-) strand; PAM type: NRG; PAM sequence: CAG
tgttgcactttcatgagagc

SEQ ID NO: 82432 - DNA, 20 bp, Artificial Sequence
  Description of Artificial Sequence: Synthetic oligonucleotide
  Target: ATXN1; (-) strand; PAM type: NRG; PAM sequence: GAG
attttgttgcactttcatga

SEQ ID NO: 82433 - DNA, 20 bp, Artificial Sequence
  Description of Artificial Sequence: Synthetic oligonucleotide
  Target: ATXN1; (-) strand; PAM type: NRG; PAM sequence: GAG
atattttgttgcactttcat

SEQ ID NO: 82434 - DNA, 20 bp, Artificial Sequence
  Description of Artificial Sequence: Synthetic oligonucleotide
  Target: ATXN1; (-) strand; PAM type: NRG; PAM sequence: AGG
gttacagttcattcatcagg

SEQ ID NO: 82435 - DNA, 20 bp, Artificial Sequence
  Description of Artificial Sequence: Synthetic oligonucleotide
  Target: ATXN1; (-) strand; PAM type: NRG; PAM sequence: GAG
tgttacagttcattcatcag

SEQ ID NO: 82436 - DNA, 20 bp, Artificial Sequence
  Description of Artificial Sequence: Synthetic oligonucleotide
  Target: ATXN1; (-) strand; PAM type: NRG; PAM sequence: AGG
actgttacagttcattcatc

SEQ ID NO: 82437 - DNA, 20 bp, Artificial Sequence
  Description of Artificial Sequence: Synthetic oligonucleotide
  Target: ATXN1; (-) strand; PAM type: NRG; PAM sequence: CAG
gactgttacagttcattcat

SEQ ID NO: 82438 - DNA, 20 bp, Artificial Sequence
  Description of Artificial Sequence: Synthetic oligonucleotide
  Target: ATXN1; (-) strand; PAM type: NRG; PAM sequence: CAG
aacttttttggtgactgtta

SEQ ID NO: 82439 - DNA, 20 bp, Artificial Sequence
  Description of Artificial Sequence: Synthetic oligonucleotide
  Target: ATXN1; (-) strand; PAM type: NRG; PAM sequence: TGG
catggggttgcaaacttttt

SEQ ID NO: 82440 - DNA, 20 bp, Artificial Sequence
  Description of Artificial Sequence: Synthetic oligonucleotide
  Target: ATXN1; (-) strand; PAM type: NRG; PAM sequence: GGG
attctgttgcactagccatg

SEQ ID NO: 82441 - DNA, 20 bp, Artificial Sequence
  Description of Artificial Sequence: Synthetic oligonucleotide
  Target: ATXN1; (-) strand; PAM type: NRG; PAM sequence: GGG
tattctgttgcactagccat

SEQ ID NO: 82442 - DNA, 20 bp, Artificial Sequence
  Description of Artificial Sequence: Synthetic oligonucleotide
  Target: ATXN1; (-) strand; PAM type: NRG; PAM sequence: TGG
ctattctgttgcactagcca

SEQ ID NO: 82443 - DNA, 20 bp, Artificial Sequence
  Description of Artificial Sequence: Synthetic oligonucleotide
  Target: ATXN1; (-) strand; PAM type: NRG; PAM sequence: TAG
ctttagctattctgttgcac

SEQ ID NO: 82444 - DNA, 20 bp, Artificial Sequence
  Description of Artificial Sequence: Synthetic oligonucleotide
  Target: ATXN1; (-) strand; PAM type: NRG; PAM sequence: TAG
gcagactcccagtttccctt

SEQ ID NO: 82445 - DNA, 20 bp, Artificial Sequence
  Description of Artificial Sequence: Synthetic oligonucleotide
  Target: ATXN1; (-) strand; PAM type: NRG; PAM sequence: CAG
aaggtgaatgtgcagactcc

SEQ ID NO: 82446 - DNA, 20 bp, Artificial Sequence
  Description of Artificial Sequence: Synthetic oligonucleotide
  Target: ATXN1; (-) strand; PAM type: NRG; PAM sequence: CAG
ccatggctaaggtgaatgtg

SEQ ID NO: 82447 - DNA, 20 bp, Artificial Sequence
  Description of Artificial Sequence: Synthetic oligonucleotide
  Target: ATXN1; (-) strand; PAM type: NRG; PAM sequence: AGG
catgaaatataccatggcta

SEQ ID NO: 82448 - DNA, 20 bp, Artificial Sequence
  Description of Artificial Sequence: Synthetic oligonucleotide
  Target: ATXN1; (-) strand; PAM type: NRG; PAM sequence: AAG
tcatgaaatataccatggct

SEQ ID NO: 82449 - DNA, 20 bp, Artificial Sequence
  Description of Artificial Sequence: Synthetic oligonucleotide
  Target: ATXN1; (-) strand; PAM type: NRG; PAM sequence: TGG
atccatcatgaaatatacca

SEQ ID NO: 82450 - DNA, 20 bp, Artificial Sequence
  Description of Artificial Sequence: Synthetic oligonucleotide
  Target: ATXN1; (-) strand; PAM type: NRG; PAM sequence: AAG
ctgacccttcagctgtttac

SEQ ID NO: 82451 - DNA, 20 bp, Artificial Sequence
  Description of Artificial Sequence: Synthetic oligonucleotide
  Target: ATXN1; (-) strand; PAM type: NRG; PAM sequence: CAG
catttaaaaacctgaccctt

SEQ ID NO: 82452 - DNA, 20 bp, Artificial Sequence
  Description of Artificial Sequence: Synthetic oligonucleotide
  Target: ATXN1; (-) strand; PAM type: NRG; PAM sequence: TAG
ttttgcagagtaaagaacct

SEQ ID NO: 82453 - DNA, 20 bp, Artificial Sequence
  Description of Artificial Sequence: Synthetic oligonucleotide
  Target: ATXN1; (-) strand; PAM type: NRG; PAM sequence: AAG
cttgtctgttttgcagagta

SEQ ID NO: 82454 - DNA, 20 bp, Artificial Sequence
  Description of Artificial Sequence: Synthetic oligonucleotide
  Target: ATXN1; (-) strand; PAM type: NRG; PAM sequence: GAG
tgatccttgtctgttttgca

SEQ ID NO: 82455 - DNA, 20 bp, Artificial Sequence
  Description of Artificial Sequence: Synthetic oligonucleotide
  Target: ATXN1; (-) strand; PAM type: NRG; PAM sequence: CAG
gttgatccttgtctgttttg

SEQ ID NO: 82456 - DNA, 20 bp, Artificial Sequence
  Description of Artificial Sequence: Synthetic oligonucleotide
  Target: ATXN1; (-) strand; PAM type: NRG; PAM sequence: AAG
cattttttagcatttcatgt

SEQ ID NO: 82457 - DNA, 20 bp, Artificial Sequence
  Description of Artificial Sequence: Synthetic oligonucleotide
  Target: ATXN1; (-) strand; PAM type: NRG; PAM sequence: TAG
taaatacccacatcattttt

SEQ ID NO: 82458 - DNA, 20 bp, Artificial Sequence
  Description of Artificial Sequence: Synthetic oligonucleotide
  Target: ATXN1; (-) strand; PAM type: NRG; PAM sequence: TGG
tttattgattgaccactgat

SEQ ID NO: 82459 - DNA, 20 bp, Artificial Sequence
  Description of Artificial Sequence: Synthetic oligonucleotide
  Target: ATXN1; (-) strand; PAM type: NRG; PAM sequence: CAG
taactaattaagaaattagt

SEQ ID NO: 82460 - DNA, 20 bp, Artificial Sequence
  Description of Artificial Sequence: Synthetic oligonucleotide
  Target: ATXN1; (-) strand; PAM type: NRG; PAM sequence: TAG
ggattaactaattaagaaat

SEQ ID NO: 82461 - DNA, 20 bp, Artificial Sequence
  Description of Artificial Sequence: Synthetic oligonucleotide
  Target: ATXN1; (-) strand; PAM type: NRG; PAM sequence: AAG
tgtcactggattaactaatt

SEQ ID NO: 82462 - DNA, 20 bp, Artificial Sequence
  Description of Artificial Sequence: Synthetic oligonucleotide
  Target: ATXN1; (-) strand; PAM type: NRG; PAM sequence: TGG
gccaaaaggtgaactgtcac

SEQ ID NO: 82463 - DNA, 20 bp, Artificial Sequence
  Description of Artificial Sequence: Synthetic oligonucleotide
  Target: ATXN1; (-) strand; PAM type: NRG; PAM sequence: AGG
gtttataaagtcatgccaaa

SEQ ID NO: 82464 - DNA, 20 bp, Artificial Sequence
  Description of Artificial Sequence: Synthetic oligonucleotide
  Target: ATXN1; (-) strand; PAM type: NRG; PAM sequence: AAG
tgtttataaagtcatgccaa

SEQ ID NO: 82465 - DNA, 20 bp, Artificial Sequence
  Description of Artificial Sequence: Synthetic oligonucleotide
  Target: ATXN1; (-) strand; PAM type: NRG; PAM sequence: AAG
cttcagttttcttgtttata

SEQ ID NO: 82466 - DNA, 20 bp, Artificial Sequence
  Description of Artificial Sequence: Synthetic oligonucleotide
  Target: ATXN1; (-) strand; PAM type: NRG; PAM sequence: CAG
tgatagccttgcccagcctt

SEQ ID NO: 82467 - DNA, 20 bp, Artificial Sequence
  Description of Artificial Sequence: Synthetic oligonucleotide
  Target: ATXN1; (-) strand; PAM type: NRG; PAM sequence: CAG
ttttgcatgatagccttgcc

SEQ ID NO: 82468 - DNA, 20 bp, Artificial Sequence
  Description of Artificial Sequence: Synthetic oligonucleotide
  Target: ATXN1; (-) strand; PAM type: NRG; PAM sequence: TAG
ttgtcattttttttgcatga

SEQ ID NO: 82469 - DNA, 20 bp, Artificial Sequence
  Description of Artificial Sequence: Synthetic oligonucleotide
  Target: ATXN1; (-) strand; PAM type: NRG; PAM sequence: GAG
gtaatggggaatttcagttt

SEQ ID NO: 82470 - DNA, 20 bp, Artificial Sequence
  Description of Artificial Sequence: Synthetic oligonucleotide
  Target: ATXN1; (-) strand; PAM type: NRG; PAM sequence: CAG
taagttgtaatggggaattt

SEQ ID NO: 82471 - DNA, 20 bp, Artificial Sequence
  Description of Artificial Sequence: Synthetic oligonucleotide
  Target: ATXN1; (-) strand; PAM type: NRG; PAM sequence: GGG
agagtcaataagttgtaatg

SEQ ID NO: 82472 - DNA, 20 bp, Artificial Sequence
  Description of Artificial Sequence: Synthetic oligonucleotide
  Target: ATXN1; (-) strand; PAM type: NRG; PAM sequence: GGG
tagagtcaataagttgtaat

SEQ ID NO: 82473 - DNA, 20 bp, Artificial Sequence
  Description of Artificial Sequence: Synthetic oligonucleotide
  Target: ATXN1; (-) strand; PAM type: NRG; PAM sequence: TGG
ttagagtcaataagttgtaa

SEQ ID NO: 82474 - DNA, 20 bp, Artificial Sequence
  Description of Artificial Sequence: Synthetic oligonucleotide
  Target: ATXN1; (-) strand; PAM type: NRG; PAM sequence: AAG
attaatgctttagagtcaat

SEQ ID NO: 82475 - DNA, 20 bp, Artificial Sequence
  Description of Artificial Sequence: Synthetic oligonucleotide
  Target: ATXN1; (-) strand; PAM type: NRG; PAM sequence: GAG
tttttcctattaatgcttta

SEQ ID NO: 82476 - DNA, 20 bp, Artificial Sequence
  Description of Artificial Sequence: Synthetic oligonucleotide
  Target: ATXN1; (-) strand; PAM type: NRG; PAM sequence: TAG
gttttttcctattaatgctt

SEQ ID NO: 82477 - DNA, 20 bp, Artificial Sequence
  Description of Artificial Sequence: Synthetic oligonucleotide
  Target: ATXN1; (-) strand; PAM type: NRG; PAM sequence: GAG
gtatatacatatataaaata

SEQ ID NO: 82478 - DNA, 20 bp, Artificial Sequence
  Description of Artificial Sequence: Synthetic oligonucleotide
  Target: ATXN1; (-) strand; PAM type: NRG; PAM sequence: TAG
gtgtatatacatatataaaa

SEQ ID NO: 82479 - DNA, 20 bp, Artificial Sequence
  Description of Artificial Sequence: Synthetic oligonucleotide
  Target: ATXN1; (-) strand; PAM type: NRG; PAM sequence: AAG
ataatattttgatatcgggg

SEQ ID NO: 82480 - DNA, 20 bp, Artificial Sequence
  Description of Artificial Sequence: Synthetic oligonucleotide
  Target: ATXN1; (-) strand; PAM type: NRG; PAM sequence: GGG
aaaataatattttgatatcg

SEQ ID NO: 82481 - DNA, 20 bp, Artificial Sequence
  Description of Artificial Sequence: Synthetic oligonucleotide
  Target: ATXN1; (-) strand; PAM type: NRG; PAM sequence: GGG
taaaataatattttgatatc

SEQ ID NO: 82482 - DNA, 20 bp, Artificial Sequence
  Description of Artificial Sequence: Synthetic oligonucleotide
  Target: ATXN1; (-) strand; PAM type: NRG; PAM sequence: CGG
ttaaaataatattttgatat

SEQ ID NO: 82483 - DNA, 20 bp, Artificial Sequence
  Description of Artificial Sequence: Synthetic oligonucleotide
  Target: ATXN1; (-) strand; PAM type: NRG; PAM sequence: AGG
tttatgaaggctagtgtgtg

SEQ ID NO: 82484 - DNA, 20 bp, Artificial Sequence
  Description of Artificial Sequence: Synthetic oligonucleotide
  Target: ATXN1; (-) strand; PAM type: NRG; PAM sequence: GAG
ttttatgaaggctagtgtgt

SEQ ID NO: 82485 - DNA, 20 bp, Artificial Sequence
  Description of Artificial Sequence: Synthetic oligonucleotide
  Target: ATXN1; (-) strand; PAM type: NRG; PAM sequence: TAG
gaatggaattttatgaaggc

SEQ ID NO: 82486 - DNA, 20 bp, Artificial Sequence
  Description of Artificial Sequence: Synthetic oligonucleotide
  Target: ATXN1; (-) strand; PAM type: NRG; PAM sequence: AGG
ttcagaatggaattttatga

SEQ ID NO: 82487 - DNA, 20 bp, Artificial Sequence
  Description of Artificial Sequence: Synthetic oligonucleotide
  Target: ATXN1; (-) strand; PAM type: NRG; PAM sequence: AAG
attcagaatggaattttatg

SEQ ID NO: 82488 - DNA, 20 bp, Artificial Sequence
  Description of Artificial Sequence: Synthetic oligonucleotide
  Target: ATXN1; (-) strand; PAM type: NRG; PAM sequence: TGG
gtgtgacaaggaattcagaa

SEQ ID NO: 82489 - DNA, 20 bp, Artificial Sequence
  Description of Artificial Sequence: Synthetic oligonucleotide
  Target: ATXN1; (-) strand; PAM type: NRG; PAM sequence: CAG
tgtacgtgtgacaaggaatt

SEQ ID NO: 82490 - DNA, 20 bp, Artificial Sequence
  Description of Artificial Sequence: Synthetic oligonucleotide
  Target: ATXN1; (-) strand; PAM type: NRG; PAM sequence: AGG
catcatttgtacgtgtgaca

SEQ ID NO: 82491 - DNA, 20 bp, Artificial Sequence
  Description of Artificial Sequence: Synthetic oligonucleotide
  Target: ATXN1; (-) strand; PAM type: NRG; PAM sequence: AAG
tcatcatttgtacgtgtgac

SEQ ID NO: 82492 - DNA, 20 bp, Artificial Sequence
  Description of Artificial Sequence: Synthetic oligonucleotide
  Target: ATXN1; (-) strand; PAM type: NRG; PAM sequence: AAG
atgtcaaaaacaccactaaa

SEQ ID NO: 82493 - DNA, 20 bp, Artificial Sequence
  Description of Artificial Sequence: Synthetic oligonucleotide
  Target: ATXN1; (-) strand; PAM type: NRG; PAM sequence: AGG
ttctttccaaaggaaggaat

SEQ ID NO: 82494 - DNA, 20 bp, Artificial Sequence
  Description of Artificial Sequence: Synthetic oligonucleotide
  Target: ATXN1; (-) strand; PAM type: NRG; PAM sequence: TAG
gttctttccaaaggaaggaa

SEQ ID NO: 82495 - DNA, 20 bp, Artificial Sequence
  Description of Artificial Sequence: Synthetic oligonucleotide
  Target: ATXN1; (-) strand; PAM type: NRG; PAM sequence: AGG
caaaagttctttccaaagga

SEQ ID NO: 82496 - DNA, 20 bp, Artificial Sequence
  Description of Artificial Sequence: Synthetic oligonucleotide
  Target: ATXN1; (-) strand; PAM type: NRG; PAM sequence: AAG
tcaaaagttctttccaaagg

SEQ ID NO: 82497 - DNA, 20 bp, Artificial Sequence
  Description of Artificial Sequence: Synthetic oligonucleotide
  Target: ATXN1; (-) strand; PAM type: NRG; PAM sequence: AGG
tcctcaaaagttctttccaa

SEQ ID NO: 82498 - DNA, 20 bp, Artificial Sequence
  Description of Artificial Sequence: Synthetic oligonucleotide
  Target: ATXN1; (-) strand; PAM type: NRG; PAM sequence: AAG
ctcctcaaaagttctttcca

SEQ ID NO: 82499 - DNA, 20 bp, Artificial Sequence
  Description of Artificial Sequence: Synthetic oligonucleotide
  Target: ATXN1; (-) strand; PAM type: NRG; PAM sequence: AAG
aaattaattcggctcctcaa

SEQ ID NO: 82500 - DNA, 20 bp, Artificial Sequence
  Description of Artificial Sequence: Synthetic oligonucleotide
  Target: ATXN1; (-) strand; PAM type: NRG; PAM sequence: CGG
agtcatctccaaaattaatt

SEQ ID NO: 82501 - DNA, 20 bp, Artificial Sequence
  Description of Artificial Sequence: Synthetic oligonucleotide
  Target: ATXN1; (-) strand; PAM type: NRG; PAM sequence: AAG
cttggcttaaataaaatgaa

SEQ ID NO: 82502 - DNA, 20 bp, Artificial Sequence
  Description of Artificial Sequence: Synthetic oligonucleotide
  Target: ATXN1; (-) strand; PAM type: NRG; PAM sequence: TGG
caaaagagaaaaaaataact

SEQ ID NO: 82503 - DNA, 20 bp, Artificial Sequence
  Description of Artificial Sequence: Synthetic oligonucleotide
  Target: ATXN1; (-) strand; PAM type: NRG; PAM sequence: GAG
gtttggctaaaataccaaaa

SEQ ID NO: 82504 - DNA, 20 bp, Artificial Sequence
  Description of Artificial Sequence: Synthetic oligonucleotide
  Target: ATXN1; (-) strand; PAM type: NRG; PAM sequence: AAG
ctgtttggctaaaataccaa

SEQ ID NO: 82505 - DNA, 20 bp, Artificial Sequence
  Description of Artificial Sequence: Synthetic oligonucleotide
  Target: ATXN1; (-) strand; PAM type: NRG; PAM sequence: TGG
tcatttctaagaattctgtt

SEQ ID NO: 82506 - DNA, 20 bp, Artificial Sequence
  Description of Artificial Sequence: Synthetic oligonucleotide
  Target: ATXN1; (-) strand; PAM type: NRG; PAM sequence: AAG
ctattttttttttcatttct

SEQ ID NO: 82507 - DNA, 20 bp, Artificial Sequence
  Description of Artificial Sequence: Synthetic oligonucleotide
  Target: ATXN1; (-) strand; PAM type: NRG; PAM sequence: AGG
ctgaaaggctactctgctct

SEQ ID NO: 82508 - DNA, 20 bp, Artificial Sequence
  Description of Artificial Sequence: Synthetic oligonucleotide
  Target: ATXN1; (-) strand; PAM type: NRG; PAM sequence: TAG
tctgaaaggctactctgctc

SEQ ID NO: 82509 - DNA, 20 bp, Artificial Sequence
  Description of Artificial Sequence: Synthetic oligonucleotide
  Target: ATXN1; (-) strand; PAM type: NRG; PAM sequence: AGG
gtaacattttcaattctgaa

SEQ ID NO: 82510 - DNA, 20 bp, Artificial Sequence
  Description of Artificial Sequence: Synthetic oligonucleotide
  Target: ATXN1; (-) strand; PAM type: NRG; PAM sequence: AAG
tgtaacattttcaattctga

SEQ ID NO: 82511 - DNA, 20 bp, Artificial Sequence
  Description of Artificial Sequence: Synthetic oligonucleotide
  Target: ATXN1; (-) strand; PAM type: NRG; PAM sequence: GGG
aaagactgggtaacattaaa

SEQ ID NO: 82512 - DNA, 20 bp, Artificial Sequence
  Description of Artificial Sequence: Synthetic oligonucleotide
  Target: ATXN1; (-) strand; PAM type: NRG; PAM sequence: AGG
aaaagactgggtaacattaa

SEQ ID NO: 82513 - DNA, 20 bp, Artificial Sequence
  Description of Artificial Sequence: Synthetic oligonucleotide
  Target: ATXN1; (-) strand; PAM type: NRG; PAM sequence: AAG
aaaaagactgggtaacatta

SEQ ID NO: 82514 - DNA, 20 bp, Artificial Sequence
  Description of Artificial Sequence: Synthetic oligonucleotide
  Target: ATXN1; (-) strand; PAM type: NRG; PAM sequence: GGG
taagggaatttaaaaagact

SEQ ID NO: 82515 - DNA, 20 bp, Artificial Sequence
  Description of Artificial Sequence: Synthetic oligonucleotide
  Target: ATXN1; (-) strand; PAM type: NRG; PAM sequence: TGG
ttaagggaatttaaaaagac

SEQ ID NO: 82516 - DNA, 20 bp, Artificial Sequence
  Description of Artificial Sequence: Synthetic oligonucleotide
  Target: ATXN1; (-) strand; PAM type: NRG; PAM sequence: AAG
ttttcttaagggaatttaaa

SEQ ID NO: 82517 - DNA, 20 bp, Artificial Sequence
  Description of Artificial Sequence: Synthetic oligonucleotide
  Target: ATXN1; (-) strand; PAM type: NRG; PAM sequence: GGG
atctggtatttttttcttaa

SEQ ID NO: 82518 - DNA, 20 bp, Artificial Sequence
  Description of Artificial Sequence: Synthetic oligonucleotide
  Target: ATXN1; (-) strand; PAM type: NRG; PAM sequence: AGG
tatctggtatttttttctta

SEQ ID NO: 82519 - DNA, 20 bp, Artificial Sequence
  Description of Artificial Sequence: Synthetic oligonucleotide
  Target: ATXN1; (-) strand; PAM type: NRG; PAM sequence: AAG
atatctggtatttttttctt

SEQ ID NO: 82520 - DNA, 20 bp, Artificial Sequence
  Description of Artificial Sequence: Synthetic oligonucleotide
  Target: ATXN1; (-) strand; PAM type: NRG; PAM sequence: TGG
ggccacattttgtgaatatc

SEQ ID NO: 82521 - DNA, 20 bp, Artificial Sequence
  Description of Artificial Sequence: Synthetic oligonucleotide
  Target: ATXN1; (-) strand; PAM type: NRG; PAM sequence: TGG
ataaatgacacatccagttc

SEQ ID NO: 82522 - DNA, 20 bp, Artificial Sequence
  Description of Artificial Sequence: Synthetic oligonucleotide
  Target: ATXN1; (-) strand; PAM type: NRG; PAM sequence: CAG
atccaaataaatgacacatc

SEQ ID NO: 82523 - DNA, 20 bp, Artificial Sequence
  Description of Artificial Sequence: Synthetic oligonucleotide
  Target: ATXN1; (-) strand; PAM type: NRG; PAM sequence: CAG
cataaccatgtcggccaaat

SEQ ID NO: 82524 - DNA, 20 bp, Artificial Sequence
  Description of Artificial Sequence: Synthetic oligonucleotide
  Target: ATXN1; (-) strand; PAM type: NRG; PAM sequence: CGG
tatgtcatgcataaccatgt

SEQ ID NO: 82525 - DNA, 20 bp, Artificial Sequence
  Description of Artificial Sequence: Synthetic oligonucleotide
  Target: ATXN1; (-) strand; PAM type: NRG; PAM sequence: AAG
cactgtaagccatatttatg

SEQ ID NO: 82526 - DNA, 20 bp, Artificial Sequence
  Description of Artificial Sequence: Synthetic oligonucleotide
  Target: ATXN1; (-) strand; PAM type: NRG; PAM sequence: AAG
aattgcttcagcttcactgt

SEQ ID NO: 82527 - DNA, 20 bp, Artificial Sequence
  Description of Artificial Sequence: Synthetic oligonucleotide
  Target: ATXN1; (-) strand; PAM type: NRG; PAM sequence: CAG
aacatcagatagaattgctt

SEQ ID NO: 82528 - DNA, 20 bp, Artificial Sequence
  Description of Artificial Sequence: Synthetic oligonucleotide
  Target: ATXN1; (-) strand; PAM type: NRG; PAM sequence: TAG
tagaaaattctaacatcaga

SEQ ID NO: 82529 - DNA, 20 bp, Artificial Sequence
  Description of Artificial Sequence: Synthetic oligonucleotide
  Target: ATXN1; (-) strand; PAM type: NRG; PAM sequence: CAG
gcattagaaaattctaacat

SEQ ID NO: 82530 - DNA, 20 bp, Artificial Sequence
  Description of Artificial Sequence: Synthetic oligonucleotide
  Target: ATXN1; (-) strand; PAM type: NRG; PAM sequence: TAG
ctggcgtatatctttggcat

SEQ ID NO: 82531 - DNA, 20 bp, Artificial Sequence
  Description of Artificial Sequence: Synthetic oligonucleotide
  Target: ATXN1; (-) strand; PAM type: NRG; PAM sequence: TGG
aaactactggcgtatatctt

SEQ ID NO: 82532 - DNA, 20 bp, Artificial Sequence
  Description of Artificial Sequence: Synthetic oligonucleotide
  Target: ATXN1; (-) strand; PAM type: NRG; PAM sequence: TGG
catcatttaaactaaactac

SEQ ID NO: 82533 - DNA, 20 bp, Artificial Sequence
  Description of Artificial Sequence: Synthetic oligonucleotide
  Target: ATXN1; (-) strand; PAM type: NRG; PAM sequence: CAG
tttacagtaatagttggatt

SEQ ID NO: 82534 - DNA, 20 bp, Artificial Sequence
  Description of Artificial Sequence: Synthetic oligonucleotide
  Target: ATXN1; (-) strand; PAM type: NRG; PAM sequence: TGG
acagtttttacagtaatagt

SEQ ID NO: 82535 - DNA, 20 bp, Artificial Sequence
  Description of Artificial Sequence: Synthetic oligonucleotide
  Target: ATXN1; (-) strand; PAM type: NRG; PAM sequence: TAG
ttaaacagtttttacagtaa

SEQ ID NO: 82536 - DNA, 20 bp, Artificial Sequence
  Description of Artificial Sequence: Synthetic oligonucleotide
  Target: ATXN1; (-) strand; PAM type: NRG; PAM sequence: CAG
ttttggttaaacagttttta

SEQ ID NO: 82537 - DNA, 20 bp, Artificial Sequence
  Description of Artificial Sequence: Synthetic oligonucleotide
  Target: ATXN1; (-) strand; PAM type: NRG; PAM sequence: CAG
aatagatgtttttggttaaa

SEQ ID NO: 82538 - DNA, 20 bp, Artificial Sequence
  Description of Artificial Sequence: Synthetic oligonucleotide
  Target: ATXN1; (-) strand; PAM type: NRG; PAM sequence: TGG
attacaaaaatagatgtttt

SEQ ID NO: 82539 - DNA, 20 bp, Artificial Sequence
  Description of Artificial Sequence: Synthetic oligonucleotide
  Target: ATXN1; (-) strand; PAM type: NRG; PAM sequence: TAG
tttcataaaaattacaaaaa

SEQ ID NO: 82540 - DNA, 20 bp, Artificial Sequence
  Description of Artificial Sequence: Synthetic oligonucleotide
  Target: ATXN1; (-) strand; PAM type: NRG; PAM sequence: TAG
aaaatgtttttggataagct

SEQ ID NO: 82541 - DNA, 20 bp, Artificial Sequence
  Description of Artificial Sequence: Synthetic oligonucleotide
  Target: ATXN1; (-) strand; PAM type: NRG; PAM sequence: AAG
tattaaaaatgtttttggat

SEQ ID NO: 82542 - DNA, 20 bp, Artificial Sequence
  Description of Artificial Sequence: Synthetic oligonucleotide
  Target: ATXN1; (-) strand; PAM type: NRG; PAM sequence: TGG
taagatattaaaaatgtttt

SEQ ID NO: 82543 - DNA, 20 bp, Artificial Sequence
  Description of Artificial Sequence: Synthetic oligonucleotide
  Target: ATXN1; (-) strand; PAM type: NRG; PAM sequence: AAG
acagaaataatccttcaggt

SEQ ID NO: 82544 - DNA, 20 bp, Artificial Sequence
  Description of Artificial Sequence: Synthetic oligonucleotide
  Target: ATXN1; (-) strand; PAM type: NRG; PAM sequence: AGG
aaatacagaaataatccttc

SEQ ID NO: 82545 - DNA, 20 bp, Artificial Sequence
  Description of Artificial Sequence: Synthetic oligonucleotide
  Target: ATXN1; (-) strand; PAM type: NRG; PAM sequence: CAG
gaaatacagaaataatcctt

SEQ ID NO: 82546 - DNA, 20 bp, Artificial Sequence
  Description of Artificial Sequence: Synthetic oligonucleotide
  Target: ATXN1; (-) strand; PAM type: NRG; PAM sequence: CAG
aaagagcccatttagaaata

SEQ ID NO: 82547 - DNA, 20 bp, Artificial Sequence
  Description of Artificial Sequence: Synthetic oligonucleotide
  Target: ATXN1; (-) strand; PAM type: NRG; PAM sequence: TAG
aagaaaggaaagagcccatt

SEQ ID NO: 82548 - DNA, 20 bp, Artificial Sequence
  Description of Artificial Sequence: Synthetic oligonucleotide
  Target: ATXN1; (-) strand; PAM type: NRG; PAM sequence: GAG
aaaggtaagaagaaaggaaa

SEQ ID NO: 82549 - DNA, 20 bp, Artificial Sequence
  Description of Artificial Sequence: Synthetic oligonucleotide
  Target: ATXN1; (-) strand; PAM type: NRG; PAM sequence: AAG
acaaaggtaagaagaaagga

SEQ ID NO: 82550 - DNA, 20 bp, Artificial Sequence
  Description of Artificial Sequence: Synthetic oligonucleotide
  Target: ATXN1; (-) strand; PAM type: NRG; PAM sequence: AGG
atttacaaaggtaagaagaa

SEQ ID NO: 82551 - DNA, 20 bp, Artificial Sequence
  Description of Artificial Sequence: Synthetic oligonucleotide
  Target: ATXN1; (-) strand; PAM type: NRG; PAM sequence: AAG
tatttacaaaggtaagaaga

SEQ ID NO: 82552 - DNA, 20 bp, Artificial Sequence
  Description of Artificial Sequence: Synthetic oligonucleotide
  Target: ATXN1; (-) strand; PAM type: NRG; PAM sequence: AAG
taaatatttacaaaggtaag

SEQ ID NO: 82553 - DNA, 20 bp, Artificial Sequence
  Description of Artificial Sequence: Synthetic oligonucleotide
  Target: ATXN1; (-) strand; PAM type: NRG; PAM sequence: AAG
taataaatatttacaaaggt

SEQ ID NO: 82554 - DNA, 20 bp, Artificial Sequence
  Description of Artificial Sequence: Synthetic oligonucleotide
  Target: ATXN1; (-) strand; PAM type: NRG; PAM sequence: AGG
agtttaataaatatttacaa

SEQ ID NO: 82555 - DNA, 20 bp, Artificial Sequence
  Description of Artificial Sequence: Synthetic oligonucleotide
  Target: ATXN1; (-) strand; PAM type: NRG; PAM sequence: AAG
cagtttaataaatatttaca

SEQ ID NO: 82556 - DNA, 20 bp, Artificial Sequence
  Description of Artificial Sequence: Synthetic oligonucleotide
  Target: ATXN1; (-) strand; PAM type: NRG; PAM sequence: CAG
gcccattcctgcatataata

SEQ ID NO: 82557 - DNA, 20 bp, Artificial Sequence
  Description of Artificial Sequence: Synthetic oligonucleotide
  Target: ATXN1; (-) strand; PAM type: NRG; PAM sequence: AAG
aaccttgtattccaagtgtt

SEQ ID NO: 82558 - DNA, 20 bp, Artificial Sequence
  Description of Artificial Sequence: Synthetic oligonucleotide
  Target: ATXN1; (-) strand; PAM type: NRG; PAM sequence: AAG
tatcttaaaccttgtattcc

SEQ ID NO: 82559 - DNA, 20 bp, Artificial Sequence
  Description of Artificial Sequence: Synthetic oligonucleotide
  Target: ATXN1; (-) strand; PAM type: NRG; PAM sequence: CAG
tggtaaatgattcatgaaga

SEQ ID NO: 82560 - DNA, 20 bp, Artificial Sequence
  Description of Artificial Sequence: Synthetic oligonucleotide
  Target: ATXN1; (-) strand; PAM type: NRG; PAM sequence: AAG
atcttggtaaatgattcatg

SEQ ID NO: 82561 - DNA, 20 bp, Artificial Sequence
  Description of Artificial Sequence: Synthetic oligonucleotide
  Target: ATXN1; (-) strand; PAM type: NRG; PAM sequence: TGG
ttctgctcatatagctatct

SEQ ID NO: 82562 - DNA, 20 bp, Artificial Sequence
  Description of Artificial Sequence: Synthetic oligonucleotide
  Target: ATXN1; (-) strand; PAM type: NRG; PAM sequence: TAG
attgcaattttctgctcata

SEQ ID NO: 82563 - DNA, 20 bp, Artificial Sequence
  Description of Artificial Sequence: Synthetic oligonucleotide
  Target: ATXN1; (-) strand; PAM type: NRG; PAM sequence: CAG
aaggaaaaaaaaaaacaaaa

SEQ ID NO: 82564 - DNA, 20 bp, Artificial Sequence
  Description of Artificial Sequence: Synthetic oligonucleotide
  Target: ATXN1; (-) strand; PAM type: NRG; PAM sequence: AGG
cagatagagagctcgtctca

SEQ ID NO: 82565 - DNA, 20 bp, Artificial Sequence
  Description of Artificial Sequence: Synthetic oligonucleotide
  Target: ATXN1; (-) strand; PAM type: NRG; PAM sequence: AAG
acagatagagagctcgtctc

SEQ ID NO: 82566 - DNA, 20 bp, Artificial Sequence
  Description of Artificial Sequence: Synthetic oligonucleotide
  Target: ATXN1; (-) strand; PAM type: NRG; PAM sequence: GAG
cagcctgggcaacagataga

SEQ ID NO: 82567 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcaacagata

SEQ ID NO: 82568 - DNA, 20 bp, Artificial Sequence
  Description of Artificial Sequence: Synthetic oligonucleotide
  Target: ATXN1; (-) strand; PAM type: NRG; PAM sequence: TAG
actccagcctgggcaacaga

SEQ ID NO: 82569 - DNA, 20 bp, Artificial Sequence
  Description of Artificial Sequence: Synthetic oligonucleotide
  Target: ATXN1; (-) strand; PAM type: NRG; PAM sequence: CAG
ttccactccagcctgggcaa

SEQ ID NO: 82570 - DNA, 20 bp, Artificial Sequence
  Description of Artificial Sequence: Synthetic oligonucleotide
  Target: ATXN1; (-) strand; PAM type: NRG; PAM sequence: GGG
gcaccattccactccagcct

SEQ ID NO: 82571 - DNA, 20 bp, Artificial Sequence
  Description of Artificial Sequence: Synthetic oligonucleotide
  Target: ATXN1; (-) strand; PAM type: NRG; PAM sequence: TGG
tgcaccattccactccagcc

SEQ ID NO: 82572 - DNA, 20 bp, Artificial Sequence
  Description of Artificial Sequence: Synthetic oligonucleotide
  Target: ATXN1; (-) strand; PAM type: NRG; PAM sequence: CAG
tagactgcaccattccactc

SEQ ID NO: 82573 - DNA, 20 bp, Artificial Sequence
  Description of Artificial Sequence: Synthetic oligonucleotide
  Target: ATXN1; (-) strand; PAM type: NRG; PAM sequence: TAG
tttcttgagcccagaaagtt

SEQ ID NO: 82574 - DNA, 20 bp, Artificial Sequence
  Description of Artificial Sequence: Synthetic oligonucleotide
  Target: ATXN1; (-) strand; PAM type: NRG; PAM sequence: AAG
gaggatttcttgagcccaga

SEQ ID NO: 82575 - DNA, 20 bp, Artificial Sequence
  Description of Artificial Sequence: Synthetic oligonucleotide
  Target: ATXN1; (-) strand; PAM type: NRG; PAM sequence: CAG
ggaagaggatttcttgagcc

SEQ ID NO: 82576 - DNA, 20 bp, Artificial Sequence
  Description of Artificial Sequence: Synthetic oligonucleotide
  Target: ATXN1; (-) strand; PAM type: NRG; PAM sequence: GAG
ctgagggaagaggatttctt

SEQ ID NO: 82577 - DNA, 20 bp, Artificial Sequence
  Description of Artificial Sequence: Synthetic oligonucleotide
  Target: ATXN1; (-) strand; PAM type: NRG; PAM sequence: AGG
ttttgagaggctgagggaag

SEQ ID NO: 82578 - DNA, 20 bp, Artificial Sequence
  Description of Artificial Sequence: Synthetic oligonucleotide
  Target: ATXN1; (-) strand; PAM type: NRG; PAM sequence: GAG
attttgagaggctgagggaa

SEQ ID NO: 82579 - DNA, 20 bp, Artificial Sequence
  Description of Artificial Sequence: Synthetic oligonucleotide
  Target: ATXN1; (-) strand; PAM type: NRG; PAM sequence: AAG
gcattttgagaggctgaggg

SEQ ID NO: 82580 - DNA, 20 bp, Artificial Sequence
  Description of Artificial Sequence: Synthetic oligonucleotide
  Target: ATXN1; (-) strand; PAM type: NRG; PAM sequence: GGG
tcagcattttgagaggctga

SEQ ID NO: 82581 - DNA, 20 bp, Artificial Sequence
  Description of Artificial Sequence: Synthetic oligonucleotide
  Target: ATXN1; (-) strand; PAM type: NRG; PAM sequence: AGG
gtcagcattttgagaggctg

SEQ ID NO: 82582 - DNA, 20 bp, Artificial Sequence
  Description of Artificial Sequence: Synthetic oligonucleotide
  Target: ATXN1; (-) strand; PAM type: NRG; PAM sequence: GAG
tgtcagcattttgagaggct

SEQ ID NO: 82583 - DNA, 20 bp, Artificial Sequence
  Description of Artificial Sequence: Synthetic oligonucleotide
  Target: ATXN1; (-) strand; PAM type: NRG; PAM sequence: AGG
tgtaatgtcagcattttgag

SEQ ID NO: 82584 - DNA, 20 bp, Artificial Sequence
  Description of Artificial Sequence: Synthetic oligonucleotide
  Target: ATXN1; (-) strand; PAM type: NRG; PAM sequence: GAG
ctgtaatgtcagcattttga

SEQ ID NO: 82585 - DNA, 20 bp, Artificial Sequence
  Description of Artificial Sequence: Synthetic oligonucleotide
  Target: ATXN1; (-) strand; PAM type: NRG; PAM sequence: GAG
atctgtaatgtcagcatttt

SEQ ID NO: 82586 - DNA, 20 bp, Artificial Sequence
  Description of Artificial Sequence: Synthetic oligonucleotide
  Target: ATXN1; (-) strand; PAM type: NRG; PAM sequence: CAG
gtgtctcacatctgtaatgt

SEQ ID NO: 82587 - DNA, 20 bp, Artificial Sequence
  Description of Artificial Sequence: Synthetic oligonucleotide
  Target: ATXN1; (-) strand; PAM type: NRG; PAM sequence: TGG
ttgaaattcctggccaagca

SEQ ID NO: 82588 - DNA, 20 bp, Artificial Sequence
  Description of Artificial Sequence: Synthetic oligonucleotide
  Target: ATXN1; (-) strand; PAM type: NRG; PAM sequence: AAG
cctaattgaaattcctggcc

SEQ ID NO: 82589 - DNA, 20 bp, Artificial Sequence
  Description of Artificial Sequence: Synthetic oligonucleotide
  Target: ATXN1; (-) strand; PAM type: NRG; PAM sequence: TGG
tgaggcctaattgaaattcc

SEQ ID NO: 82590 - DNA, 20 bp, Artificial Sequence
  Description of Artificial Sequence: Synthetic oligonucleotide
  Target: ATXN1; (-) strand; PAM type: NRG; PAM sequence: AGG
aaactcccactcattcgttg

SEQ ID NO: 82591 - DNA, 20 bp, Artificial Sequence
  Description of Artificial Sequence: Synthetic oligonucleotide
  Target: ATXN1; (-) strand; PAM type: NRG; PAM sequence: GAG
taaactcccactcattcgtt

SEQ ID NO: 82592 - DNA, 20 bp, Artificial Sequence
  Description of Artificial Sequence: Synthetic oligonucleotide
  Target: ATXN1; (-) strand; PAM type: NRG; PAM sequence: TGG
tgagactcttgttctctgcc

SEQ ID NO: 82593 - DNA, 20 bp, Artificial Sequence
  Description of Artificial Sequence: Synthetic oligonucleotide
  Target: ATXN1; (-) strand; PAM type: NRG; PAM sequence: GAG
cctgttgtttcttctcgcat

SEQ ID NO: 82594 - DNA, 20 bp, Artificial Sequence
  Description of Artificial Sequence: Synthetic oligonucleotide
  Target: ATXN1; (-) strand; PAM type: NRG; PAM sequence: AGG
gcatggcctctaaggcccct

SEQ ID NO: 82595 - DNA, 20 bp, Artificial Sequence
  Description of Artificial Sequence: Synthetic oligonucleotide
  Target: ATXN1; (-) strand; PAM type: NRG; PAM sequence: TAG
tgcatggcctctaaggcccc

SEQ ID NO: 82596 - DNA, 20 bp, Artificial Sequence
  Description of Artificial Sequence: Synthetic oligonucleotide
  Target: ATXN1; (-) strand; PAM type: NRG; PAM sequence: AGG
atttcactgcatggcctcta

SEQ ID NO: 82597 - DNA, 20 bp, Artificial Sequence
  Description of Artificial Sequence: Synthetic oligonucleotide
  Target: ATXN1; (-) strand; PAM type: NRG; PAM sequence: AAG
aatttcactgcatggcctct

SEQ ID NO: 82598 - DNA, 20 bp, Artificial Sequence
  Description of Artificial Sequence: Synthetic oligonucleotide
  Target: ATXN1; (-) strand; PAM type: NRG; PAM sequence: TGG
aaaatgtgaatttcactgca

SEQ ID NO: 82599 - DNA, 20 bp, Artificial Sequence
  Description of Artificial Sequence: Synthetic oligonucleotide
  Target: ATXN1; (-) strand; PAM type: NRG; PAM sequence: AGG
ttagctttctgctcctgata

SEQ ID NO: 82600 - DNA, 20 bp, Artificial Sequence
  Description of Artificial Sequence: Synthetic oligonucleotide
  Target: ATXN1; (-) strand; PAM type: NRG; PAM sequence: AAG
gttagctttctgctcctgat

SEQ ID NO: 82601 - DNA, 20 bp, Artificial Sequence
  Description of Artificial Sequence: Synthetic oligonucleotide
  Target: ATXN1; (-) strand; PAM type: NRG; PAM sequence: TAG
aataattgaaaggattttgt

SEQ ID NO: 82602 - DNA, 20 bp, Artificial Sequence
  Description of Artificial Sequence: Synthetic oligonucleotide
  Target: ATXN1; (-) strand; PAM type: NRG; PAM sequence: AGG
aagtaaaatgaataattgaa

SEQ ID NO: 82603 - DNA, 20 bp, Artificial Sequence
  Description of Artificial Sequence: Synthetic oligonucleotide
  Target: ATXN1; (-) strand; PAM type: NRG; PAM sequence: AAG
gaagtaaaatgaataattga

SEQ ID NO: 82604 - DNA, 20 bp, Artificial Sequence
  Description of Artificial Sequence: Synthetic oligonucleotide
  Target: ATXN1; (-) strand; PAM type: NRG; PAM sequence: AAG
ggtagcaaatgaatatggtg

SEQ ID NO: 82605 - DNA, 20 bp, Artificial Sequence
  Description of Artificial Sequence: Synthetic oligonucleotide
  Target: ATXN1; (-) strand; PAM type: NRG; PAM sequence: TGG
cctttggtagcaaatgaata

SEQ ID NO: 82606 - DNA, 20 bp, Artificial Sequence
  Description of Artificial Sequence: Synthetic oligonucleotide
  Target: ATXN1; (-) strand; PAM type: NRG; PAM sequence: TAG
gttttttaatactcctttgg

SEQ ID NO: 82607 - DNA, 20 bp, Artificial Sequence
  Description of Artificial Sequence: Synthetic oligonucleotide
  Target: ATXN1; (-) strand; PAM type: NRG; PAM sequence: TGG
tgtgttttttaatactcctt

SEQ ID NO: 82608 - DNA, 20 bp, Artificial Sequence
  Description of Artificial Sequence: Synthetic oligonucleotide
  Target: ATXN1; (-) strand; PAM type: NRG; PAM sequence: GGG
tgaaggtatttttaatatta

SEQ ID NO: 82609 - DNA, 20 bp, Artificial Sequence
  Description of Artificial Sequence: Synthetic oligonucleotide
  Target: ATXN1; (-) strand; PAM type: NRG; PAM sequence: AGG
atgaaggtatttttaatatt

SEQ ID NO: 82610 - DNA, 20 bp, Artificial Sequence
  Description of Artificial Sequence: Synthetic oligonucleotide
  Target: ATXN1; (-) strand; PAM type: NRG; PAM sequence: TAG
aatgaaggtatttttaatat

SEQ ID NO: 82611 - DNA, 20 bp, Artificial Sequence
  Description of Artificial Sequence: Synthetic oligonucleotide
  Target: ATXN1; (-) strand; PAM type: NRG; PAM sequence: AGG
agtaaagaaaacaagaatga

SEQ ID NO: 82612 - DNA, 20 bp, Artificial Sequence
  Description of Artificial Sequence: Synthetic oligonucleotide
  Target: ATXN1; (-) strand; PAM type: NRG; PAM sequence: AAG
aagtaaagaaaacaagaatg

SEQ ID NO: 82613 - DNA, 20 bp, Artificial Sequence
  Description of Artificial Sequence: Synthetic oligonucleotide
  Target: ATXN1; (-) strand; PAM type: NRG; PAM sequence: AAG
aggctagaagtaaagaaaac

SEQ ID NO: 82614 - DNA, 20 bp, Artificial Sequence
  Description of Artificial Sequence: Synthetic oligonucleotide
  Target: ATXN1; (-) strand; PAM type: NRG; PAM sequence: AAG
atccacaaaggctagaagta

SEQ ID NO: 82615 - DNA, 20 bp, Artificial Sequence
  Description of Artificial Sequence: Synthetic oligonucleotide
  Target: ATXN1; (-) strand; PAM type: NRG; PAM sequence: AAG
tgcctatccacaaaggctag

SEQ ID NO: 82616 - DNA, 20 bp, Artificial Sequence
  Description of Artificial Sequence: Synthetic oligonucleotide
  Target: ATXN1; (-) strand; PAM type: NRG; PAM sequence: TAG
ctatgcctatccacaaaggc

SEQ ID NO: 82617 - DNA, 20 bp, Artificial Sequence
  Description of Artificial Sequence: Synthetic oligonucleotide
  Target: ATXN1; (-) strand; PAM type: NRG; PAM sequence: AGG
aaatctatgcctatccacaa

SEQ ID NO: 82618 - DNA, 20 bp, Artificial Sequence
  Description of Artificial Sequence: Synthetic oligonucleotide
  Target: ATXN1; (-) strand; PAM type: NRG; PAM sequence: AAG
aaaatctatgcctatccaca

SEQ ID NO: 82619 - DNA, 20 bp, Artificial Sequence
  Description of Artificial Sequence: Synthetic oligonucleotide
  Target: ATXN1; (-) strand; PAM type: NRG; PAM sequence: CAG
caaacacattgattacaaag

SEQ ID NO: 82620 - DNA, 20 bp, Artificial Sequence
  Description of Artificial Sequence: Synthetic oligonucleotide
  Target: ATXN1; (-) strand; PAM type: NRG; PAM sequence: AAG
gtgcaaacacattgattaca

SEQ ID NO: 82621 - DNA, 20 bp, Artificial Sequence
  Description of Artificial Sequence: Synthetic oligonucleotide
  Target: ATXN1; (-) strand; PAM type: NRG; PAM sequence: AAG
ggctaaacccaacaaatgtt

SEQ ID NO: 82622 - DNA, 20 bp, Artificial Sequence
  Description of Artificial Sequence: Synthetic oligonucleotide
  Target: ATXN1; (-) strand; PAM type: NRG; PAM sequence: CGG
atatggaagaaggcagcttt

SEQ ID NO: 82623 - DNA, 20 bp, Artificial Sequence
  Description of Artificial Sequence: Synthetic oligonucleotide
  Target: ATXN1; (-) strand; PAM type: NRG; PAM sequence: CAG
acttaaaatatggaagaagg

SEQ ID NO: 82624 - DNA, 20 bp, Artificial Sequence
  Description of Artificial Sequence: Synthetic oligonucleotide
  Target: ATXN1; (-) strand; PAM type: NRG; PAM sequence: AGG
caaacttaaaatatggaaga

SEQ ID NO: 82625 - DNA, 20 bp, Artificial Sequence
  Description of Artificial Sequence: Synthetic oligonucleotide
  Target: ATXN1; (-) strand; PAM type: NRG; PAM sequence: AAG
ccaaacttaaaatatggaag

SEQ ID NO: 82626 - DNA, 20 bp, Artificial Sequence
  Description of Artificial Sequence: Synthetic oligonucleotide
  Target: ATXN1; (-) strand; PAM type: NRG; PAM sequence: AAG
aggccaaacttaaaatatgg

SEQ ID NO: 82627 - DNA, 20 bp, Artificial Sequence
  Description of Artificial Sequence: Synthetic oligonucleotide
  Target: ATXN1; (-) strand; PAM type: NRG; PAM sequence: TGG
tttaggccaaacttaaaata

SEQ ID NO: 82628 - DNA, 20 bp, Artificial Sequence
  Description of Artificial Sequence: Synthetic oligonucleotide
  Target: ATXN1; (-) strand; PAM type: NRG; PAM sequence: AGG
ctgcatgcggagaaaccttt

SEQ ID NO: 82629 - DNA, 20 bp, Artificial Sequence
  Description of Artificial Sequence: Synthetic oligonucleotide
  Target: ATXN1; (-) strand; PAM type: NRG; PAM sequence: TAG
actgcatgcggagaaacctt

SEQ ID NO: 82630 - DNA, 20 bp, Artificial Sequence
  Description of Artificial Sequence: Synthetic oligonucleotide
  Target: ATXN1; (-) strand; PAM type: NRG; PAM sequence: GAG
gttacggttcactgcatgcg

SEQ ID NO: 82631 - DNA, 20 bp, Artificial Sequence
  Description of Artificial Sequence: Synthetic oligonucleotide
  Target: ATXN1; (-) strand; PAM type: NRG; PAM sequence: CGG
aggttacggttcactgcatg

SEQ ID NO: 82632 - DNA, 20 bp, Artificial Sequence
  Description of Artificial Sequence: Synthetic oligonucleotide
  Target: ATXN1; (-) strand; PAM type: NRG; PAM sequence: CGG
ttacacatccaggtaggtta

SEQ ID NO: 82633 - DNA, 20 bp, Artificial Sequence
  Description of Artificial Sequence: Synthetic oligonucleotide
  Target: ATXN1; (-) strand; PAM type: NRG; PAM sequence: AGG
gcctgtttacacatccaggt

SEQ ID NO: 82634 - DNA, 20 bp, Artificial Sequence
  Description of Artificial Sequence: Synthetic oligonucleotide
  Target: ATXN1; (-) strand; PAM type: NRG; PAM sequence: TAG
agcctgtttacacatccagg

SEQ ID NO: 82635 - DNA, 20 bp, Artificial Sequence
  Description of Artificial Sequence: Synthetic oligonucleotide
  Target: ATXN1; (-) strand; PAM type: NRG; PAM sequence: AGG
tacagcctgtttacacatcc

SEQ ID NO: 82636 - DNA, 20 bp, Artificial Sequence
  Description of Artificial Sequence: Synthetic oligonucleotide
  Target: ATXN1; (-) strand; PAM type: NRG; PAM sequence: CAG
ttacagcctgtttacacatc

SEQ ID NO: 82637 - DNA, 20 bp, Artificial Sequence
  Description of Artificial Sequence: Synthetic oligonucleotide
  Target: ATXN1; (-) strand; PAM type: NRG; PAM sequence: CAG
attggtacaagaataggtta

SEQ ID NO: 82638 - DNA, 20 bp, Artificial Sequence
  Description of Artificial Sequence: Synthetic oligonucleotide
  Target: ATXN1; (-) strand; PAM type: NRG; PAM sequence: AGG
ccagagattggtacaagaat

SEQ ID NO: 82639 - DNA, 20 bp, Artificial Sequence
  Description of Artificial Sequence: Synthetic oligonucleotide
  Target: ATXN1; (-) strand; PAM type: NRG; PAM sequence: TAG
cccagagattggtacaagaa

SEQ ID NO: 82640 - DNA, 20 bp, Artificial Sequence
  Description of Artificial Sequence: Synthetic oligonucleotide
  Target: ATXN1; (-) strand; PAM type: NRG; PAM sequence: AAG
cgaaacccagagattggtac

SEQ ID NO: 82641 - DNA, 20 bp, Artificial Sequence
  Description of Artificial Sequence: Synthetic oligonucleotide
  Target: ATXN1; (-) strand; PAM type: NRG; PAM sequence: TGG
attcgccgaaacccagagat

SEQ ID NO: 82642 - DNA, 20 bp, Artificial Sequence
  Description of Artificial Sequence: Synthetic oligonucleotide
  Target: ATXN1; (-) strand; PAM type: NRG; PAM sequence: GAG
ctgtgattcgccgaaaccca

SEQ ID NO: 82643 - DNA, 20 bp, Artificial Sequence
  Description of Artificial Sequence: Synthetic oligonucleotide
  Target: ATXN1; (-) strand; PAM type: NRG; PAM sequence: CAG
gcctgtgattcgccgaaacc

SEQ ID NO: 82644 - DNA, 20 bp, Artificial Sequence
  Description of Artificial Sequence: Synthetic oligonucleotide
  Target: ATXN1; (-) strand; PAM type: NRG; PAM sequence: AGG
ttgaacagggtttgaacgat

SEQ ID NO: 82645 - DNA, 20 bp, Artificial Sequence
  Description of Artificial Sequence: Synthetic oligonucleotide
  Target: ATXN1; (-) strand; PAM type: NRG; PAM sequence: TAG
tttgaacagggtttgaacga

SEQ ID NO: 82646 - DNA, 20 bp, Artificial Sequence
  Description of Artificial Sequence: Synthetic oligonucleotide
  Target: ATXN1; (-) strand; PAM type: NRG; PAM sequence: GGG
gcgttcgccttatttgaaca

SEQ ID NO: 82647 - DNA, 20 bp, Artificial Sequence
  Description of Artificial Sequence: Synthetic oligonucleotide
  Target: ATXN1; (-) strand; PAM type: NRG; PAM sequence: AGG
agcgttcgccttatttgaac

SEQ ID NO: 82648 - DNA, 20 bp, Artificial Sequence
  Description of Artificial Sequence: Synthetic oligonucleotide
  Target: ATXN1; (-) strand; PAM type: NRG; PAM sequence: CAG
cagcgttcgccttatttgaa

SEQ ID NO: 82649 - DNA, 20 bp, Artificial Sequence
  Description of Artificial Sequence: Synthetic oligonucleotide
  Target: ATXN1; (-) strand; PAM type: NRG; PAM sequence: CAG
cagccagattggtttcagct

SEQ ID NO: 82650 - DNA, 20 bp, Artificial Sequence
  Description of Artificial Sequence: Synthetic oligonucleotide
  Target: ATXN1; (-) strand; PAM type: NRG; PAM sequence: CAG
agaaacagccagattggttt

SEQ ID NO: 82651 - DNA, 20 bp, Artificial Sequence
  Description of Artificial Sequence: Synthetic oligonucleotide
  Target: ATXN1; (-) strand; PAM type: NRG; PAM sequence: TGG
aggtacagaaacagccagat

SEQ ID NO: 82652 - DNA, 20 bp, Artificial Sequence
  Description of Artificial Sequence: Synthetic oligonucleotide
  Target: ATXN1; (-) strand; PAM type: NRG; PAM sequence: CAG
aagtgaggtacagaaacagc

SEQ ID NO: 82653 - DNA, 20 bp, Artificial Sequence
  Description of Artificial Sequence: Synthetic oligonucleotide
  Target: ATXN1; (-) strand; PAM type: NRG; PAM sequence: CAG
acagaagtgaggtacagaaa

SEQ ID NO: 82654 - DNA, 20 bp, Artificial Sequence
  Description of Artificial Sequence: Synthetic oligonucleotide
  Target: ATXN1; (-) strand; PAM type: NRG; PAM sequence: CAG
cagaaaacagaagtgaggta

SEQ ID NO: 82655 - DNA, 20 bp, Artificial Sequence
  Description of Artificial Sequence: Synthetic oligonucleotide
  Target: ATXN1; (-) strand; PAM type: NRG; PAM sequence: AGG
acggacagaaaacagaagtg

SEQ ID NO: 82656 - DNA, 20 bp, Artificial Sequence
  Description of Artificial Sequence: Synthetic oligonucleotide
  Target: ATXN1; (-) strand; PAM type: NRG; PAM sequence: GAG
gacggacagaaaacagaagt

SEQ ID NO: 82657 - DNA, 20 bp, Artificial Sequence
  Description of Artificial Sequence: Synthetic oligonucleotide
  Target: ATXN1; (-) strand; PAM type: NRG; PAM sequence: AAG
aaacgacggacagaaaacag

SEQ ID NO: 82658 - DNA, 20 bp, Artificial Sequence
  Description of Artificial Sequence: Synthetic oligonucleotide
  Target: ATXN1; (-) strand; PAM type: NRG; PAM sequence: CAG
ggaaaacgacggacagaaaa

SEQ ID NO: 82659 - DNA, 20 bp, Artificial Sequence
  Description of Artificial Sequence: Synthetic oligonucleotide
  Target: ATXN1; (-) strand; PAM type: NRG; PAM sequence: CAG
agaaaaaggaaaacgacgga

SEQ ID NO: 82660 - DNA, 20 bp, Artificial Sequence
  Description of Artificial Sequence: Synthetic oligonucleotide
  Target: ATXN1; (-) strand; PAM type: NRG; PAM sequence: CGG
agacagaaaaaggaaaacga

SEQ ID NO: 82661 - DNA, 20 bp, Artificial Sequence
  Description of Artificial Sequence: Synthetic oligonucleotide
  Target: ATXN1; (-) strand; PAM type: NRG; PAM sequence: AGG
gaggatttatagacagaaaa

SEQ ID NO: 82662 - DNA, 20 bp, Artificial Sequence
  Description of Artificial Sequence: Synthetic oligonucleotide
  Target: ATXN1; (-) strand; PAM type: NRG; PAM sequence: AAG
agaggatttatagacagaaa

SEQ ID NO: 82663 - DNA, 20 bp, Artificial Sequence
  Description of Artificial Sequence: Synthetic oligonucleotide
  Target: ATXN1; (-) strand; PAM type: NRG; PAM sequence: CAG
ggttggagaggatttataga

SEQ ID NO: 82664 - DNA, 20 bp, Artificial Sequence
  Description of Artificial Sequence: Synthetic oligonucleotide
  Target: ATXN1; (-) strand; PAM type: NRG; PAM sequence: TAG
gtgtggttggagaggattta

SEQ ID NO: 82665 - DNA, 20 bp, Artificial Sequence
  Description of Artificial Sequence: Synthetic oligonucleotide
  Target: ATXN1; (-) strand; PAM type: NRG; PAM sequence: AGG
atgctgttgtgtggttggag

SEQ ID NO: 82666 - DNA, 20 bp, Artificial Sequence
  Description of Artificial Sequence: Synthetic oligonucleotide
  Target: ATXN1; (-) strand; PAM type: NRG; PAM sequence: GAG
catgctgttgtgtggttgga

SEQ ID NO: 82667 - DNA, 20 bp, Artificial Sequence
  Description of Artificial Sequence: Synthetic oligonucleotide
  Target: ATXN1; (-) strand; PAM type: NRG; PAM sequence: GAG
gacatgctgttgtgtggttg

SEQ ID NO: 82668 - DNA, 20 bp, Artificial Sequence
  Description of Artificial Sequence: Synthetic oligonucleotide
  Target: ATXN1; (-) strand; PAM type: NRG; PAM sequence: TGG
ctgacatgctgttgtgtggt

SEQ ID NO: 82669 - DNA, 20 bp, Artificial Sequence
  Description of Artificial Sequence: Synthetic oligonucleotide
  Target: ATXN1; (-) strand; PAM type: NRG; PAM sequence: TGG
atttctgacatgctgttgtg

SEQ ID NO: 82670 - DNA, 20 bp, Artificial Sequence
  Description of Artificial Sequence: Synthetic oligonucleotide
  Target: ATXN1; (-) strand; PAM type: NRG; PAM sequence: GGG
cccgaactagaatagattca

SEQ ID NO: 82671 - DNA, 20 bp, Artificial Sequence
  Description of Artificial Sequence: Synthetic oligonucleotide
  Target: ATXN1; (-) strand; PAM type: NRG; PAM sequence: AGG
tcccgaactagaatagattc

SEQ ID NO: 82672 - DNA, 20 bp, Artificial Sequence
  Description of Artificial Sequence: Synthetic oligonucleotide
  Target: ATXN1; (-) strand; PAM type: NRG; PAM sequence: CAG
ctcccgaactagaatagatt

SEQ ID NO: 82673 - DNA, 20 bp, Artificial Sequence
  Description of Artificial Sequence: Synthetic oligonucleotide
  Target: ATXN1; (-) strand; PAM type: NRG; PAM sequence: TAG
cctttcctcccgaactagaa

SEQ ID NO: 82674 - DNA, 20 bp, Artificial Sequence
  Description of Artificial Sequence: Synthetic oligonucleotide
  Target: ATXN1; (-) strand; PAM type: NRG; PAM sequence: TAG
ctactcctttcctcccgaac

SEQ ID NO: 82675 - DNA, 20 bp, Artificial Sequence
  Description of Artificial Sequence: Synthetic oligonucleotide
  Target: ATXN1; (-) strand; PAM type: NRG; PAM sequence: CAG
agaactatttgcaaatcagg

SEQ ID NO: 82676 - DNA, 20 bp, Artificial Sequence
  Description of Artificial Sequence: Synthetic oligonucleotide
  Target: ATXN1; (-) strand; PAM type: NRG; PAM sequence: AGG
caaagaactatttgcaaatc

SEQ ID NO: 82677 - DNA, 20 bp, Artificial Sequence
  Description of Artificial Sequence: Synthetic oligonucleotide
  Target: ATXN1; (-) strand; PAM type: NRG; PAM sequence: CAG
gcaaagaactatttgcaaat

SEQ ID NO: 82678 - DNA, 20 bp, Artificial Sequence
  Description of Artificial Sequence: Synthetic oligonucleotide
  Target: ATXN1; (-) strand; PAM type: NRG; PAM sequence: AAG
taacagagtttaattcagca

SEQ ID NO: 82679 - DNA, 20 bp, Artificial Sequence
  Description of Artificial Sequence: Synthetic oligonucleotide
  Target: ATXN1; (-) strand; PAM type: NRG; PAM sequence: CAG
aaatttaacagagtttaatt

SEQ ID NO: 82680 - DNA, 20 bp, Artificial Sequence
  Description of Artificial Sequence: Synthetic oligonucleotide
  Target: ATXN1; (-) strand; PAM type: NRG; PAM sequence: GAG
tagacaaattaaatttaaca

SEQ ID NO: 82681 - DNA, 20 bp, Artificial Sequence
  Description of Artificial Sequence: Synthetic oligonucleotide
  Target: ATXN1; (-) strand; PAM type: NRG; PAM sequence: CAG
tttagacaaattaaatttaa

SEQ ID NO: 82682 - DNA, 20 bp, Artificial Sequence
  Description of Artificial Sequence: Synthetic oligonucleotide
  Target: ATXN1; (-) strand; PAM type: NRG; PAM sequence: TAG
atgtgttaaaagaaaaactt

SEQ ID NO: 82683 - DNA, 20 bp, Artificial Sequence
  Description of Artificial Sequence: Synthetic oligonucleotide
  Target: ATXN1; (-) strand; PAM type: NRG; PAM sequence: AAG
ctcataatctaatgtgttaa

SEQ ID NO: 82684 - DNA, 20 bp, Artificial Sequence
  Description of Artificial Sequence: Synthetic oligonucleotide
  Target: ATXN1; (-) strand; PAM type: NRG; PAM sequence: AAG
tagtatgtggaaatatggaa

SEQ ID NO: 82685 - DNA, 20 bp, Artificial Sequence
  Description of Artificial Sequence: Synthetic oligonucleotide
  Target: ATXN1; (-) strand; PAM type: NRG; PAM sequence: TGG
cttggtagtatgtggaaata

SEQ ID NO: 82686 - DNA, 20 bp, Artificial Sequence
  Description of Artificial Sequence: Synthetic oligonucleotide
  Target: ATXN1; (-) strand; PAM type: NRG; PAM sequence: TGG
tgaaaatccttggtagtatg

SEQ ID NO: 82687 - DNA, 20 bp, Artificial Sequence
  Description of Artificial Sequence: Synthetic oligonucleotide
  Target: ATXN1; (-) strand; PAM type: NRG; PAM sequence: TAG
ctacacttgaaaatccttgg

SEQ ID NO: 82688 - DNA, 20 bp, Artificial Sequence
  Description of Artificial Sequence: Synthetic oligonucleotide
  Target: ATXN1; (-) strand; PAM type: NRG; PAM sequence: TGG
ctcctacacttgaaaatcct

SEQ ID NO: 82689 - DNA, 20 bp, Artificial Sequence
  Description of Artificial Sequence: Synthetic oligonucleotide
  Target: ATXN1; (-) strand; PAM type: NRG; PAM sequence: GGG
gaattctcatatgaaagaaa

SEQ ID NO: 82690 - DNA, 20 bp, Artificial Sequence
  Description of Artificial Sequence: Synthetic oligonucleotide
  Target: ATXN1; (-) strand; PAM type: NRG; PAM sequence: AGG
agaattctcatatgaaagaa

SEQ ID NO: 82691 - DNA, 20 bp, Artificial Sequence
  Description of Artificial Sequence: Synthetic oligonucleotide
  Target: ATXN1; (-) strand; PAM type: NRG; PAM sequence: AAG
gagaattctcatatgaaaga

SEQ ID NO: 82692 - DNA, 20 bp, Artificial Sequence
  Description of Artificial Sequence: Synthetic oligonucleotide
  Target: ATXN1; (-) strand; PAM type: NRG; PAM sequence: AAG
ttttgagaattctcatatga

SEQ ID NO: 82693 - DNA, 20 bp, Artificial Sequence
  Description of Artificial Sequence: Synthetic oligonucleotide
  Target: ATXN1; (-) strand; PAM type: NRG; PAM sequence: GAG
tccatttattctactctttt

SEQ ID NO: 82694 - DNA, 20 bp, Artificial Sequence
  Description of Artificial Sequence: Synthetic oligonucleotide
  Target: ATXN1; (-) strand; PAM type: NRG; PAM sequence: AAG
tccaagaagccccttgctta

SEQ ID NO: 82695 - DNA, 20 bp, Artificial Sequence
  Description of Artificial Sequence: Synthetic oligonucleotide
  Target: ATXN1; (-) strand; PAM type: NRG; PAM sequence: AAG
ctgctgcagtggcttccaag

SEQ ID NO: 82696 - DNA, 20 bp, Artificial Sequence
  Description of Artificial Sequence: Synthetic oligonucleotide
  Target: ATXN1; (-) strand; PAM type: NRG; PAM sequence: AAG
ggactgctgcagtggcttcc

SEQ ID NO: 82697 - DNA, 20 bp, Artificial Sequence
  Description of Artificial Sequence: Synthetic oligonucleotide
  Target: ATXN1; (-) strand; PAM type: NRG; PAM sequence: TGG
acttgcctggactgctgcag

SEQ ID NO: 82698 - DNA, 20 bp, Artificial Sequence
  Description of Artificial Sequence: Synthetic oligonucleotide
  Target: ATXN1; (-) strand; PAM type: NRG; PAM sequence: CAG
atcacttgcctggactgctg

SEQ ID NO: 82699 - DNA, 20 bp, Artificial Sequence
  Description of Artificial Sequence: Synthetic oligonucleotide
  Target: ATXN1; (-) strand; PAM type: NRG; PAM sequence: TGG
gaccttcagcatcacttgcc

SEQ ID NO: 82700 - DNA, 20 bp, Artificial Sequence
  Description of Artificial Sequence: Synthetic oligonucleotide
  Target: ATXN1; (-) strand; PAM type: NRG; PAM sequence: CAG
cctgttctgttgcagacctt

SEQ ID NO: 82701 - DNA, 20 bp, Artificial Sequence
  Description of Artificial Sequence: Synthetic oligonucleotide
  Target: ATXN1; (-) strand; PAM type: NRG; PAM sequence: CAG
ctcgggcccctgttctgttg

SEQ ID NO: 82702 - DNA, 20 bp, Artificial Sequence
  Description of Artificial Sequence: Synthetic oligonucleotide
  Target: ATXN1; (-) strand; PAM type: NRG; PAM sequence: GGG
acccactcttctccactctc

SEQ ID NO: 82703 - DNA, 20 bp, Artificial Sequence
  Description of Artificial Sequence: Synthetic oligonucleotide
  Target: ATXN1; (-) strand; PAM type: NRG; PAM sequence: CGG
tacccactcttctccactct

SEQ ID NO: 82704 - DNA, 20 bp, Artificial Sequence
  Description of Artificial Sequence: Synthetic oligonucleotide
  Target: ATXN1; (-) strand; PAM type: NRG; PAM sequence: TAG
gtttggcctctttaatatga

SEQ ID NO: 82705 - DNA, 20 bp, Artificial Sequence
  Description of Artificial Sequence: Synthetic oligonucleotide
  Target: ATXN1; (-) strand; PAM type: NRG; PAM sequence: TGG
cactgcccccagtctgagtt

SEQ ID NO: 82706 - DNA, 20 bp, Artificial Sequence
  Description of Artificial Sequence: Synthetic oligonucleotide
  Target: ATXN1; (-) strand; PAM type: NRG; PAM sequence: GAG
tgagccactgcccccagtct

SEQ ID NO: 82707 - DNA, 20 bp, Artificial Sequence
  Description of Artificial Sequence: Synthetic oligonucleotide
  Target: ATXN1; (-) strand; PAM type: NRG; PAM sequence: CAG
caggcgtgagccactgcccc

SEQ ID NO: 82708 - DNA, 20 bp, Artificial Sequence
  Description of Artificial Sequence: Synthetic oligonucleotide
  Target: ATXN1; (-) strand; PAM type: NRG; PAM sequence: GAG
agtgttgggattacaggcgt

SEQ ID NO: 82709 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgttgggattac

SEQ ID NO: 82710 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgttgggatta

SEQ ID NO: 82711 - DNA, 20 bp, Artificial Sequence
  Description of Artificial Sequence: Synthetic oligonucleotide
  Target: ATXN1; (-) strand; PAM type: NRG; PAM sequence: GGG
cctaagcctcccaaagtgtt

SEQ ID NO: 82712 - DNA, 20 bp, Artificial Sequence
  Description of Artificial Sequence: Synthetic oligonucleotide
  Target: ATXN1; (-) strand; PAM type: NRG; PAM sequence: TGG
gcctaagcctcccaaagtgt

SEQ ID NO: 82713 - DNA, 20 bp, Artificial Sequence
  Description of Artificial Sequence: Synthetic oligonucleotide
  Target: ATXN1; (-) strand; PAM type: NRG; PAM sequence: AAG
ccgcctgcctaagcctccca

SEQ ID NO: 82714 - DNA, 20 bp, Artificial Sequence
  Description of Artificial Sequence: Synthetic oligonucleotide
  Target: ATXN1; (-) strand; PAM type: NRG; PAM sequence: AAG
acctcatgatccgcctgcct

SEQ ID NO: 82715 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggtcaggt

SEQ ID NO: 82716 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggtc

SEQ ID NO: 82717 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggt

SEQ ID NO: 82718 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcaccatgt

SEQ ID NO: 82719 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttggtagagatg

SEQ ID NO: 82720 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttggtagagat

SEQ ID NO: 82721 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttggtagaga

SEQ ID NO: 82722 - DNA, 20 bp, Artificial Sequence
  Description of Artificial Sequence: Synthetic oligonucleotide
  Target: ATXN1; (-) strand; PAM type: NRG; PAM sequence: GAG
aattttttgtatttttggta

SEQ ID NO: 82723 - DNA, 20 bp, Artificial Sequence
  Description of Artificial Sequence: Synthetic oligonucleotide
  Target: ATXN1; (-) strand; PAM type: NRG; PAM sequence: TAG
ctaattttttgtatttttgg

SEQ ID NO: 82724 - DNA, 20 bp, Artificial Sequence
  Description of Artificial Sequence: Synthetic oligonucleotide
  Target: ATXN1; (-) strand; PAM type: NRG; PAM sequence: TGG
tggctaattttttgtatttt

SEQ ID NO: 82725 - DNA, 20 bp, Artificial Sequence
  Description of Artificial Sequence: Synthetic oligonucleotide
  Target: ATXN1; (-) strand; PAM type: NRG; PAM sequence: TGG
caggtgcgcaccaccacacc

SEQ ID NO: 82726 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagcttggattac

SEQ ID NO: 82727 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagcttggatta

SEQ ID NO: 82728 - DNA, 20 bp, Artificial Sequence
  Description of Artificial Sequence: Synthetic oligonucleotide
  Target: ATXN1; (-) strand; PAM type: NRG; PAM sequence: TGG
cctcagcctcctgagtagct

SEQ ID NO: 82729 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 82730 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 82731 - DNA, 20 bp, Artificial Sequence
  Description of Artificial Sequence: Synthetic oligonucleotide
  Target: ATXN1; (-) strand; PAM type: NRG; PAM sequence: CAG
ttcaagggattctcctgcct

SEQ ID NO: 82732 - DNA, 20 bp, Artificial Sequence
  Description of Artificial Sequence: Synthetic oligonucleotide
  Target: ATXN1; (-) strand; PAM type: NRG; PAM sequence: GGG
cctctgcttcccaggttcaa

SEQ ID NO: 82733 - DNA, 20 bp, Artificial Sequence
  Description of Artificial Sequence: Synthetic oligonucleotide
  Target: ATXN1; (-) strand; PAM type: NRG; PAM sequence: AGG
acctctgcttcccaggttca

SEQ ID NO: 82734 - DNA, 20 bp, Artificial Sequence
  Description of Artificial Sequence: Synthetic oligonucleotide
  Target: ATXN1; (-) strand; PAM type: NRG; PAM sequence: AAG
aacctctgcttcccaggttc

SEQ ID NO: 82735 - DNA, 20 bp, Artificial Sequence
  Description of Artificial Sequence: Synthetic oligonucleotide
  Target: ATXN1; (-) strand; PAM type: NRG; PAM sequence: AGG
tactgcaacctctgcttccc

SEQ ID NO: 82736 - DNA, 20 bp, Artificial Sequence
  Description of Artificial Sequence: Synthetic oligonucleotide
  Target: ATXN1; (-) strand; PAM type: NRG; PAM sequence: CAG
ttactgcaacctctgcttcc

SEQ ID NO: 82737 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcaccatct

SEQ ID NO: 82738 - DNA, 20 bp, Artificial Sequence
  Description of Artificial Sequence: Synthetic oligonucleotide
  Target: ATXN1; (-) strand; PAM type: NRG; PAM sequence: TGG
tcacccacgctggagtgcag

SEQ ID NO: 82739 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccacgctggagtg

SEQ ID NO: 82740 - DNA, 20 bp, Artificial Sequence
  Description of Artificial Sequence: Synthetic oligonucleotide
  Target: ATXN1; (-) strand; PAM type: NRG; PAM sequence: GAG
tctctctgtcacccacgctg

SEQ ID NO: 82741 - DNA, 20 bp, Artificial Sequence
  Description of Artificial Sequence: Synthetic oligonucleotide
  Target: ATXN1; (-) strand; PAM type: NRG; PAM sequence: TGG
tctctctctgtcacccacgc

SEQ ID NO: 82742 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 82743 - DNA, 20 bp, Artificial Sequence
  Description of Artificial Sequence: Synthetic oligonucleotide
  Target: ATXN1; (-) strand; PAM type: NRG; PAM sequence: CAG
ccttttttttttttttgaga

SEQ ID NO: 82744 - DNA, 20 bp, Artificial Sequence
  Description of Artificial Sequence: Synthetic oligonucleotide
  Target: ATXN1; (-) strand; PAM type: NRG; PAM sequence: GAG
tctgcctttttttttttttt

SEQ ID NO: 82745 - DNA, 20 bp, Artificial Sequence
  Description of Artificial Sequence: Synthetic oligonucleotide
  Target: ATXN1; (-) strand; PAM type: NRG; PAM sequence: GAG
catccctagctcatatgctg

SEQ ID NO: 82746 - DNA, 20 bp, Artificial Sequence
  Description of Artificial Sequence: Synthetic oligonucleotide
  Target: ATXN1; (-) strand; PAM type: NRG; PAM sequence: TGG
ttcatccctagctcatatgc

SEQ ID NO: 82747 - DNA, 20 bp, Artificial Sequence
  Description of Artificial Sequence: Synthetic oligonucleotide
  Target: ATXN1; (-) strand; PAM type: NRG; PAM sequence: TAG
ctcttcctctgcttcatccc

SEQ ID NO: 82748 - DNA, 20 bp, Artificial Sequence
  Description of Artificial Sequence: Synthetic oligonucleotide
  Target: ATXN1; (-) strand; PAM type: NRG; PAM sequence: TGG
agctcaccatttgttgatgc

SEQ ID NO: 82749 - DNA, 20 bp, Artificial Sequence
  Description of Artificial Sequence: Synthetic oligonucleotide
  Target: ATXN1; (-) strand; PAM type: NRG; PAM sequence: TAG
tttatgggctccagggtcac

SEQ ID NO: 82750 - DNA, 20 bp, Artificial Sequence
  Description of Artificial Sequence: Synthetic oligonucleotide
  Target: ATXN1; (-) strand; PAM type: NRG; PAM sequence: GGG
tcctacgtttatgggctcca

SEQ ID NO: 82751 - DNA, 20 bp, Artificial Sequence
  Description of Artificial Sequence: Synthetic oligonucleotide
  Target: ATXN1; (-) strand; PAM type: NRG; PAM sequence: AGG
gtcctacgtttatgggctcc

SEQ ID NO: 82752 - DNA, 20 bp, Artificial Sequence
  Description of Artificial Sequence: Synthetic oligonucleotide
  Target: ATXN1; (-) strand; PAM type: NRG; PAM sequence: CAG
tgtcctacgtttatgggctc

SEQ ID NO: 82753 - DNA, 20 bp, Artificial Sequence
  Description of Artificial Sequence: Synthetic oligonucleotide
  Target: ATXN1; (-) strand; PAM type: NRG; PAM sequence: GGG
tgtcattgtcctacgtttat

SEQ ID NO: 82754 - DNA, 20 bp, Artificial Sequence
  Description of Artificial Sequence: Synthetic oligonucleotide
  Target: ATXN1; (-) strand; PAM type: NRG; PAM sequence: TGG
ttgtcattgtcctacgttta

SEQ ID NO: 82755 - DNA, 20 bp, Artificial Sequence
  Description of Artificial Sequence: Synthetic oligonucleotide
  Target: ATXN1; (-) strand; PAM type: NRG; PAM sequence: AGG
actccagctggatatcacat

SEQ ID NO: 82756 - DNA, 20 bp, Artificial Sequence
  Description of Artificial Sequence: Synthetic oligonucleotide
  Target: ATXN1; (-) strand; PAM type: NRG; PAM sequence: TAG
gactccagctggatatcaca

SEQ ID NO: 82757 - DNA, 20 bp, Artificial Sequence
  Description of Artificial Sequence: Synthetic oligonucleotide
  Target: ATXN1; (-) strand; PAM type: NRG; PAM sequence: TGG
tcctcccacatgactccagc

SEQ ID NO: 82758 - DNA, 20 bp, Artificial Sequence
  Description of Artificial Sequence: Synthetic oligonucleotide
  Target: ATXN1; (-) strand; PAM type: NRG; PAM sequence: CAG
aacttcctcccacatgactc

SEQ ID NO: 82759 - DNA, 20 bp, Artificial Sequence
  Description of Artificial Sequence: Synthetic oligonucleotide
  Target: ATXN1; (-) strand; PAM type: NRG; PAM sequence: AAG
tctctttctcttcagagttt

SEQ ID NO: 82760 - DNA, 20 bp, Artificial Sequence
  Description of Artificial Sequence: Synthetic oligonucleotide
  Target: ATXN1; (-) strand; PAM type: NRG; PAM sequence: GAG
tttctgtctctttctcttca

SEQ ID NO: 82761 - DNA, 20 bp, Artificial Sequence
  Description of Artificial Sequence: Synthetic oligonucleotide
  Target: ATXN1; (-) strand; PAM type: NRG; PAM sequence: CAG
tatttctgtctctttctctt

SEQ ID NO: 82762 - DNA, 20 bp, Artificial Sequence
  Description of Artificial Sequence: Synthetic oligonucleotide
  Target: ATXN1; (-) strand; PAM type: NRG; PAM sequence: TAG
atcaactctgcacacacaac

SEQ ID NO: 82763 - DNA, 20 bp, Artificial Sequence
  Description of Artificial Sequence: Synthetic oligonucleotide
  Target: ATXN1; (-) strand; PAM type: NRG; PAM sequence: AGG
accgcacatgctttccctga

SEQ ID NO: 82764 - DNA, 20 bp, Artificial Sequence
  Description of Artificial Sequence: Synthetic oligonucleotide
  Target: ATXN1; (-) strand; PAM type: NRG; PAM sequence: AAG
taccgcacatgctttccctg

SEQ ID NO: 82765 - DNA, 20 bp, Artificial Sequence
  Description of Artificial Sequence: Synthetic oligonucleotide
  Target: ATXN1; (-) strand; PAM type: NRG; PAM sequence: GAG
aaaggaaaagcagtgaccta

SEQ ID NO: 82766 - DNA, 20 bp, Artificial Sequence
  Description of Artificial Sequence: Synthetic oligonucleotide
  Target: ATXN1; (-) strand; PAM type: NRG; PAM sequence: TAG
aaaaaggaaaagcagtgacc

SEQ ID NO: 82767 - DNA, 20 bp, Artificial Sequence
  Description of Artificial Sequence: Synthetic oligonucleotide
  Target: ATXN1; (-) strand; PAM type: NRG; PAM sequence: CAG
gttggagtaaaaaggaaaag

SEQ ID NO: 82768 - DNA, 20 bp, Artificial Sequence
  Description of Artificial Sequence: Synthetic oligonucleotide
  Target: ATXN1; (-) strand; PAM type: NRG; PAM sequence: AAG
attgttggagtaaaaaggaa

SEQ ID NO: 82769 - DNA, 20 bp, Artificial Sequence
  Description of Artificial Sequence: Synthetic oligonucleotide
  Target: ATXN1; (-) strand; PAM type: NRG; PAM sequence: AGG
tgcacattgttggagtaaaa

SEQ ID NO: 82770 - DNA, 20 bp, Artificial Sequence
  Description of Artificial Sequence: Synthetic oligonucleotide
  Target: ATXN1; (-) strand; PAM type: NRG; PAM sequence: AAG
gtgcacattgttggagtaaa

SEQ ID NO: 82771 - DNA, 20 bp, Artificial Sequence
  Description of Artificial Sequence: Synthetic oligonucleotide
  Target: ATXN1; (-) strand; PAM type: NRG; PAM sequence: GAG
ggcacacgtgcacattgttg

SEQ ID NO: 82772 - DNA, 20 bp, Artificial Sequence
  Description of Artificial Sequence: Synthetic oligonucleotide
  Target: ATXN1; (-) strand; PAM type: NRG; PAM sequence: TGG
ctggcacacgtgcacattgt

SEQ ID NO: 82773 - DNA, 20 bp, Artificial Sequence
  Description of Artificial Sequence: Synthetic oligonucleotide
  Target: ATXN1; (-) strand; PAM type: NRG; PAM sequence: TGG
agaagaaatcagaattaaac

SEQ ID NO: 82774 - DNA, 20 bp, Artificial Sequence
  Description of Artificial Sequence: Synthetic oligonucleotide
  Target: ATXN1; (-) strand; PAM type: NRG; PAM sequence: CAG
tgccgtgcatcagaagaaat

SEQ ID NO: 82775 - DNA, 20 bp, Artificial Sequence
  Description of Artificial Sequence: Synthetic oligonucleotide
  Target: ATXN1; (-) strand; PAM type: NRG; PAM sequence: AAG
aggcatttgccgtgcatcag

SEQ ID NO: 82776 - DNA, 20 bp, Artificial Sequence
  Description of Artificial Sequence: Synthetic oligonucleotide
  Target: ATXN1; (-) strand; PAM type: NRG; PAM sequence: CAG
gggaggcatttgccgtgcat

SEQ ID NO: 82777 - DNA, 20 bp, Artificial Sequence
  Description of Artificial Sequence: Synthetic oligonucleotide
  Target: ATXN1; (-) strand; PAM type: NRG; PAM sequence: AGG
aatttgagagctttgaaggg

SEQ ID NO: 82778 - DNA, 20 bp, Artificial Sequence
  Description of Artificial Sequence: Synthetic oligonucleotide
  Target: ATXN1; (-) strand; PAM type: NRG; PAM sequence: GAG
caatttgagagctttgaagg

SEQ ID NO: 82779 - DNA, 20 bp, Artificial Sequence
  Description of Artificial Sequence: Synthetic oligonucleotide
  Target: ATXN1; (-) strand; PAM type: NRG; PAM sequence: GGG
gacaatttgagagctttgaa

SEQ ID NO: 82780 - DNA, 20 bp, Artificial Sequence
  Description of Artificial Sequence: Synthetic oligonucleotide
  Target: ATXN1; (-) strand; PAM type: NRG; PAM sequence: AGG
tgacaatttgagagctttga

SEQ ID NO: 82781 - DNA, 20 bp, Artificial Sequence
  Description of Artificial Sequence: Synthetic oligonucleotide
  Target: ATXN1; (-) strand; PAM type: NRG; PAM sequence: AAG
gtgacaatttgagagctttg

SEQ ID NO: 82782 - DNA, 20 bp, Artificial Sequence
  Description of Artificial Sequence: Synthetic oligonucleotide
  Target: ATXN1; (-) strand; PAM type: NRG; PAM sequence: GAG
cttctttagtgacaatttga

SEQ ID NO: 82783 - DNA, 20 bp, Artificial Sequence
  Description of Artificial Sequence: Synthetic oligonucleotide
  Target: ATXN1; (-) strand; PAM type: NRG; PAM sequence: GAG
cccttctttagtgacaattt

SEQ ID NO: 82784 - DNA, 20 bp, Artificial Sequence
  Description of Artificial Sequence: Synthetic oligonucleotide
  Target: ATXN1; (-) strand; PAM type: NRG; PAM sequence: TAG
acatggtaggtccccttctt

SEQ ID NO: 82785 - DNA, 20 bp, Artificial Sequence
  Description of Artificial Sequence: Synthetic oligonucleotide
  Target: ATXN1; (-) strand; PAM type: NRG; PAM sequence: AGG
cagatgctgatttacatggt

SEQ ID NO: 82786 - DNA, 20 bp, Artificial Sequence
  Description of Artificial Sequence: Synthetic oligonucleotide
  Target: ATXN1; (-) strand; PAM type: NRG; PAM sequence: TAG
acagatgctgatttacatgg

SEQ ID NO: 82787 - DNA, 20 bp, Artificial Sequence
  Description of Artificial Sequence: Synthetic oligonucleotide
  Target: ATXN1; (-) strand; PAM type: NRG; PAM sequence: TGG
aaaacagatgctgatttaca

SEQ ID NO: 82788 - DNA, 20 bp, Artificial Sequence
  Description of Artificial Sequence: Synthetic oligonucleotide
  Target: ATXN1; (-) strand; PAM type: NRG; PAM sequence: CAG
tctaacaggcatcatcaaaa

SEQ ID NO: 82789 - DNA, 20 bp, Artificial Sequence
  Description of Artificial Sequence: Synthetic oligonucleotide
  Target: ATXN1; (-) strand; PAM type: NRG; PAM sequence: AGG
gcaatgtactttcttctaac

SEQ ID NO: 82790 - DNA, 20 bp, Artificial Sequence
  Description of Artificial Sequence: Synthetic oligonucleotide
  Target: ATXN1; (-) strand; PAM type: NRG; PAM sequence: CAG
tgcaatgtactttcttctaa

SEQ ID NO: 82791 - DNA, 20 bp, Artificial Sequence
  Description of Artificial Sequence: Synthetic oligonucleotide
  Target: ATXN1; (-) strand; PAM type: NRG; PAM sequence: AGG
gagtaaaaccacacccattc

SEQ ID NO: 82792 - DNA, 20 bp, Artificial Sequence
  Description of Artificial Sequence: Synthetic oligonucleotide
  Target: ATXN1; (-) strand; PAM type: NRG; PAM sequence: CAG
tgagtaaaaccacacccatt

SEQ ID NO: 82793 - DNA, 20 bp, Artificial Sequence
  Description of Artificial Sequence: Synthetic oligonucleotide
  Target: ATXN1; (-) strand; PAM type: NRG; PAM sequence: GAG
gtgtggttttgtatagctgt

SEQ ID NO: 82794 - DNA, 20 bp, Artificial Sequence
  Description of Artificial Sequence: Synthetic oligonucleotide
  Target: ATXN1; (-) strand; PAM type: NRG; PAM sequence: TAG
agaagctgtgtggttttgta

SEQ ID NO: 82795 - DNA, 20 bp, Artificial Sequence
  Description of Artificial Sequence: Synthetic oligonucleotide
  Target: ATXN1; (-) strand; PAM type: NRG; PAM sequence: TGG
agtccttcagagaagctgtg

SEQ ID NO: 82796 - DNA, 20 bp, Artificial Sequence
  Description of Artificial Sequence: Synthetic oligonucleotide
  Target: ATXN1; (-) strand; PAM type: NRG; PAM sequence: AAG
attgtctaagtccttcagag

SEQ ID NO: 82797 - DNA, 20 bp, Artificial Sequence
  Description of Artificial Sequence: Synthetic oligonucleotide
  Target: ATXN1; (-) strand; PAM type: NRG; PAM sequence: GAG
atgattgtctaagtccttca

SEQ ID NO: 82798 - DNA, 20 bp, Artificial Sequence
  Description of Artificial Sequence: Synthetic oligonucleotide
  Target: ATXN1; (-) strand; PAM type: NRG; PAM sequence: CAG
taatgattgtctaagtcctt

SEQ ID NO: 82799 - DNA, 20 bp, Artificial Sequence
  Description of Artificial Sequence: Synthetic oligonucleotide
  Target: ATXN1; (-) strand; PAM type: NRG; PAM sequence: AAG
tcacaggctaatgattgtct

SEQ ID NO: 82800 - DNA, 20 bp, Artificial Sequence
  Description of Artificial Sequence: Synthetic oligonucleotide
  Target: ATXN1; (-) strand; PAM type: NRG; PAM sequence: AGG
cctcttgctgatgctatcac

SEQ ID NO: 82801 - DNA, 20 bp, Artificial Sequence
  Description of Artificial Sequence: Synthetic oligonucleotide
  Target: ATXN1; (-) strand; PAM type: NRG; PAM sequence: CAG
tcctcttgctgatgctatca

SEQ ID NO: 82802 - DNA, 20 bp, Artificial Sequence
  Description of Artificial Sequence: Synthetic oligonucleotide
  Target: ATXN1; (-) strand; PAM type: NRG; PAM sequence: CAG
taagccagtgttcggtaaag

SEQ ID NO: 82803 - DNA, 20 bp, Artificial Sequence
  Description of Artificial Sequence: Synthetic oligonucleotide
  Target: ATXN1; (-) strand; PAM type: NRG; PAM sequence: AAG
acttaagccagtgttcggta

SEQ ID NO: 82804 - DNA, 20 bp, Artificial Sequence
  Description of Artificial Sequence: Synthetic oligonucleotide
  Target: ATXN1; (-) strand; PAM type: NRG; PAM sequence: CGG
caggtacttaagccagtgtt

SEQ ID NO: 82805 - DNA, 20 bp, Artificial Sequence
  Description of Artificial Sequence: Synthetic oligonucleotide
  Target: ATXN1; (-) strand; PAM type: NRG; PAM sequence: CAG
ttcccttcaggtacttaagc

SEQ ID NO: 82806 - DNA, 20 bp, Artificial Sequence
  Description of Artificial Sequence: Synthetic oligonucleotide
  Target: ATXN1; (-) strand; PAM type: NRG; PAM sequence: AAG
gtagttcccttcaggtactt

SEQ ID NO: 82807 - DNA, 20 bp, Artificial Sequence
  Description of Artificial Sequence: Synthetic oligonucleotide
  Target: ATXN1; (-) strand; PAM type: NRG; PAM sequence: AGG
agaggagtgtagttcccttc

SEQ ID NO: 82808 - DNA, 20 bp, Artificial Sequence
  Description of Artificial Sequence: Synthetic oligonucleotide
  Target: ATXN1; (-) strand; PAM type: NRG; PAM sequence: CAG
tagaggagtgtagttccctt

SEQ ID NO: 82809 - DNA, 20 bp, Artificial Sequence
  Description of Artificial Sequence: Synthetic oligonucleotide
  Target: ATXN1; (-) strand; PAM type: NRG; PAM sequence: TAG
ctttccagcttagaggagtg

SEQ ID NO: 82810 - DNA, 20 bp, Artificial Sequence
  Description of Artificial Sequence: Synthetic oligonucleotide
  Target: ATXN1; (-) strand; PAM type: NRG; PAM sequence: GAG
cagtgctttccagcttagag

SEQ ID NO: 82811 - DNA, 20 bp, Artificial Sequence
  Description of Artificial Sequence: Synthetic oligonucleotide
  Target: ATXN1; (-) strand; PAM type: NRG; PAM sequence: AGG
cgcagtgctttccagcttag

SEQ ID NO: 82812 - DNA, 20 bp, Artificial Sequence
  Description of Artificial Sequence: Synthetic oligonucleotide
  Target: ATXN1; (-) strand; PAM type: NRG; PAM sequence: GAG
tcgcagtgctttccagctta

SEQ ID NO: 82813 - DNA, 20 bp, Artificial Sequence
  Description of Artificial Sequence: Synthetic oligonucleotide
  Target: ATXN1; (-) strand; PAM type: NRG; PAM sequence: TAG
tctcgcagtgctttccagct

SEQ ID NO: 82814 - DNA, 20 bp, Artificial Sequence
  Description of Artificial Sequence: Synthetic oligonucleotide
  Target: ATXN1; (-) strand; PAM type: NRG; PAM sequence: CAG
aaagctctcgcagtgctttc

SEQ ID NO: 82815 - DNA, 20 bp, Artificial Sequence
  Description of Artificial Sequence: Synthetic oligonucleotide
  Target: ATXN1; (-) strand; PAM type: NRG; PAM sequence: CAG
ccatcgttagaaagctctcg

SEQ ID NO: 82816 - DNA, 20 bp, Artificial Sequence
  Description of Artificial Sequence: Synthetic oligonucleotide
  Target: ATXN1; (-) strand; PAM type: NRG; PAM sequence: AAG
cactaaagaccatcgttaga

SEQ ID NO: 82817 - DNA, 20 bp, Artificial Sequence
  Description of Artificial Sequence: Synthetic oligonucleotide
  Target: ATXN1; (-) strand; PAM type: NRG; PAM sequence: TAG
cccccactaaagaccatcgt

SEQ ID NO: 82818 - DNA, 20 bp, Artificial Sequence
  Description of Artificial Sequence: Synthetic oligonucleotide
  Target: ATXN1; (-) strand; PAM type: NRG; PAM sequence: AAG
ccagtccagtacccccacta

SEQ ID NO: 82819 - DNA, 20 bp, Artificial Sequence
  Description of Artificial Sequence: Synthetic oligonucleotide
  Target: ATXN1; (-) strand; PAM type: NRG; PAM sequence: CAG
aaataggaaaagcgccagtc

SEQ ID NO: 82820 - DNA, 20 bp, Artificial Sequence
  Description of Artificial Sequence: Synthetic oligonucleotide
  Target: ATXN1; (-) strand; PAM type: NRG; PAM sequence: CAG
gatgtaaataggaaaagcgc

SEQ ID NO: 82821 - DNA, 20 bp, Artificial Sequence
  Description of Artificial Sequence: Synthetic oligonucleotide
  Target: ATXN1; (-) strand; PAM type: NRG; PAM sequence: AAG
ggaacagatgtaaataggaa

SEQ ID NO: 82822 - DNA, 20 bp, Artificial Sequence
  Description of Artificial Sequence: Synthetic oligonucleotide
  Target: ATXN1; (-) strand; PAM type: NRG; PAM sequence: AGG
cttttggaacagatgtaaat

SEQ ID NO: 82823 - DNA, 20 bp, Artificial Sequence
  Description of Artificial Sequence: Synthetic oligonucleotide
  Target: ATXN1; (-) strand; PAM type: NRG; PAM sequence: TAG
gcttttggaacagatgtaaa

SEQ ID NO: 82824 - DNA, 20 bp, Artificial Sequence
  Description of Artificial Sequence: Synthetic oligonucleotide
  Target: ATXN1; (-) strand; PAM type: NRG; PAM sequence: CAG
cataggtactgcttttggaa

SEQ ID NO: 82825 - DNA, 20 bp, Artificial Sequence
  Description of Artificial Sequence: Synthetic oligonucleotide
  Target: ATXN1; (-) strand; PAM type: NRG; PAM sequence: TGG
taaatcataggtactgcttt

SEQ ID NO: 82826 - DNA, 20 bp, Artificial Sequence
  Description of Artificial Sequence: Synthetic oligonucleotide
  Target: ATXN1; (-) strand; PAM type: NRG; PAM sequence: AGG
caaacagccacctaaatcat

SEQ ID NO: 82827 - DNA, 20 bp, Artificial Sequence
  Description of Artificial Sequence: Synthetic oligonucleotide
  Target: ATXN1; (-) strand; PAM type: NRG; PAM sequence: TAG
ccaaacagccacctaaatca

SEQ ID NO: 82828 - DNA, 20 bp, Artificial Sequence
  Description of Artificial Sequence: Synthetic oligonucleotide
  Target: ATXN1; (-) strand; PAM type: NRG; PAM sequence: CAG
agaggtacatgatttccaaa

SEQ ID NO: 82829 - DNA, 20 bp, Artificial Sequence
  Description of Artificial Sequence: Synthetic oligonucleotide
  Target: ATXN1; (-) strand; PAM type: NRG; PAM sequence: AGG
taccgtgaggcatccttgag

SEQ ID NO: 82830 - DNA, 20 bp, Artificial Sequence
  Description of Artificial Sequence: Synthetic oligonucleotide
  Target: ATXN1; (-) strand; PAM type: NRG; PAM sequence: GAG
ttaccgtgaggcatccttga

SEQ ID NO: 82831 - DNA, 20 bp, Artificial Sequence
  Description of Artificial Sequence: Synthetic oligonucleotide
  Target: ATXN1; (-) strand; PAM type: NRG; PAM sequence: GAG
gtttaccgtgaggcatcctt

SEQ ID NO: 82832 - DNA, 20 bp, Artificial Sequence
  Description of Artificial Sequence: Synthetic oligonucleotide
  Target: ATXN1; (-) strand; PAM type: NRG; PAM sequence: AGG
cacttgtatcgtttaccgtg

SEQ ID NO: 82833 - DNA, 20 bp, Artificial Sequence
  Description of Artificial Sequence: Synthetic oligonucleotide
  Target: ATXN1; (-) strand; PAM type: NRG; PAM sequence: GAG
tcacttgtatcgtttaccgt

SEQ ID NO: 82834 - DNA, 20 bp, Artificial Sequence
  Description of Artificial Sequence: Synthetic oligonucleotide
  Target: ATXN1; (-) strand; PAM type: NRG; PAM sequence: TAG
taaaagagcatttgtctagt

SEQ ID NO: 82835 - DNA, 20 bp, Artificial Sequence
  Description of Artificial Sequence: Synthetic oligonucleotide
  Target: ATXN1; (-) strand; PAM type: NRG; PAM sequence: TAG
attctaaaagagcatttgtc

SEQ ID NO: 82836 - DNA, 20 bp, Artificial Sequence
  Description of Artificial Sequence: Synthetic oligonucleotide
  Target: ATXN1; (-) strand; PAM type: NRG; PAM sequence: GAG
agaaaaaaatgattctaaaa

SEQ ID NO: 82837 - DNA, 20 bp, Artificial Sequence
  Description of Artificial Sequence: Synthetic oligonucleotide
  Target: ATXN1; (-) strand; PAM type: NRG; PAM sequence: AAG
acagaaaaaaatgattctaa

SEQ ID NO: 82838 - DNA, 20 bp, Artificial Sequence
  Description of Artificial Sequence: Synthetic oligonucleotide
  Target: ATXN1; (-) strand; PAM type: NRG; PAM sequence: CAG
aaccatccatggtaggaaaa

SEQ ID NO: 82839 - DNA, 20 bp, Artificial Sequence
  Description of Artificial Sequence: Synthetic oligonucleotide
  Target: ATXN1; (-) strand; PAM type: NRG; PAM sequence: AGG
tgcaagtaaccatccatggt

SEQ ID NO: 82840 - DNA, 20 bp, Artificial Sequence
  Description of Artificial Sequence: Synthetic oligonucleotide
  Target: ATXN1; (-) strand; PAM type: NRG; PAM sequence: TAG
ttgcaagtaaccatccatgg

SEQ ID NO: 82841 - DNA, 20 bp, Artificial Sequence
  Description of Artificial Sequence: Synthetic oligonucleotide
  Target: ATXN1; (-) strand; PAM type: NRG; PAM sequence: TGG
tccttgcaagtaaccatcca

SEQ ID NO: 82842 - DNA, 20 bp, Artificial Sequence
  Description of Artificial Sequence: Synthetic oligonucleotide
  Target: ATXN1; (-) strand; PAM type: NRG; PAM sequence: AAG
catgtaaactatttccttgc

SEQ ID NO: 82843 - DNA, 20 bp, Artificial Sequence
  Description of Artificial Sequence: Synthetic oligonucleotide
  Target: ATXN1; (-) strand; PAM type: NRG; PAM sequence: TGG
tctgttttggaggtctttag

SEQ ID NO: 82844 - DNA, 20 bp, Artificial Sequence
  Description of Artificial Sequence: Synthetic oligonucleotide
  Target: ATXN1; (-) strand; PAM type: NRG; PAM sequence: TAG
atttctgttttggaggtctt

SEQ ID NO: 82845 - DNA, 20 bp, Artificial Sequence
  Description of Artificial Sequence: Synthetic oligonucleotide
  Target: ATXN1; (-) strand; PAM type: NRG; PAM sequence: AGG
tgttggcatttctgttttgg

SEQ ID NO: 82846 - DNA, 20 bp, Artificial Sequence
  Description of Artificial Sequence: Synthetic oligonucleotide
  Target: ATXN1; (-) strand; PAM type: NRG; PAM sequence: GAG
atgttggcatttctgttttg

SEQ ID NO: 82847 - DNA, 20 bp, Artificial Sequence
  Description of Artificial Sequence: Synthetic oligonucleotide
  Target: ATXN1; (-) strand; PAM type: NRG; PAM sequence: TGG
agatgttggcatttctgttt

SEQ ID NO: 82848 - DNA, 20 bp, Artificial Sequence
  Description of Artificial Sequence: Synthetic oligonucleotide
  Target: ATXN1; (-) strand; PAM type: NRG; PAM sequence: TGG
tttagcaaaatgccagatgt

SEQ ID NO: 82849 - DNA, 20 bp, Artificial Sequence
  Description of Artificial Sequence: Synthetic oligonucleotide
  Target: ATXN1; (-) strand; PAM type: NRG; PAM sequence: CAG
acaggattttagcaaaatgc

SEQ ID NO: 82850 - DNA, 20 bp, Artificial Sequence
  Description of Artificial Sequence: Synthetic oligonucleotide
  Target: ATXN1; (-) strand; PAM type: NRG; PAM sequence: TAG
aattatagagtacaggattt

SEQ ID NO: 82851 - DNA, 20 bp, Artificial Sequence
  Description of Artificial Sequence: Synthetic oligonucleotide
  Target: ATXN1; (-) strand; PAM type: NRG; PAM sequence: AGG
tttaaaaaattatagagtac

SEQ ID NO: 82852 - DNA, 20 bp, Artificial Sequence
  Description of Artificial Sequence: Synthetic oligonucleotide
  Target: ATXN1; (-) strand; PAM type: NRG; PAM sequence: CAG
ttttaaaaaattatagagta

SEQ ID NO: 82853 - DNA, 20 bp, Artificial Sequence
  Description of Artificial Sequence: Synthetic oligonucleotide
  Target: ATXN1; (-) strand; PAM type: NRG; PAM sequence: GAG
gagatttttaaaaaattata

SEQ ID NO: 82854 - DNA, 20 bp, Artificial Sequence
  Description of Artificial Sequence: Synthetic oligonucleotide
  Target: ATXN1; (-) strand; PAM type: NRG; PAM sequence: TAG
gcgagatttttaaaaaatta

SEQ ID NO: 82855 - DNA, 20 bp, Artificial Sequence
  Description of Artificial Sequence: Synthetic oligonucleotide
  Target: ATXN1; (-) strand; PAM type: NRG; PAM sequence: GAG
gtggaggagtaatgaggggc

SEQ ID NO: 82856 - DNA, 20 bp, Artificial Sequence
  Description of Artificial Sequence: Synthetic oligonucleotide
  Target: ATXN1; (-) strand; PAM type: NRG; PAM sequence: GGG
tcaggtggaggagtaatgag

SEQ ID NO: 82857 - DNA, 20 bp, Artificial Sequence
  Description of Artificial Sequence: Synthetic oligonucleotide
  Target: ATXN1; (-) strand; PAM type: NRG; PAM sequence: GGG
gtcaggtggaggagtaatga

SEQ ID NO: 82858 - DNA, 20 bp, Artificial Sequence
  Description of Artificial Sequence: Synthetic oligonucleotide
  Target: ATXN1; (-) strand; PAM type: NRG; PAM sequence: AGG
tgtcaggtggaggagtaatg

SEQ ID NO: 82859 - DNA, 20 bp, Artificial Sequence
  Description of Artificial Sequence: Synthetic oligonucleotide
  Target: ATXN1; (-) strand; PAM type: NRG; PAM sequence: GAG
atgtcaggtggaggagtaat

SEQ ID NO: 82860 - DNA, 20 bp, Artificial Sequence
  Description of Artificial Sequence: Synthetic oligonucleotide
  Target: ATXN1; (-) strand; PAM type: NRG; PAM sequence: GAG
taaaaggatgtcaggtggag

SEQ ID NO: 82861 - DNA, 20 bp, Artificial Sequence
  Description of Artificial Sequence: Synthetic oligonucleotide
  Target: ATXN1; (-) strand; PAM type: NRG; PAM sequence: AGG
tctaaaaggatgtcaggtgg

SEQ ID NO: 82862 - DNA, 20 bp, Artificial Sequence
  Description of Artificial Sequence: Synthetic oligonucleotide
  Target: ATXN1; (-) strand; PAM type: NRG; PAM sequence: GAG
gtctaaaaggatgtcaggtg

SEQ ID NO: 82863 - DNA, 20 bp, Artificial Sequence
  Description of Artificial Sequence: Synthetic oligonucleotide
  Target: ATXN1; (-) strand; PAM type: NRG; PAM sequence: TGG
ttgtctaaaaggatgtcagg

SEQ ID NO: 82864 - DNA, 20 bp, Artificial Sequence
  Description of Artificial Sequence: Synthetic oligonucleotide
  Target: ATXN1; (-) strand; PAM type: NRG; PAM sequence: AGG
cctttgtctaaaaggatgtc

SEQ ID NO: 82865 - DNA, 20 bp, Artificial Sequence
  Description of Artificial Sequence: Synthetic oligonucleotide
  Target: ATXN1; (-) strand; PAM type: NRG; PAM sequence: CAG
gcctttgtctaaaaggatgt

SEQ ID NO: 82866 - DNA, 20 bp, Artificial Sequence
  Description of Artificial Sequence: Synthetic oligonucleotide
  Target: ATXN1; (-) strand; PAM type: NRG; PAM sequence: AGG
actttgagcctttgtctaaa

SEQ ID NO: 82867 - DNA, 20 bp, Artificial Sequence
  Description of Artificial Sequence: Synthetic oligonucleotide
  Target: ATXN1; (-) strand; PAM type: NRG; PAM sequence: AAG
gactttgagcctttgtctaa

SEQ ID NO: 82868 - DNA, 20 bp, Artificial Sequence
  Description of Artificial Sequence: Synthetic oligonucleotide
  Target: ATXN1; (-) strand; PAM type: NRG; PAM sequence: GAG
ttgtctgcataattgacttt

SEQ ID NO: 82869 - DNA, 20 bp, Artificial Sequence
  Description of Artificial Sequence: Synthetic oligonucleotide
  Target: ATXN1; (-) strand; PAM type: NRG; PAM sequence: AGG
ttgtcagctacagaagagaa

SEQ ID NO: 82870 - DNA, 20 bp, Artificial Sequence
  Description of Artificial Sequence: Synthetic oligonucleotide
  Target: ATXN1; (-) strand; PAM type: NRG; PAM sequence: AAG
gttgtcagctacagaagaga

SEQ ID NO: 82871 - DNA, 20 bp, Artificial Sequence
  Description of Artificial Sequence: Synthetic oligonucleotide
  Target: ATXN1; (-) strand; PAM type: NRG; PAM sequence: GAG
ccaggttgtcagctacagaa

SEQ ID NO: 82872 - DNA, 20 bp, Artificial Sequence
  Description of Artificial Sequence: Synthetic oligonucleotide
  Target: ATXN1; (-) strand; PAM type: NRG; PAM sequence: AAG
agccaggttgtcagctacag

SEQ ID NO: 82873 - DNA, 20 bp, Artificial Sequence
  Description of Artificial Sequence: Synthetic oligonucleotide
  Target: ATXN1; (-) strand; PAM type: NRG; PAM sequence: CAG
aagagccaggttgtcagcta

SEQ ID NO: 82874 - DNA, 20 bp, Artificial Sequence
  Description of Artificial Sequence: Synthetic oligonucleotide
  Target: ATXN1; (-) strand; PAM type: NRG; PAM sequence: CAG
gaaggcaagagccaggttgt

SEQ ID NO: 82875 - DNA, 20 bp, Artificial Sequence
  Description of Artificial Sequence: Synthetic oligonucleotide
  Target: ATXN1; (-) strand; PAM type: NRG; PAM sequence: AGG
ggttgcagaaggcaagagcc

SEQ ID NO: 82876 - DNA, 20 bp, Artificial Sequence
  Description of Artificial Sequence: Synthetic oligonucleotide
  Target: ATXN1; (-) strand; PAM type: NRG; PAM sequence: CAG
gggttgcagaaggcaagagc

SEQ ID NO: 82877 - DNA, 20 bp, Artificial Sequence
  Description of Artificial Sequence: Synthetic oligonucleotide
  Target: ATXN1; (-) strand; PAM type: NRG; PAM sequence: GAG
ttttgggttgcagaaggcaa

SEQ ID NO: 82878 - DNA, 20 bp, Artificial Sequence
  Description of Artificial Sequence: Synthetic oligonucleotide
  Target: ATXN1; (-) strand; PAM type: NRG; PAM sequence: AAG
gtttttgggttgcagaaggc

SEQ ID NO: 82879 - DNA, 20 bp, Artificial Sequence
  Description of Artificial Sequence: Synthetic oligonucleotide
  Target: ATXN1; (-) strand; PAM type: NRG; PAM sequence: AGG
ggctgtttttgggttgcaga

SEQ ID NO: 82880 - DNA, 20 bp, Artificial Sequence
  Description of Artificial Sequence: Synthetic oligonucleotide
  Target: ATXN1; (-) strand; PAM type: NRG; PAM sequence: AAG
gggctgtttttgggttgcag

SEQ ID NO: 82881 - DNA, 20 bp, Artificial Sequence
  Description of Artificial Sequence: Synthetic oligonucleotide
  Target: ATXN1; (-) strand; PAM type: NRG; PAM sequence: CAG
cgagggctgtttttgggttg

SEQ ID NO: 82882 - DNA, 20 bp, Artificial Sequence
  Description of Artificial Sequence: Synthetic oligonucleotide
  Target: ATXN1; (-) strand; PAM type: NRG; PAM sequence: GGG
tgggagcgagggctgttttt

SEQ ID NO: 82883 - DNA, 20 bp, Artificial Sequence
  Description of Artificial Sequence: Synthetic oligonucleotide
  Target: ATXN1; (-) strand; PAM type: NRG; PAM sequence: TGG
atgggagcgagggctgtttt

SEQ ID NO: 82884 - DNA, 20 bp, Artificial Sequence
  Description of Artificial Sequence: Synthetic oligonucleotide
  Target: ATXN1; (-) strand; PAM type: NRG; PAM sequence: GGG
tttccatctgatgggagcga

SEQ ID NO: 82885 - DNA, 20 bp, Artificial Sequence
  Description of Artificial Sequence: Synthetic oligonucleotide
  Target: ATXN1; (-) strand; PAM type: NRG; PAM sequence: AGG
ctttccatctgatgggagcg

SEQ ID NO: 82886 - DNA, 20 bp, Artificial Sequence
  Description of Artificial Sequence: Synthetic oligonucleotide
  Target: ATXN1; (-) strand; PAM type: NRG; PAM sequence: GAG
tctttccatctgatgggagc

SEQ ID NO: 82887 - DNA, 20 bp, Artificial Sequence
  Description of Artificial Sequence: Synthetic oligonucleotide
  Target: ATXN1; (-) strand; PAM type: NRG; PAM sequence: GAG
tagttctttccatctgatgg

SEQ ID NO: 82888 - DNA, 20 bp, Artificial Sequence
  Description of Artificial Sequence: Synthetic oligonucleotide
  Target: ATXN1; (-) strand; PAM type: NRG; PAM sequence: GGG
cgtagttctttccatctgat

SEQ ID NO: 82889 - DNA, 20 bp, Artificial Sequence
  Description of Artificial Sequence: Synthetic oligonucleotide
  Target: ATXN1; (-) strand; PAM type: NRG; PAM sequence: TGG
gcgtagttctttccatctga

SEQ ID NO: 82890 - DNA, 20 bp, Artificial Sequence
  Description of Artificial Sequence: Synthetic oligonucleotide
  Target: ATXN1; (-) strand; PAM type: NRG; PAM sequence: TAG
ttactagattttcctctgcg

SEQ ID NO: 82891 - DNA, 20 bp, Artificial Sequence
  Description of Artificial Sequence: Synthetic oligonucleotide
  Target: ATXN1; (-) strand; PAM type: NRG; PAM sequence: TAG
gtgcttcatggagaccttac

SEQ ID NO: 82892 - DNA, 20 bp, Artificial Sequence
  Description of Artificial Sequence: Synthetic oligonucleotide
  Target: ATXN1; (-) strand; PAM type: NRG; PAM sequence: GAG
cttttaatatgtgcttcatg

SEQ ID NO: 82893 - DNA, 20 bp, Artificial Sequence
  Description of Artificial Sequence: Synthetic oligonucleotide
  Target: ATXN1; (-) strand; PAM type: NRG; PAM sequence: TGG
ggcttttaatatgtgcttca

SEQ ID NO: 82894 - DNA, 20 bp, Artificial Sequence
  Description of Artificial Sequence: Synthetic oligonucleotide
  Target: ATXN1; (-) strand; PAM type: NRG; PAM sequence: AGG
agccatgttaagggcacatt

SEQ ID NO: 82895 - DNA, 20 bp, Artificial Sequence
  Description of Artificial Sequence: Synthetic oligonucleotide
  Target: ATXN1; (-) strand; PAM type: NRG; PAM sequence: TAG
aagccatgttaagggcacat

SEQ ID NO: 82896 - DNA, 20 bp, Artificial Sequence
  Description of Artificial Sequence: Synthetic oligonucleotide
  Target: ATXN1; (-) strand; PAM type: NRG; PAM sequence: GGG
gtttgctgaagccatgttaa

SEQ ID NO: 82897 - DNA, 20 bp, Artificial Sequence
  Description of Artificial Sequence: Synthetic oligonucleotide
  Target: ATXN1; (-) strand; PAM type: NRG; PAM sequence: AGG
agtttgctgaagccatgtta

SEQ ID NO: 82898 - DNA, 20 bp, Artificial Sequence
  Description of Artificial Sequence: Synthetic oligonucleotide
  Target: ATXN1; (-) strand; PAM type: NRG; PAM sequence: AAG
cagtttgctgaagccatgtt

SEQ ID NO: 82899 - DNA, 20 bp, Artificial Sequence
  Description of Artificial Sequence: Synthetic oligonucleotide
  Target: ATXN1; (-) strand; PAM type: NRG; PAM sequence: AAG
gaaaaaagcccagtttgctg

SEQ ID NO: 82900 - DNA, 20 bp, Artificial Sequence
  Description of Artificial Sequence: Synthetic oligonucleotide
  Target: ATXN1; (-) strand; PAM type: NRG; PAM sequence: CAG
ctaagtgaaggaaaaaagcc

SEQ ID NO: 82901 - DNA, 20 bp, Artificial Sequence
  Description of Artificial Sequence: Synthetic oligonucleotide
  Target: ATXN1; (-) strand; PAM type: NRG; PAM sequence: AAG
ctcatctaagtgaaggaaaa

SEQ ID NO: 82902 - DNA, 20 bp, Artificial Sequence
  Description of Artificial Sequence: Synthetic oligonucleotide
  Target: ATXN1; (-) strand; PAM type: NRG; PAM sequence: AGG
tcaaattctcatctaagtga

SEQ ID NO: 82903 - DNA, 20 bp, Artificial Sequence
  Description of Artificial Sequence: Synthetic oligonucleotide
  Target: ATXN1; (-) strand; PAM type: NRG; PAM sequence: AAG
ctcaaattctcatctaagtg

SEQ ID NO: 82904 - DNA, 20 bp, Artificial Sequence
  Description of Artificial Sequence: Synthetic oligonucleotide
  Target: ATXN1; (-) strand; PAM type: NRG; PAM sequence: AAG
ttcttctcaaattctcatct

SEQ ID NO: 82905 - DNA, 20 bp, Artificial Sequence
  Description of Artificial Sequence: Synthetic oligonucleotide
  Target: ATXN1; (-) strand; PAM type: NRG; PAM sequence: TGG
agcagaaaggtattaccgag

SEQ ID NO: 82906 - DNA, 20 bp, Artificial Sequence
  Description of Artificial Sequence: Synthetic oligonucleotide
  Target: ATXN1; (-) strand; PAM type: NRG; PAM sequence: GAG
gcgagcagaaaggtattacc

SEQ ID NO: 82907 - DNA, 20 bp, Artificial Sequence
  Description of Artificial Sequence: Synthetic oligonucleotide
  Target: ATXN1; (-) strand; PAM type: NRG; PAM sequence: AGG
aggaggtttggcgagcagaa

SEQ ID NO: 82908 - DNA, 20 bp, Artificial Sequence
  Description of Artificial Sequence: Synthetic oligonucleotide
  Target: ATXN1; (-) strand; PAM type: NRG; PAM sequence: AAG
aaggaggtttggcgagcaga

SEQ ID NO: 82909 - DNA, 20 bp, Artificial Sequence
  Description of Artificial Sequence: Synthetic oligonucleotide
  Target: ATXN1; (-) strand; PAM type: NRG; PAM sequence: CAG
actaaaggaggtttggcgag

SEQ ID NO: 82910 - DNA, 20 bp, Artificial Sequence
  Description of Artificial Sequence: Synthetic oligonucleotide
  Target: ATXN1; (-) strand; PAM type: NRG; PAM sequence: GAG
ttgactaaaggaggtttggc

SEQ ID NO: 82911 - DNA, 20 bp, Artificial Sequence
  Description of Artificial Sequence: Synthetic oligonucleotide
  Target: ATXN1; (-) strand; PAM type: NRG; PAM sequence: TGG
agttttgactaaaggaggtt

SEQ ID NO: 82912 - DNA, 20 bp, Artificial Sequence
  Description of Artificial Sequence: Synthetic oligonucleotide
  Target: ATXN1; (-) strand; PAM type: NRG; PAM sequence: AGG
tattcagttttgactaaagg

SEQ ID NO: 82913 - DNA, 20 bp, Artificial Sequence
  Description of Artificial Sequence: Synthetic oligonucleotide
  Target: ATXN1; (-) strand; PAM type: NRG; PAM sequence: GAG
ctattcagttttgactaaag

SEQ ID NO: 82914 - DNA, 20 bp, Artificial Sequence
  Description of Artificial Sequence: Synthetic oligonucleotide
  Target: ATXN1; (-) strand; PAM type: NRG; PAM sequence: AGG
ctctattcagttttgactaa

SEQ ID NO: 82915 - DNA, 20 bp, Artificial Sequence
  Description of Artificial Sequence: Synthetic oligonucleotide
  Target: ATXN1; (-) strand; PAM type: NRG; PAM sequence: AAG
tctctattcagttttgacta

SEQ ID NO: 82916 - DNA, 20 bp, Artificial Sequence
  Description of Artificial Sequence: Synthetic oligonucleotide
  Target: ATXN1; (-) strand; PAM type: NRG; PAM sequence: CAG
tcttctcccaggtctctatt

SEQ ID NO: 82917 - DNA, 20 bp, Artificial Sequence
  Description of Artificial Sequence: Synthetic oligonucleotide
  Target: ATXN1; (-) strand; PAM type: NRG; PAM sequence: AGG
ttggagaagtatcttctccc

SEQ ID NO: 82918 - DNA, 20 bp, Artificial Sequence
  Description of Artificial Sequence: Synthetic oligonucleotide
  Target: ATXN1; (-) strand; PAM type: NRG; PAM sequence: CAG
gttggagaagtatcttctcc

SEQ ID NO: 82919 - DNA, 20 bp, Artificial Sequence
  Description of Artificial Sequence: Synthetic oligonucleotide
  Target: ATXN1; (-) strand; PAM type: NRG; PAM sequence: AAG
cttcaagcccagtgttggag

SEQ ID NO: 82920 - DNA, 20 bp, Artificial Sequence
  Description of Artificial Sequence: Synthetic oligonucleotide
  Target: ATXN1; (-) strand; PAM type: NRG; PAM sequence: GAG
caccttcaagcccagtgttg

SEQ ID NO: 82921 - DNA, 20 bp, Artificial Sequence
  Description of Artificial Sequence: Synthetic oligonucleotide
  Target: ATXN1; (-) strand; PAM type: NRG; PAM sequence: TGG
agcaccttcaagcccagtgt

SEQ ID NO: 82922 - DNA, 20 bp, Artificial Sequence
  Description of Artificial Sequence: Synthetic oligonucleotide
  Target: ATXN1; (-) strand; PAM type: NRG; PAM sequence: CAG
aaagcaagcaccttcaagcc

SEQ ID NO: 82923 - DNA, 20 bp, Artificial Sequence
  Description of Artificial Sequence: Synthetic oligonucleotide
  Target: ATXN1; (-) strand; PAM type: NRG; PAM sequence: AAG
gtgaaaaagcaagcaccttc

SEQ ID NO: 82924 - DNA, 20 bp, Artificial Sequence
  Description of Artificial Sequence: Synthetic oligonucleotide
  Target: ATXN1; (-) strand; PAM type: NRG; PAM sequence: AAG
ttcagtttgtgtgaaaaagc

SEQ ID NO: 82925 - DNA, 20 bp, Artificial Sequence
  Description of Artificial Sequence: Synthetic oligonucleotide
  Target: ATXN1; (-) strand; PAM type: NRG; PAM sequence: AAG
tgaattcagtttgtgtgaaa

SEQ ID NO: 82926 - DNA, 20 bp, Artificial Sequence
  Description of Artificial Sequence: Synthetic oligonucleotide
  Target: ATXN1; (-) strand; PAM type: NRG; PAM sequence: CAG
agttgtggcaatcctgaatt

SEQ ID NO: 82927 - DNA, 20 bp, Artificial Sequence
  Description of Artificial Sequence: Synthetic oligonucleotide
  Target: ATXN1; (-) strand; PAM type: NRG; PAM sequence: TGG
agttttgcttggagaagttg

SEQ ID NO: 82928 - DNA, 20 bp, Artificial Sequence
  Description of Artificial Sequence: Synthetic oligonucleotide
  Target: ATXN1; (-) strand; PAM type: NRG; PAM sequence: AAG
tagttcagttttgcttggag

SEQ ID NO: 82929 - DNA, 20 bp, Artificial Sequence
  Description of Artificial Sequence: Synthetic oligonucleotide
  Target: ATXN1; (-) strand; PAM type: NRG; PAM sequence: GAG
gcttagttcagttttgcttg

SEQ ID NO: 82930 - DNA, 20 bp, Artificial Sequence
  Description of Artificial Sequence: Synthetic oligonucleotide
  Target: ATXN1; (-) strand; PAM type: NRG; PAM sequence: TGG
ttgcttagttcagttttgct

SEQ ID NO: 82931 - DNA, 20 bp, Artificial Sequence
  Description of Artificial Sequence: Synthetic oligonucleotide
  Target: ATXN1; (-) strand; PAM type: NRG; PAM sequence: CAG
tatttggctgttgcttagtt

SEQ ID NO: 82932 - DNA, 20 bp, Artificial Sequence
  Description of Artificial Sequence: Synthetic oligonucleotide
  Target: ATXN1; (-) strand; PAM type: NRG; PAM sequence: TAG
tcttttatttggctgttgct

SEQ ID NO: 82933 - DNA, 20 bp, Artificial Sequence
  Description of Artificial Sequence: Synthetic oligonucleotide
  Target: ATXN1; (-) strand; PAM type: NRG; PAM sequence: TGG
acaactttttctcttttatt

SEQ ID NO: 82934 - DNA, 20 bp, Artificial Sequence
  Description of Artificial Sequence: Synthetic oligonucleotide
  Target: ATXN1; (-) strand; PAM type: NRG; PAM sequence: TAG
gtggccatcaggacatttat

SEQ ID NO: 82935 - DNA, 20 bp, Artificial Sequence
  Description of Artificial Sequence: Synthetic oligonucleotide
  Target: ATXN1; (-) strand; PAM type: NRG; PAM sequence: AGG
aaggaaccagcgtggccatc

SEQ ID NO: 82936 - DNA, 20 bp, Artificial Sequence
  Description of Artificial Sequence: Synthetic oligonucleotide
  Target: ATXN1; (-) strand; PAM type: NRG; PAM sequence: CAG
aaaggaaccagcgtggccat

SEQ ID NO: 82937 - DNA, 20 bp, Artificial Sequence
  Description of Artificial Sequence: Synthetic oligonucleotide
  Target: ATXN1; (-) strand; PAM type: NRG; PAM sequence: TGG
agcctagaaaggaaccagcg

SEQ ID NO: 82938 - DNA, 20 bp, Artificial Sequence
  Description of Artificial Sequence: Synthetic oligonucleotide
  Target: ATXN1; (-) strand; PAM type: NRG; PAM sequence: CAG
tagctagcctagaaaggaac

SEQ ID NO: 82939 - DNA, 20 bp, Artificial Sequence
  Description of Artificial Sequence: Synthetic oligonucleotide
  Target: ATXN1; (-) strand; PAM type: NRG; PAM sequence: AGG
gaagcttagctagcctagaa

SEQ ID NO: 82940 - DNA, 20 bp, Artificial Sequence
  Description of Artificial Sequence: Synthetic oligonucleotide
  Target: ATXN1; (-) strand; PAM type: NRG; PAM sequence: AAG
agaagcttagctagcctaga

SEQ ID NO: 82941 - DNA, 20 bp, Artificial Sequence
  Description of Artificial Sequence: Synthetic oligonucleotide
  Target: ATXN1; (-) strand; PAM type: NRG; PAM sequence: TAG
tcacagaagcttagctagcc

SEQ ID NO: 82942 - DNA, 20 bp, Artificial Sequence
  Description of Artificial Sequence: Synthetic oligonucleotide
  Target: ATXN1; (-) strand; PAM type: NRG; PAM sequence: TAG
agaactcacagaagcttagc

SEQ ID NO: 82943 - DNA, 20 bp, Artificial Sequence
  Description of Artificial Sequence: Synthetic oligonucleotide
  Target: ATXN1; (-) strand; PAM type: NRG; PAM sequence: TAG
cagaagaactcacagaagct

SEQ ID NO: 82944 - DNA, 20 bp, Artificial Sequence
  Description of Artificial Sequence: Synthetic oligonucleotide
  Target: ATXN1; (-) strand; PAM type: NRG; PAM sequence: AAG
ccaaacagaagaactcacag

SEQ ID NO: 82945 - DNA, 20 bp, Artificial Sequence
  Description of Artificial Sequence: Synthetic oligonucleotide
  Target: ATXN1; (-) strand; PAM type: NRG; PAM sequence: CAG
aatccaaacagaagaactca

SEQ ID NO: 82946 - DNA, 20 bp, Artificial Sequence
  Description of Artificial Sequence: Synthetic oligonucleotide
  Target: ATXN1; (-) strand; PAM type: NRG; PAM sequence: AAG
ggtagatggaatccaaacag

SEQ ID NO: 82947 - DNA, 20 bp, Artificial Sequence
  Description of Artificial Sequence: Synthetic oligonucleotide
  Target: ATXN1; (-) strand; PAM type: NRG; PAM sequence: CAG
cctggtagatggaatccaaa

SEQ ID NO: 82948 - DNA, 20 bp, Artificial Sequence
  Description of Artificial Sequence: Synthetic oligonucleotide
  Target: ATXN1; (-) strand; PAM type: NRG; PAM sequence: TGG
gtggctccagccctggtaga

SEQ ID NO: 82949 - DNA, 20 bp, Artificial Sequence
  Description of Artificial Sequence: Synthetic oligonucleotide
  Target: ATXN1; (-) strand; PAM type: NRG; PAM sequence: TAG
gctggtggctccagccctgg

SEQ ID NO: 82950 - DNA, 20 bp, Artificial Sequence
  Description of Artificial Sequence: Synthetic oligonucleotide
  Target: ATXN1; (-) strand; PAM type: NRG; PAM sequence: TGG
cttgctggtggctccagccc

SEQ ID NO: 82951 - DNA, 20 bp, Artificial Sequence
  Description of Artificial Sequence: Synthetic oligonucleotide
  Target: ATXN1; (-) strand; PAM type: NRG; PAM sequence: CAG
aatgcccttgctggtggctc

SEQ ID NO: 82952 - DNA, 20 bp, Artificial Sequence
  Description of Artificial Sequence: Synthetic oligonucleotide
  Target: ATXN1; (-) strand; PAM type: NRG; PAM sequence: TGG
ctcctgaatgcccttgctgg

SEQ ID NO: 82953 - DNA, 20 bp, Artificial Sequence
  Description of Artificial Sequence: Synthetic oligonucleotide
  Target: ATXN1; (-) strand; PAM type: NRG; PAM sequence: TGG
cacctcctgaatgcccttgc

SEQ ID NO: 82954 - DNA, 20 bp, Artificial Sequence
  Description of Artificial Sequence: Synthetic oligonucleotide
  Target: ATXN1; (-) strand; PAM type: NRG; PAM sequence: TGG
ttgcagggcgttgctgcttc

SEQ ID NO: 82955 - DNA, 20 bp, Artificial Sequence
  Description of Artificial Sequence: Synthetic oligonucleotide
  Target: ATXN1; (-) strand; PAM type: NRG; PAM sequence: GGG
tgatccaggagagatttgca

SEQ ID NO: 82956 - DNA, 20 bp, Artificial Sequence
  Description of Artificial Sequence: Synthetic oligonucleotide
  Target: ATXN1; (-) strand; PAM type: NRG; PAM sequence: AGG
atgatccaggagagatttgc

SEQ ID NO: 82957 - DNA, 20 bp, Artificial Sequence
  Description of Artificial Sequence: Synthetic oligonucleotide
  Target: ATXN1; (-) strand; PAM type: NRG; PAM sequence: CAG
gatgatccaggagagatttg

SEQ ID NO: 82958 - DNA, 20 bp, Artificial Sequence
  Description of Artificial Sequence: Synthetic oligonucleotide
  Target: ATXN1; (-) strand; PAM type: NRG; PAM sequence: GAG
tggtcttggatgatccagga

SEQ ID NO: 82959 - DNA, 20 bp, Artificial Sequence
  Description of Artificial Sequence: Synthetic oligonucleotide
  Target: ATXN1; (-) strand; PAM type: NRG; PAM sequence: GAG
cctggtcttggatgatccag

SEQ ID NO: 82960 - DNA, 20 bp, Artificial Sequence
  Description of Artificial Sequence: Synthetic oligonucleotide
  Target: ATXN1; (-) strand; PAM type: NRG; PAM sequence: AGG
tgcctggtcttggatgatcc

SEQ ID NO: 82961 - DNA, 20 bp, Artificial Sequence
  Description of Artificial Sequence: Synthetic oligonucleotide
  Target: ATXN1; (-) strand; PAM type: NRG; PAM sequence: CAG
atgcctggtcttggatgatc

SEQ ID NO: 82962 - DNA, 20 bp, Artificial Sequence
  Description of Artificial Sequence: Synthetic oligonucleotide
  Target: ATXN1; (-) strand; PAM type: NRG; PAM sequence: TGG
agcaagggcatgcctggtct

SEQ ID NO: 82963 - DNA, 20 bp, Artificial Sequence
  Description of Artificial Sequence: Synthetic oligonucleotide
  Target: ATXN1; (-) strand; PAM type: NRG; PAM sequence: TGG
tgttccagcaagggcatgcc

SEQ ID NO: 82964 - DNA, 20 bp, Artificial Sequence
  Description of Artificial Sequence: Synthetic oligonucleotide
  Target: ATXN1; (-) strand; PAM type: NRG; PAM sequence: GGG
tccgcctcttgttccagcaa

SEQ ID NO: 82965 - DNA, 20 bp, Artificial Sequence
  Description of Artificial Sequence: Synthetic oligonucleotide
  Target: ATXN1; (-) strand; PAM type: NRG; PAM sequence: AGG
gtccgcctcttgttccagca

SEQ ID NO: 82966 - DNA, 20 bp, Artificial Sequence
  Description of Artificial Sequence: Synthetic oligonucleotide
  Target: ATXN1; (-) strand; PAM type: NRG; PAM sequence: AAG
cgtccgcctcttgttccagc

SEQ ID NO: 82967 - DNA, 20 bp, Artificial Sequence
  Description of Artificial Sequence: Synthetic oligonucleotide
  Target: ATXN1; (-) strand; PAM type: NRG; PAM sequence: CAG
cttccgtccgcctcttgttc

SEQ ID NO: 82968 - DNA, 20 bp, Artificial Sequence
  Description of Artificial Sequence: Synthetic oligonucleotide
  Target: ATXN1; (-) strand; PAM type: NRG; PAM sequence: TGG
cagactgcagtggtgacact

SEQ ID NO: 82969 - DNA, 20 bp, Artificial Sequence
  Description of Artificial Sequence: Synthetic oligonucleotide
  Target: ATXN1; (-) strand; PAM type: NRG; PAM sequence: TGG
ccaatgttagcagactgcag

SEQ ID NO: 82970 - DNA, 20 bp, Artificial Sequence
  Description of Artificial Sequence: Synthetic oligonucleotide
  Target: ATXN1; (-) strand; PAM type: NRG; PAM sequence: CAG
aatccaatgttagcagactg

SEQ ID NO: 82971 - DNA, 20 bp, Artificial Sequence
  Description of Artificial Sequence: Synthetic oligonucleotide
  Target: ATXN1; (-) strand; PAM type: NRG; PAM sequence: CAG
ggatttgaatccaatgttag

SEQ ID NO: 82972 - DNA, 20 bp, Artificial Sequence
  Description of Artificial Sequence: Synthetic oligonucleotide
  Target: ATXN1; (-) strand; PAM type: NRG; PAM sequence: TAG
tcaggatttgaatccaatgt

SEQ ID NO: 82973 - DNA, 20 bp, Artificial Sequence
  Description of Artificial Sequence: Synthetic oligonucleotide
  Target: ATXN1; (-) strand; PAM type: NRG; PAM sequence: AGG
cagtgcacagtggtggattc

SEQ ID NO: 82974 - DNA, 20 bp, Artificial Sequence
  Description of Artificial Sequence: Synthetic oligonucleotide
  Target: ATXN1; (-) strand; PAM type: NRG; PAM sequence: CAG
acagtgcacagtggtggatt

SEQ ID NO: 82975 - DNA, 20 bp, Artificial Sequence
  Description of Artificial Sequence: Synthetic oligonucleotide
  Target: ATXN1; (-) strand; PAM type: NRG; PAM sequence: TGG
gcacctacagtgcacagtgg

SEQ ID NO: 82976 - DNA, 20 bp, Artificial Sequence
  Description of Artificial Sequence: Synthetic oligonucleotide
  Target: ATXN1; (-) strand; PAM type: NRG; PAM sequence: TGG
aaagcacctacagtgcacag

SEQ ID NO: 82977 - DNA, 20 bp, Artificial Sequence
  Description of Artificial Sequence: Synthetic oligonucleotide
  Target: ATXN1; (-) strand; PAM type: NRG; PAM sequence: CAG
atcaaagcacctacagtgca

SEQ ID NO: 82978 - DNA, 20 bp, Artificial Sequence
  Description of Artificial Sequence: Synthetic oligonucleotide
  Target: ATXN1; (-) strand; PAM type: NRG; PAM sequence: CAG
gacgcacatcaaagcaccta

SEQ ID NO: 82979 - DNA, 20 bp, Artificial Sequence
  Description of Artificial Sequence: Synthetic oligonucleotide
  Target: ATXN1; (-) strand; PAM type: NRG; PAM sequence: AAG
gctctagtggacgcacatca

SEQ ID NO: 82980 - DNA, 20 bp, Artificial Sequence
  Description of Artificial Sequence: Synthetic oligonucleotide
  Target: ATXN1; (-) strand; PAM type: NRG; PAM sequence: TGG
aggatcaagtttagctctag

SEQ ID NO: 82981 - DNA, 20 bp, Artificial Sequence
  Description of Artificial Sequence: Synthetic oligonucleotide
  Target: ATXN1; (-) strand; PAM type: NRG; PAM sequence: TAG
aaaaggatcaagtttagctc

SEQ ID NO: 82982 - DNA, 20 bp, Artificial Sequence
  Description of Artificial Sequence: Synthetic oligonucleotide
  Target: ATXN1; (-) strand; PAM type: NRG; PAM sequence: TAG
ctgctgaaaaggatcaagtt

SEQ ID NO: 82983 - DNA, 20 bp, Artificial Sequence
  Description of Artificial Sequence: Synthetic oligonucleotide
  Target: ATXN1; (-) strand; PAM type: NRG; PAM sequence: AAG
tcccgctgctgaaaaggatc

SEQ ID NO: 82984 - DNA, 20 bp, Artificial Sequence
  Description of Artificial Sequence: Synthetic oligonucleotide
  Target: ATXN1; (-) strand; PAM type: NRG; PAM sequence: AGG
gagcggtcccgctgctgaaa

SEQ ID NO: 82985 - DNA, 20 bp, Artificial Sequence
  Description of Artificial Sequence: Synthetic oligonucleotide
  Target: ATXN1; (-) strand; PAM type: NRG; PAM sequence: AAG
agagcggtcccgctgctgaa

SEQ ID NO: 82986 - DNA, 20 bp, Artificial Sequence
  Description of Artificial Sequence: Synthetic oligonucleotide
  Target: ATXN1; (-) strand; PAM type: NRG; PAM sequence: CGG
cagttttggtggcagaagag

SEQ ID NO: 82987 - DNA, 20 bp, Artificial Sequence
  Description of Artificial Sequence: Synthetic oligonucleotide
  Target: ATXN1; (-) strand; PAM type: NRG; PAM sequence: GAG
tgtcagttttggtggcagaa

SEQ ID NO: 82988 - DNA, 20 bp, Artificial Sequence
  Description of Artificial Sequence: Synthetic oligonucleotide
  Target: ATXN1; (-) strand; PAM type: NRG; PAM sequence: AAG
gttgtcagttttggtggcag

SEQ ID NO: 82989 - DNA, 20 bp, Artificial Sequence
  Description of Artificial Sequence: Synthetic oligonucleotide
  Target: ATXN1; (-) strand; PAM type: NRG; PAM sequence: CAG
caggttgtcagttttggtgg

SEQ ID NO: 82990 - DNA, 20 bp, Artificial Sequence
  Description of Artificial Sequence: Synthetic oligonucleotide
  Target: ATXN1; (-) strand; PAM type: NRG; PAM sequence: TGG
tcgcaggttgtcagttttgg

SEQ ID NO: 82991 - DNA, 20 bp, Artificial Sequence
  Description of Artificial Sequence: Synthetic oligonucleotide
  Target: ATXN1; (-) strand; PAM type: NRG; PAM sequence: TGG
gcctcgcaggttgtcagttt

SEQ ID NO: 82992 - DNA, 20 bp, Artificial Sequence
  Description of Artificial Sequence: Synthetic oligonucleotide
  Target: ATXN1; (-) strand; PAM type: NRG; PAM sequence: CAG
tgttaggcctcgcaggttgt

SEQ ID NO: 82993 - DNA, 20 bp, Artificial Sequence
  Description of Artificial Sequence: Synthetic oligonucleotide
  Target: ATXN1; (-) strand; PAM type: NRG; PAM sequence: AGG
tttcagctgttaggcctcgc

SEQ ID NO: 82994 - DNA, 20 bp, Artificial Sequence
  Description of Artificial Sequence: Synthetic oligonucleotide
  Target: ATXN1; (-) strand; PAM type: NRG; PAM sequence: CAG
ctttcagctgttaggcctcg

SEQ ID NO: 82995 - DNA, 20 bp, Artificial Sequence
  Description of Artificial Sequence: Synthetic oligonucleotide
  Target: ATXN1; (-) strand; PAM type: NRG; PAM sequence: AGG
tggtatttctttcagctgtt

SEQ ID NO: 82996 - DNA, 20 bp, Artificial Sequence
  Description of Artificial Sequence: Synthetic oligonucleotide
  Target: ATXN1; (-) strand; PAM type: NRG; PAM sequence: TAG
gtggtatttctttcagctgt

SEQ ID NO: 82997 - DNA, 20 bp, Artificial Sequence
  Description of Artificial Sequence: Synthetic oligonucleotide
  Target: ATXN1; (-) strand; PAM type: NRG; PAM sequence: CAG
attctgagtggtatttcttt

SEQ ID NO: 82998 - DNA, 20 bp, Artificial Sequence
  Description of Artificial Sequence: Synthetic oligonucleotide
  Target: ATXN1; (-) strand; PAM type: NRG; PAM sequence: TGG
ccttggcagtttattctgag

SEQ ID NO: 82999 - DNA, 20 bp, Artificial Sequence
  Description of Artificial Sequence: Synthetic oligonucleotide
  Target: ATXN1; (-) strand; PAM type: NRG; PAM sequence: GAG
tacccttggcagtttattct

SEQ ID NO: 83000 - DNA, 20 bp, Artificial Sequence
  Description of Artificial Sequence: Synthetic oligonucleotide
  Target: ATXN1; (-) strand; PAM type: NRG; PAM sequence: CAG
gccacacctgctacccttgg

SEQ ID NO: 83001 - DNA, 20 bp, Artificial Sequence
  Description of Artificial Sequence: Synthetic oligonucleotide
  Target: ATXN1; (-) strand; PAM type: NRG; PAM sequence: TGG
aaagccacacctgctaccct

SEQ ID NO: 83002 - DNA, 20 bp, Artificial Sequence
  Description of Artificial Sequence: Synthetic oligonucleotide
  Target: ATXN1; (-) strand; PAM type: NRG; PAM sequence: AAG
agctttatccttggctccca

SEQ ID NO: 83003 - DNA, 20 bp, Artificial Sequence
  Description of Artificial Sequence: Synthetic oligonucleotide
  Target: ATXN1; (-) strand; PAM type: NRG; PAM sequence: TGG
taaactagaagctttatcct

SEQ ID NO: 83004 - DNA, 20 bp, Artificial Sequence
  Description of Artificial Sequence: Synthetic oligonucleotide
  Target: ATXN1; (-) strand; PAM type: NRG; PAM sequence: AAG
accggactgtgctaaactag

SEQ ID NO: 83005 - DNA, 20 bp, Artificial Sequence
  Description of Artificial Sequence: Synthetic oligonucleotide
  Target: ATXN1; (-) strand; PAM type: NRG; PAM sequence: TAG
ggaaccggactgtgctaaac

SEQ ID NO: 83006 - DNA, 20 bp, Artificial Sequence
  Description of Artificial Sequence: Synthetic oligonucleotide
  Target: ATXN1; (-) strand; PAM type: NRG; PAM sequence: CGG
aaagatctgaggataggaac

SEQ ID NO: 83007 - DNA, 20 bp, Artificial Sequence
  Description of Artificial Sequence: Synthetic oligonucleotide
  Target: ATXN1; (-) strand; PAM type: NRG; PAM sequence: AGG
taggagaaagatctgaggat

SEQ ID NO: 83008 - DNA, 20 bp, Artificial Sequence
  Description of Artificial Sequence: Synthetic oligonucleotide
  Target: ATXN1; (-) strand; PAM type: NRG; PAM sequence: TAG
ctaggagaaagatctgagga

SEQ ID NO: 83009 - DNA, 20 bp, Artificial Sequence
  Description of Artificial Sequence: Synthetic oligonucleotide
  Target: ATXN1; (-) strand; PAM type: NRG; PAM sequence: AGG
caggctaggagaaagatctg

SEQ ID NO: 83010 - DNA, 20 bp, Artificial Sequence
  Description of Artificial Sequence: Synthetic oligonucleotide
  Target: ATXN1; (-) strand; PAM type: NRG; PAM sequence: GAG
gcaggctaggagaaagatct

SEQ ID NO: 83011 - DNA, 20 bp, Artificial Sequence
  Description of Artificial Sequence: Synthetic oligonucleotide
  Target: ATXN1; (-) strand; PAM type: NRG; PAM sequence: AAG
tggagcagcaggctaggaga

SEQ ID NO: 83012 - DNA, 20 bp, Artificial Sequence
  Description of Artificial Sequence: Synthetic oligonucleotide
  Target: ATXN1; (-) strand; PAM type: NRG; PAM sequence: GAG
gggctggagcagcaggctag

SEQ ID NO: 83013 - DNA, 20 bp, Artificial Sequence
  Description of Artificial Sequence: Synthetic oligonucleotide
  Target: ATXN1; (-) strand; PAM type: NRG; PAM sequence: AGG
ctgggctggagcagcaggct

SEQ ID NO: 83014 - DNA, 20 bp, Artificial Sequence
  Description of Artificial Sequence: Synthetic oligonucleotide
  Target: ATXN1; (-) strand; PAM type: NRG; PAM sequence: TAG
gctgggctggagcagcaggc

SEQ ID NO: 83015 - DNA, 20 bp, Artificial Sequence
  Description of Artificial Sequence: Synthetic oligonucleotide
  Target: ATXN1; (-) strand; PAM type: NRG; PAM sequence: AGG
aggagctgggctggagcagc

SEQ ID NO: 83016 - DNA, 20 bp, Artificial Sequence
  Description of Artificial Sequence: Synthetic oligonucleotide
  Target: ATXN1; (-) strand; PAM type: NRG; PAM sequence: CAG
gaggagctgggctggagcag

SEQ ID NO: 83017 - DNA, 20 bp, Artificial Sequence
  Description of Artificial Sequence: Synthetic oligonucleotide
  Target: ATXN1; (-) strand; PAM type: NRG; PAM sequence: CAG
tatgaggagctgggctggag

SEQ ID NO: 83018 - DNA, 20 bp, Artificial Sequence
  Description of Artificial Sequence: Synthetic oligonucleotide
  Target: ATXN1; (-) strand; PAM type: NRG; PAM sequence: GAG
agctatgaggagctgggctg

SEQ ID NO: 83019 - DNA, 20 bp, Artificial Sequence
  Description of Artificial Sequence: Synthetic oligonucleotide
  Target: ATXN1; (-) strand; PAM type: NRG; PAM sequence: TGG
tcagctatgaggagctgggc

SEQ ID NO: 83020 - DNA, 20 bp, Artificial Sequence
  Description of Artificial Sequence: Synthetic oligonucleotide
  Target: ATXN1; (-) strand; PAM type: NRG; PAM sequence: GGG
gacatcagctatgaggagct

SEQ ID NO: 83021 - DNA, 20 bp, Artificial Sequence
  Description of Artificial Sequence: Synthetic oligonucleotide
  Target: ATXN1; (-) strand; PAM type: NRG; PAM sequence: TGG
ggacatcagctatgaggagc

SEQ ID NO: 83022 - DNA, 20 bp, Artificial Sequence
  Description of Artificial Sequence: Synthetic oligonucleotide
  Target: ATXN1; (-) strand; PAM type: NRG; PAM sequence: GAG
gtggggacatcagctatgag

SEQ ID NO: 83023 - DNA, 20 bp, Artificial Sequence
  Description of Artificial Sequence: Synthetic oligonucleotide
  Target: ATXN1; (-) strand; PAM type: NRG; PAM sequence: AGG
tagtggggacatcagctatg

SEQ ID NO: 83024 - DNA, 20 bp, Artificial Sequence
  Description of Artificial Sequence: Synthetic oligonucleotide
  Target: ATXN1; (-) strand; PAM type: NRG; PAM sequence: GAG
atagtggggacatcagctat

SEQ ID NO: 83025 - DNA, 20 bp, Artificial Sequence
  Description of Artificial Sequence: Synthetic oligonucleotide
  Target: ATXN1; (-) strand; PAM type: NRG; PAM sequence: CAG
gattgggatagtggggacat

SEQ ID NO: 83026 - DNA, 20 bp, Artificial Sequence
  Description of Artificial Sequence: Synthetic oligonucleotide
  Target: ATXN1; (-) strand; PAM type: NRG; PAM sequence: GGG
tgactaagattgggatagtg

SEQ ID NO: 83027 - DNA, 20 bp, Artificial Sequence
  Description of Artificial Sequence: Synthetic oligonucleotide
  Target: ATXN1; (-) strand; PAM type: NRG; PAM sequence: GGG
ctgactaagattgggatagt

SEQ ID NO: 83028 - DNA, 20 bp, Artificial Sequence
  Description of Artificial Sequence: Synthetic oligonucleotide
  Target: ATXN1; (-) strand; PAM type: NRG; PAM sequence: TGG
cctgactaagattgggatag

SEQ ID NO: 83029 - DNA, 20 bp, Artificial Sequence
  Description of Artificial Sequence: Synthetic oligonucleotide
  Target: ATXN1; (-) strand; PAM type: NRG; PAM sequence: TAG
gcccctgactaagattggga

SEQ ID NO: 83030 - DNA, 20 bp, Artificial Sequence
  Description of Artificial Sequence: Synthetic oligonucleotide
  Target: ATXN1; (-) strand; PAM type: NRG; PAM sequence: GGG
aggagcccctgactaagatt

SEQ ID NO: 83031 - DNA, 20 bp, Artificial Sequence
  Description of Artificial Sequence: Synthetic oligonucleotide
  Target: ATXN1; (-) strand; PAM type: NRG; PAM sequence: TGG
caggagcccctgactaagat

SEQ ID NO: 83032 - DNA, 20 bp, Artificial Sequence
  Description of Artificial Sequence: Synthetic oligonucleotide
  Target: ATXN1; (-) strand; PAM type: NRG; PAM sequence: AAG
aatgacaggagcccctgact

SEQ ID NO: 83033 - DNA, 20 bp, Artificial Sequence
  Description of Artificial Sequence: Synthetic oligonucleotide
  Target: ATXN1; (-) strand; PAM type: NRG; PAM sequence: GAG
tctgttggtggtaatgacag

SEQ ID NO: 83034 - DNA, 20 bp, Artificial Sequence
  Description of Artificial Sequence: Synthetic oligonucleotide
  Target: ATXN1; (-) strand; PAM type: NRG; PAM sequence: AGG
actctgttggtggtaatgac

SEQ ID NO: 83035 - DNA, 20 bp, Artificial Sequence
  Description of Artificial Sequence: Synthetic oligonucleotide
  Target: ATXN1; (-) strand; PAM type: NRG; PAM sequence: CAG
aactctgttggtggtaatga

SEQ ID NO: 83036 - DNA, 20 bp, Artificial Sequence
  Description of Artificial Sequence: Synthetic oligonucleotide
  Target: ATXN1; (-) strand; PAM type: NRG; PAM sequence: TGG
gtaatcactaactctgttgg

SEQ ID NO: 83037 - DNA, 20 bp, Artificial Sequence
  Description of Artificial Sequence: Synthetic oligonucleotide
  Target: ATXN1; (-) strand; PAM type: NRG; PAM sequence: TGG
tttgtaatcactaactctgt

SEQ ID NO: 83038 - DNA, 20 bp, Artificial Sequence
  Description of Artificial Sequence: Synthetic oligonucleotide
  Target: ATXN1; (-) strand; PAM type: NRG; PAM sequence: TGG
ccctagggcagaggctcttt

SEQ ID NO: 83039 - DNA, 20 bp, Artificial Sequence
  Description of Artificial Sequence: Synthetic oligonucleotide
  Target: ATXN1; (-) strand; PAM type: NRG; PAM sequence: AGG
aaagtgttcccctagggcag

SEQ ID NO: 83040 - DNA, 20 bp, Artificial Sequence
  Description of Artificial Sequence: Synthetic oligonucleotide
  Target: ATXN1; (-) strand; PAM type: NRG; PAM sequence: GAG
taaagtgttcccctagggca

SEQ ID NO: 83041 - DNA, 20 bp, Artificial Sequence
  Description of Artificial Sequence: Synthetic oligonucleotide
  Target: ATXN1; (-) strand; PAM type: NRG; PAM sequence: CAG
cgtaaagtgttcccctaggg

SEQ ID NO: 83042 - DNA, 20 bp, Artificial Sequence
  Description of Artificial Sequence: Synthetic oligonucleotide
  Target: ATXN1; (-) strand; PAM type: NRG; PAM sequence: GGG
atacgtaaagtgttccccta

SEQ ID NO: 83043 - DNA, 20 bp, Artificial Sequence
  Description of Artificial Sequence: Synthetic oligonucleotide
  Target: ATXN1; (-) strand; PAM type: NRG; PAM sequence: AGG
aatacgtaaagtgttcccct

SEQ ID NO: 83044 - DNA, 20 bp, Artificial Sequence
  Description of Artificial Sequence: Synthetic oligonucleotide
  Target: ATXN1; (-) strand; PAM type: NRG; PAM sequence: TAG
aaatacgtaaagtgttcccc

SEQ ID NO: 83045 - DNA, 20 bp, Artificial Sequence
  Description of Artificial Sequence: Synthetic oligonucleotide
  Target: ATXN1; (-) strand; PAM type: NRG; PAM sequence: AAG
cactttcttccaaatacgta

SEQ ID NO: 83046 - DNA, 20 bp, Artificial Sequence
  Description of Artificial Sequence: Synthetic oligonucleotide
  Target: ATXN1; (-) strand; PAM type: NRG; PAM sequence: TAG
cagcatattctctgaacctt

SEQ ID NO: 83047 - DNA, 20 bp, Artificial Sequence
  Description of Artificial Sequence: Synthetic oligonucleotide
  Target: ATXN1; (-) strand; PAM type: NRG; PAM sequence: CAG
gctttttcaggatgtgaggt

SEQ ID NO: 83048 - DNA, 20 bp, Artificial Sequence
  Description of Artificial Sequence: Synthetic oligonucleotide
  Target: ATXN1; (-) strand; PAM type: NRG; PAM sequence: AGG
ccaagctttttcaggatgtg

SEQ ID NO: 83049 - DNA, 20 bp, Artificial Sequence
  Description of Artificial Sequence: Synthetic oligonucleotide
  Target: ATXN1; (-) strand; PAM type: NRG; PAM sequence: GAG
gccaagctttttcaggatgt

SEQ ID NO: 83050 - DNA, 20 bp, Artificial Sequence
  Description of Artificial Sequence: Synthetic oligonucleotide
  Target: ATXN1; (-) strand; PAM type: NRG; PAM sequence: AGG
ttcagttgccaagctttttc

SEQ ID NO: 83051 - DNA, 20 bp, Artificial Sequence
  Description of Artificial Sequence: Synthetic oligonucleotide
  Target: ATXN1; (-) strand; PAM type: NRG; PAM sequence: CAG
cttcagttgccaagcttttt

SEQ ID NO: 83052 - DNA, 20 bp, Artificial Sequence
  Description of Artificial Sequence: Synthetic oligonucleotide
  Target: ATXN1; (-) strand; PAM type: NRG; PAM sequence: AAG
gcattccctcttcagttgcc

SEQ ID NO: 83053 - DNA, 20 bp, Artificial Sequence
  Description of Artificial Sequence: Synthetic oligonucleotide
  Target: ATXN1; (-) strand; PAM type: NRG; PAM sequence: CAG
tgagggttgcattccctctt

SEQ ID NO: 83054 - DNA, 20 bp, Artificial Sequence
  Description of Artificial Sequence: Synthetic oligonucleotide
  Target: ATXN1; (-) strand; PAM type: NRG; PAM sequence: GGG
taagcaacatcaagccatga

SEQ ID NO: 83055 - DNA, 20 bp, Artificial Sequence
  Description of Artificial Sequence: Synthetic oligonucleotide
  Target: ATXN1; (-) strand; PAM type: NRG; PAM sequence: AGG
ctaagcaacatcaagccatg

SEQ ID NO: 83056 - DNA, 20 bp, Artificial Sequence
  Description of Artificial Sequence: Synthetic oligonucleotide
  Target: ATXN1; (-) strand; PAM type: NRG; PAM sequence: GAG
cctaagcaacatcaagccat

SEQ ID NO: 83057 - DNA, 20 bp, Artificial Sequence
  Description of Artificial Sequence: Synthetic oligonucleotide
  Target: ATXN1; (-) strand; PAM type: NRG; PAM sequence: AAG
ttgttgacctaagcaacatc

SEQ ID NO: 83058 - DNA, 20 bp, Artificial Sequence
  Description of Artificial Sequence: Synthetic oligonucleotide
  Target: ATXN1; (-) strand; PAM type: NRG; PAM sequence: AAG
aaatatttgcttgttgacct

SEQ ID NO: 83059 - DNA, 20 bp, Artificial Sequence
  Description of Artificial Sequence: Synthetic oligonucleotide
  Target: ATXN1; (-) strand; PAM type: NRG; PAM sequence: AGG
tgagcctatggtaggtgtcc

SEQ ID NO: 83060 - DNA, 20 bp, Artificial Sequence
  Description of Artificial Sequence: Synthetic oligonucleotide
  Target: ATXN1; (-) strand; PAM type: NRG; PAM sequence: CAG
ctgagcctatggtaggtgtc

SEQ ID NO: 83061 - DNA, 20 bp, Artificial Sequence
  Description of Artificial Sequence: Synthetic oligonucleotide
  Target: ATXN1; (-) strand; PAM type: NRG; PAM sequence: AGG
tccaggtctgagcctatggt

SEQ ID NO: 83062 - DNA, 20 bp, Artificial Sequence
  Description of Artificial Sequence: Synthetic oligonucleotide
  Target: ATXN1; (-) strand; PAM type: NRG; PAM sequence: TAG
gtccaggtctgagcctatgg

SEQ ID NO: 83063 - DNA, 20 bp, Artificial Sequence
  Description of Artificial Sequence: Synthetic oligonucleotide
  Target: ATXN1; (-) strand; PAM type: NRG; PAM sequence: TGG
agggtccaggtctgagccta

SEQ ID NO: 83064 - DNA, 20 bp, Artificial Sequence
  Description of Artificial Sequence: Synthetic oligonucleotide
  Target: ATXN1; (-) strand; PAM type: NRG; PAM sequence: GAG
acagcaaagggtccaggtct

SEQ ID NO: 83065 - DNA, 20 bp, Artificial Sequence
  Description of Artificial Sequence: Synthetic oligonucleotide
  Target: ATXN1; (-) strand; PAM type: NRG; PAM sequence: AGG
tctcccacagcaaagggtcc

SEQ ID NO: 83066 - DNA, 20 bp, Artificial Sequence
  Description of Artificial Sequence: Synthetic oligonucleotide
  Target: ATXN1; (-) strand; PAM type: NRG; PAM sequence: CAG
ctctcccacagcaaagggtc

SEQ ID NO: 83067 - DNA, 20 bp, Artificial Sequence
  Description of Artificial Sequence: Synthetic oligonucleotide
  Target: ATXN1; (-) strand; PAM type: NRG; PAM sequence: GGG
gcctcctctcccacagcaaa

SEQ ID NO: 83068 - DNA, 20 bp, Artificial Sequence
  Description of Artificial Sequence: Synthetic oligonucleotide
  Target: ATXN1; (-) strand; PAM type: NRG; PAM sequence: AGG
tgcctcctctcccacagcaa

SEQ ID NO: 83069 - DNA, 20 bp, Artificial Sequence
  Description of Artificial Sequence: Synthetic oligonucleotide
  Target: ATXN1; (-) strand; PAM type: NRG; PAM sequence: AAG
ttgcctcctctcccacagca

SEQ ID NO: 83070 - DNA, 20 bp, Artificial Sequence
  Description of Artificial Sequence: Synthetic oligonucleotide
  Target: ATXN1; (-) strand; PAM type: NRG; PAM sequence: CAG
cctctttgcctcctctccca

SEQ ID NO: 83071 - DNA, 20 bp, Artificial Sequence
  Description of Artificial Sequence: Synthetic oligonucleotide
  Target: ATXN1; (-) strand; PAM type: NRG; PAM sequence: GAG
acttttgcacactgaggttt

SEQ ID NO: 83072 - DNA, 20 bp, Artificial Sequence
  Description of Artificial Sequence: Synthetic oligonucleotide
  Target: ATXN1; (-) strand; PAM type: NRG; PAM sequence: AGG
tagttaacttttgcacactg

SEQ ID NO: 83073 - DNA, 20 bp, Artificial Sequence
  Description of Artificial Sequence: Synthetic oligonucleotide
  Target: ATXN1; (-) strand; PAM type: NRG; PAM sequence: GAG
ttagttaacttttgcacact

SEQ ID NO: 83074 - DNA, 20 bp, Artificial Sequence
  Description of Artificial Sequence: Synthetic oligonucleotide
  Target: ATXN1; (-) strand; PAM type: NRG; PAM sequence: TAG
agaacccaggaaactcacct

SEQ ID NO: 83075 - DNA, 20 bp, Artificial Sequence
  Description of Artificial Sequence: Synthetic oligonucleotide
  Target: ATXN1; (-) strand; PAM type: NRG; PAM sequence: AGG
gttctggggatgtagaaccc

SEQ ID NO: 83076 - DNA, 20 bp, Artificial Sequence
  Description of Artificial Sequence: Synthetic oligonucleotide
  Target: ATXN1; (-) strand; PAM type: NRG; PAM sequence: CAG
agttctggggatgtagaacc

SEQ ID NO: 83077 - DNA, 20 bp, Artificial Sequence
  Description of Artificial Sequence: Synthetic oligonucleotide
  Target: ATXN1; (-) strand; PAM type: NRG; PAM sequence: TAG
aatcagaagttctggggatg

SEQ ID NO: 83078 - DNA, 20 bp, Artificial Sequence
  Description of Artificial Sequence: Synthetic oligonucleotide
  Target: ATXN1; (-) strand; PAM type: NRG; PAM sequence: GGG
cttatgaatcagaagttctg

SEQ ID NO: 83079 - DNA, 20 bp, Artificial Sequence
  Description of Artificial Sequence: Synthetic oligonucleotide
  Target: ATXN1; (-) strand; PAM type: NRG; PAM sequence: GGG
gcttatgaatcagaagttct

SEQ ID NO: 83080 - DNA, 20 bp, Artificial Sequence
  Description of Artificial Sequence: Synthetic oligonucleotide
  Target: ATXN1; (-) strand; PAM type: NRG; PAM sequence: TGG
ggcttatgaatcagaagttc

SEQ ID NO: 83081 - DNA, 20 bp, Artificial Sequence
  Description of Artificial Sequence: Synthetic oligonucleotide
  Target: ATXN1; (-) strand; PAM type: NRG; PAM sequence: AAG
acaccaggcttatgaatcag

SEQ ID NO: 83082 - DNA, 20 bp, Artificial Sequence
  Description of Artificial Sequence: Synthetic oligonucleotide
  Target: ATXN1; (-) strand; PAM type: NRG; PAM sequence: CAG
gcaacaccaggcttatgaat

SEQ ID NO: 83083 - DNA, 20 bp, Artificial Sequence
  Description of Artificial Sequence: Synthetic oligonucleotide
  Target: ATXN1; (-) strand; PAM type: NRG; PAM sequence: AGG
gttgcagattcagcaacacc

SEQ ID NO: 83084 - DNA, 20 bp, Artificial Sequence
  Description of Artificial Sequence: Synthetic oligonucleotide
  Target: ATXN1; (-) strand; PAM type: NRG; PAM sequence: CAG
agttgcagattcagcaacac

SEQ ID NO: 83085 - DNA, 20 bp, Artificial Sequence
  Description of Artificial Sequence: Synthetic oligonucleotide
  Target: ATXN1; (-) strand; PAM type: NRG; PAM sequence: CAG
gtttattaaagttgcagatt

SEQ ID NO: 83086 - DNA, 20 bp, Artificial Sequence
  Description of Artificial Sequence: Synthetic oligonucleotide
  Target: ATXN1; (-) strand; PAM type: NRG; PAM sequence: CAG
ggatatgtttattaaagttg

SEQ ID NO: 83087 - DNA, 20 bp, Artificial Sequence
  Description of Artificial Sequence: Synthetic oligonucleotide
  Target: ATXN1; (-) strand; PAM type: NRG; PAM sequence: AAG
tctcttggatatgtttatta

SEQ ID NO: 83088 - DNA, 20 bp, Artificial Sequence
  Description of Artificial Sequence: Synthetic oligonucleotide
  Target: ATXN1; (-) strand; PAM type: NRG; PAM sequence: TGG
cctcctgcttccgaatctct

SEQ ID NO: 83089 - DNA, 20 bp, Artificial Sequence
  Description of Artificial Sequence: Synthetic oligonucleotide
  Target: ATXN1; (-) strand; PAM type: NRG; PAM sequence: CAG
tcccaagggtggtctaatcc

SEQ ID NO: 83090 - DNA, 20 bp, Artificial Sequence
  Description of Artificial Sequence: Synthetic oligonucleotide
  Target: ATXN1; (-) strand; PAM type: NRG; PAM sequence: TGG
agaccagtgtttcccaaggg

SEQ ID NO: 83091 - DNA, 20 bp, Artificial Sequence
  Description of Artificial Sequence: Synthetic oligonucleotide
  Target: ATXN1; (-) strand; PAM type: NRG; PAM sequence: GGG
cacagaccagtgtttcccaa

SEQ ID NO: 83092 - DNA, 20 bp, Artificial Sequence
  Description of Artificial Sequence: Synthetic oligonucleotide
  Target: ATXN1; (-) strand; PAM type: NRG; PAM sequence: AGG
tcacagaccagtgtttccca

SEQ ID NO: 83093 - DNA, 20 bp, Artificial Sequence
  Description of Artificial Sequence: Synthetic oligonucleotide
  Target: ATXN1; (-) strand; PAM type: NRG; PAM sequence: AAG
atcacagaccagtgtttccc

SEQ ID NO: 83094 - DNA, 20 bp, Artificial Sequence
  Description of Artificial Sequence: Synthetic oligonucleotide
  Target: ATXN1; (-) strand; PAM type: NRG; PAM sequence: CAG
gcaggaatcaaatcacagac

SEQ ID NO: 83095 - DNA, 20 bp, Artificial Sequence
  Description of Artificial Sequence: Synthetic oligonucleotide
  Target: ATXN1; (-) strand; PAM type: NRG; PAM sequence: CAG
tcaaggcaggaatcaaatca

SEQ ID NO: 83096 - DNA, 20 bp, Artificial Sequence
  Description of Artificial Sequence: Synthetic oligonucleotide
  Target: ATXN1; (-) strand; PAM type: NRG; PAM sequence: AGG
gttgcacatggcttcaaggc

SEQ ID NO: 83097 - DNA, 20 bp, Artificial Sequence
  Description of Artificial Sequence: Synthetic oligonucleotide
  Target: ATXN1; (-) strand; PAM type: NRG; PAM sequence: CAG
ggttgcacatggcttcaagg

SEQ ID NO: 83098 - DNA, 20 bp, Artificial Sequence
  Description of Artificial Sequence: Synthetic oligonucleotide
  Target: ATXN1; (-) strand; PAM type: NRG; PAM sequence: AGG
atgggttgcacatggcttca

SEQ ID NO: 83099 - DNA, 20 bp, Artificial Sequence
  Description of Artificial Sequence: Synthetic oligonucleotide
  Target: ATXN1; (-) strand; PAM type: NRG; PAM sequence: AAG
catgggttgcacatggcttc

SEQ ID NO: 83100 - DNA, 20 bp, Artificial Sequence
  Description of Artificial Sequence: Synthetic oligonucleotide
  Target: ATXN1; (-) strand; PAM type: NRG; PAM sequence: TGG
aattgcacatgggttgcaca

SEQ ID NO: 83101 - DNA, 20 bp, Artificial Sequence
  Description of Artificial Sequence: Synthetic oligonucleotide
  Target: ATXN1; (-) strand; PAM type: NRG; PAM sequence: GGG
ccatcagcacaattgcacat

SEQ ID NO: 83102 - DNA, 20 bp, Artificial Sequence
  Description of Artificial Sequence: Synthetic oligonucleotide
  Target: ATXN1; (-) strand; PAM type: NRG; PAM sequence: TGG
gccatcagcacaattgcaca

SEQ ID NO: 83103 - DNA, 20 bp, Artificial Sequence
  Description of Artificial Sequence: Synthetic oligonucleotide
  Target: ATXN1; (-) strand; PAM type: NRG; PAM sequence: CAG
actctgtgagtgtttgccat

SEQ ID NO: 83104 - DNA, 20 bp, Artificial Sequence
  Description of Artificial Sequence: Synthetic oligonucleotide
  Target: ATXN1; (-) strand; PAM type: NRG; PAM sequence: GAG
actgctgtgcattactctgt

SEQ ID NO: 83105 - DNA, 20 bp, Artificial Sequence
  Description of Artificial Sequence: Synthetic oligonucleotide
  Target: ATXN1; (-) strand; PAM type: NRG; PAM sequence: CAG
catttagggcctgcttctta

SEQ ID NO: 83106 - DNA, 20 bp, Artificial Sequence
  Description of Artificial Sequence: Synthetic oligonucleotide
  Target: ATXN1; (-) strand; PAM type: NRG; PAM sequence: GGG
atgaacttctatcacattta

SEQ ID NO: 83107 - DNA, 20 bp, Artificial Sequence
  Description of Artificial Sequence: Synthetic oligonucleotide
  Target: ATXN1; (-) strand; PAM type: NRG; PAM sequence: AGG
tatgaacttctatcacattt

SEQ ID NO: 83108 - DNA, 20 bp, Artificial Sequence
  Description of Artificial Sequence: Synthetic oligonucleotide
  Target: ATXN1; (-) strand; PAM type: NRG; PAM sequence: TAG
ttatgaacttctatcacatt

SEQ ID NO: 83109 - DNA, 20 bp, Artificial Sequence
  Description of Artificial Sequence: Synthetic oligonucleotide
  Target: ATXN1; (-) strand; PAM type: NRG; PAM sequence: CAG
ccactgcgcccggccctgag

SEQ ID NO: 83110 - DNA, 20 bp, Artificial Sequence
  Description of Artificial Sequence: Synthetic oligonucleotide
  Target: ATXN1; (-) strand; PAM type: NRG; PAM sequence: GAG
aagccactgcgcccggccct

SEQ ID NO: 83111 - DNA, 20 bp, Artificial Sequence
  Description of Artificial Sequence: Synthetic oligonucleotide
  Target: ATXN1; (-) strand; PAM type: NRG; PAM sequence: CGG
caggtgtaagccactgcgcc

SEQ ID NO: 83112 - DNA, 20 bp, Artificial Sequence
  Description of Artificial Sequence: Synthetic oligonucleotide
  Target: ATXN1; (-) strand; PAM type: NRG; PAM sequence: AAG
agtgctgagattacaggtgt

SEQ ID NO: 83113 - DNA, 20 bp, Artificial Sequence
  Description of Artificial Sequence: Synthetic oligonucleotide
  Target: ATXN1; (-) strand; PAM type: NRG; PAM sequence: AGG
ttccaaagtgctgagattac

SEQ ID NO: 83114 - DNA, 20 bp, Artificial Sequence
  Description of Artificial Sequence: Synthetic oligonucleotide
  Target: ATXN1; (-) strand; PAM type: NRG; PAM sequence: CAG
cttccaaagtgctgagatta

SEQ ID NO: 83115 - DNA, 20 bp, Artificial Sequence
  Description of Artificial Sequence: Synthetic oligonucleotide
  Target: ATXN1; (-) strand; PAM type: NRG; PAM sequence: GAG
ccttggccttccaaagtgct

SEQ ID NO: 83116 - DNA, 20 bp, Artificial Sequence
  Description of Artificial Sequence: Synthetic oligonucleotide
  Target: ATXN1; (-) strand; PAM type: NRG; PAM sequence: AAG
ccatctgccttggccttcca

SEQ ID NO: 83117 - DNA, 20 bp, Artificial Sequence
  Description of Artificial Sequence: Synthetic oligonucleotide
  Target: ATXN1; (-) strand; PAM type: NRG; PAM sequence: TGG
atctcatgatccatctgcct

SEQ ID NO: 83118 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccagga

SEQ ID NO: 83119 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 83120 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggc

SEQ ID NO: 83121 - DNA, 20 bp, Artificial Sequence
  Description of Artificial Sequence: Synthetic oligonucleotide
  Target: ATXN1; (-) strand; PAM type: NRG; PAM sequence: TGG
gaaatggggtttcaccatgt

SEQ ID NO: 83122 - DNA, 20 bp, Artificial Sequence
  Description of Artificial Sequence: Synthetic oligonucleotide
  Target: ATXN1; (-) strand; PAM type: NRG; PAM sequence: GGG
ttctatttttagtagaaatg

SEQ ID NO: 83123 - DNA, 20 bp, Artificial Sequence
  Description of Artificial Sequence: Synthetic oligonucleotide
  Target: ATXN1; (-) strand; PAM type: NRG; PAM sequence: GGG
tttctatttttagtagaaat

SEQ ID NO: 83124 - DNA, 20 bp, Artificial Sequence
  Description of Artificial Sequence: Synthetic oligonucleotide
  Target: ATXN1; (-) strand; PAM type: NRG; PAM sequence: TGG
ttttctatttttagtagaaa

SEQ ID NO: 83125 - DNA, 20 bp, Artificial Sequence
  Description of Artificial Sequence: Synthetic oligonucleotide
  Target: ATXN1; (-) strand; PAM type: NRG; PAM sequence: TAG
gctaatttttctatttttag

SEQ ID NO: 83126 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttctatttt

SEQ ID NO: 83127 - DNA, 20 bp, Artificial Sequence
  Description of Artificial Sequence: Synthetic oligonucleotide
  Target: ATXN1; (-) strand; PAM type: NRG; PAM sequence: CAG
caggcatgcgccaccgtgcc

SEQ ID NO: 83128 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggattac

SEQ ID NO: 83129 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgggatta

SEQ ID NO: 83130 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagct

SEQ ID NO: 83131 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagc

SEQ ID NO: 83132 - DNA, 20 bp, Artificial Sequence
  Description of Artificial Sequence: Synthetic oligonucleotide
  Target: ATXN1; (-) strand; PAM type: NRG; PAM sequence: TAG
tcttgcctcagcctcctgag

SEQ ID NO: 83133 - DNA, 20 bp, Artificial Sequence
  Description of Artificial Sequence: Synthetic oligonucleotide
  Target: ATXN1; (-) strand; PAM type: NRG; PAM sequence: GAG
ttctcttgcctcagcctcct

SEQ ID NO: 83134 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcttgcct

SEQ ID NO: 83135 - DNA, 20 bp, Artificial Sequence
  Description of Artificial Sequence: Synthetic oligonucleotide
  Target: ATXN1; (-) strand; PAM type: NRG; PAM sequence: AAG
aaccttcgcctcccaggttc

SEQ ID NO: 83136 - DNA, 20 bp, Artificial Sequence
  Description of Artificial Sequence: Synthetic oligonucleotide
  Target: ATXN1; (-) strand; PAM type: NRG; PAM sequence: AGG
cactgcaaccttcgcctccc

SEQ ID NO: 83137 - DNA, 20 bp, Artificial Sequence
  Description of Artificial Sequence: Synthetic oligonucleotide
  Target: ATXN1; (-) strand; PAM type: NRG; PAM sequence: CAG
tcactgcaaccttcgcctcc

SEQ ID NO: 83138 - DNA, 20 bp, Artificial Sequence
  Description of Artificial Sequence: Synthetic oligonucleotide
  Target: ATXN1; (-) strand; PAM type: NRG; PAM sequence: TGG
ctggagtgcagtggcaatct

SEQ ID NO: 83139 - DNA, 20 bp, Artificial Sequence
  Description of Artificial Sequence: Synthetic oligonucleotide
  Target: ATXN1; (-) strand; PAM type: NRG; PAM sequence: TGG
gttgctaggctggagtgcag

SEQ ID NO: 83140 - DNA, 20 bp, Artificial Sequence
  Description of Artificial Sequence: Synthetic oligonucleotide
  Target: ATXN1; (-) strand; PAM type: NRG; PAM sequence: CAG
tctgttgctaggctggagtg

SEQ ID NO: 83141 - DNA, 20 bp, Artificial Sequence
  Description of Artificial Sequence: Synthetic oligonucleotide
  Target: ATXN1; (-) strand; PAM type: NRG; PAM sequence: GAG
ttgggtctgttgctaggctg

SEQ ID NO: 83142 - DNA, 20 bp, Artificial Sequence
  Description of Artificial Sequence: Synthetic oligonucleotide
  Target: ATXN1; (-) strand; PAM type: NRG; PAM sequence: TGG
tcttgggtctgttgctaggc

SEQ ID NO: 83143 - DNA, 20 bp, Artificial Sequence
  Description of Artificial Sequence: Synthetic oligonucleotide
  Target: ATXN1; (-) strand; PAM type: NRG; PAM sequence: AGG
agagtcttgggtctgttgct

SEQ ID NO: 83144 - DNA, 20 bp, Artificial Sequence
  Description of Artificial Sequence: Synthetic oligonucleotide
  Target: ATXN1; (-) strand; PAM type: NRG; PAM sequence: TAG
cagagtcttgggtctgttgc

SEQ ID NO: 83145 - DNA, 20 bp, Artificial Sequence
  Description of Artificial Sequence: Synthetic oligonucleotide
  Target: ATXN1; (-) strand; PAM type: NRG; PAM sequence: GGG
tttttttaaggcagagtctt

SEQ ID NO: 83146 - DNA, 20 bp, Artificial Sequence
  Description of Artificial Sequence: Synthetic oligonucleotide
  Target: ATXN1; (-) strand; PAM type: NRG; PAM sequence: TGG
ttttttttaaggcagagtct

SEQ ID NO: 83147 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttaaggca

SEQ ID NO: 83148 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttaagg

SEQ ID NO: 83149 - DNA, 20 bp, Artificial Sequence
  Description of Artificial Sequence: Synthetic oligonucleotide
  Target: ATXN1; (-) strand; PAM type: NRG; PAM sequence: AGG
ttttttttttttttttttta

SEQ ID NO: 83150 - DNA, 20 bp, Artificial Sequence
  Description of Artificial Sequence: Synthetic oligonucleotide
  Target: ATXN1; (-) strand; PAM type: NRG; PAM sequence: AAG
tttttttttttttttttttt

SEQ ID NO: 83151 - DNA, 20 bp, Artificial Sequence
  Description of Artificial Sequence: Synthetic oligonucleotide
  Target: ATXN1; (-) strand; PAM type: NRG; PAM sequence: TGG
atcctcaggacttcactgac

SEQ ID NO: 83152 - DNA, 20 bp, Artificial Sequence
  Description of Artificial Sequence: Synthetic oligonucleotide
  Target: ATXN1; (-) strand; PAM type: NRG; PAM sequence: AGG
aaagtcttccctgaatcctc

SEQ ID NO: 83153 - DNA, 20 bp, Artificial Sequence
  Description of Artificial Sequence: Synthetic oligonucleotide
  Target: ATXN1; (-) strand; PAM type: NRG; PAM sequence: CAG
caaagtcttccctgaatcct

SEQ ID NO: 83154 - DNA, 20 bp, Artificial Sequence
  Description of Artificial Sequence: Synthetic oligonucleotide
  Target: ATXN1; (-) strand; PAM type: NRG; PAM sequence: AAG
aatcctggctgtcacttaca

SEQ ID NO: 83155 - DNA, 20 bp, Artificial Sequence
  Description of Artificial Sequence: Synthetic oligonucleotide
  Target: ATXN1; (-) strand; PAM type: NRG; PAM sequence: TGG
ttctgcctcaccacaaatcc

SEQ ID NO: 83156 - DNA, 20 bp, Artificial Sequence
  Description of Artificial Sequence: Synthetic oligonucleotide
  Target: ATXN1; (-) strand; PAM type: NRG; PAM sequence: AAG
cttggggactatctctatca

SEQ ID NO: 83157 - DNA, 20 bp, Artificial Sequence
  Description of Artificial Sequence: Synthetic oligonucleotide
  Target: ATXN1; (-) strand; PAM type: NRG; PAM sequence: GGG
ttgattaagacagttgcttg

SEQ ID NO: 83158 - DNA, 20 bp, Artificial Sequence
  Description of Artificial Sequence: Synthetic oligonucleotide
  Target: ATXN1; (-) strand; PAM type: NRG; PAM sequence: GGG
tttgattaagacagttgctt

SEQ ID NO: 83159 - DNA, 20 bp, Artificial Sequence
  Description of Artificial Sequence: Synthetic oligonucleotide
  Target: ATXN1; (-) strand; PAM type: NRG; PAM sequence: TGG
gtttgattaagacagttgct

SEQ ID NO: 83160 - DNA, 20 bp, Artificial Sequence
  Description of Artificial Sequence: Synthetic oligonucleotide
  Target: ATXN1; (-) strand; PAM type: NRG; PAM sequence: CAG
atcgggaggtttgattaaga

SEQ ID NO: 83161 - DNA, 20 bp, Artificial Sequence
  Description of Artificial Sequence: Synthetic oligonucleotide
  Target: ATXN1; (-) strand; PAM type: NRG; PAM sequence: AAG
ctgaatcgggaggtttgatt

SEQ ID NO: 83162 - DNA, 20 bp, Artificial Sequence
  Description of Artificial Sequence: Synthetic oligonucleotide
  Target: ATXN1; (-) strand; PAM type: NRG; PAM sequence: AGG
ctttgtcatgctgaatcggg

SEQ ID NO: 83163 - DNA, 20 bp, Artificial Sequence
  Description of Artificial Sequence: Synthetic oligonucleotide
  Target: ATXN1; (-) strand; PAM type: NRG; PAM sequence: GAG
actttgtcatgctgaatcgg

SEQ ID NO: 83164 - DNA, 20 bp, Artificial Sequence
  Description of Artificial Sequence: Synthetic oligonucleotide
  Target: ATXN1; (-) strand; PAM type: NRG; PAM sequence: GGG
ccactttgtcatgctgaatc

SEQ ID NO: 83165 - DNA, 20 bp, Artificial Sequence
  Description of Artificial Sequence: Synthetic oligonucleotide
  Target: ATXN1; (-) strand; PAM type: NRG; PAM sequence: CGG
gccactttgtcatgctgaat

SEQ ID NO: 83166 - DNA, 20 bp, Artificial Sequence
  Description of Artificial Sequence: Synthetic oligonucleotide
  Target: ATXN1; (-) strand; PAM type: NRG; PAM sequence: TGG
tccatttatgctgtatgcca

SEQ ID NO: 83167 - DNA, 20 bp, Artificial Sequence
  Description of Artificial Sequence: Synthetic oligonucleotide
  Target: ATXN1; (-) strand; PAM type: NRG; PAM sequence: TGG
cctctttacctgtttgctgg

SEQ ID NO: 83168 - DNA, 20 bp, Artificial Sequence
  Description of Artificial Sequence: Synthetic oligonucleotide
  Target: ATXN1; (-) strand; PAM type: NRG; PAM sequence: TGG
aaccctctttacctgtttgc

SEQ ID NO: 83169 - DNA, 20 bp, Artificial Sequence
  Description of Artificial Sequence: Synthetic oligonucleotide
  Target: ATXN1; (-) strand; PAM type: NRG; PAM sequence: AGG
atccttcctgtaatcaacat

SEQ ID NO: 83170 - DNA, 20 bp, Artificial Sequence
  Description of Artificial Sequence: Synthetic oligonucleotide
  Target: ATXN1; (-) strand; PAM type: NRG; PAM sequence: TAG
tatccttcctgtaatcaaca

SEQ ID NO: 83171 - DNA, 20 bp, Artificial Sequence
  Description of Artificial Sequence: Synthetic oligonucleotide
  Target: ATXN1; (-) strand; PAM type: NRG; PAM sequence: CAG
ttttgtgattctcctggtga

SEQ ID NO: 83172 - DNA, 20 bp, Artificial Sequence
  Description of Artificial Sequence: Synthetic oligonucleotide
  Target: ATXN1; (-) strand; PAM type: NRG; PAM sequence: TGG
tgctagttttgtgattctcc

SEQ ID NO: 83173 - DNA, 20 bp, Artificial Sequence
  Description of Artificial Sequence: Synthetic oligonucleotide
  Target: ATXN1; (-) strand; PAM type: NRG; PAM sequence: TAG
acagtgttatctggaagtgc

SEQ ID NO: 83174 - DNA, 20 bp, Artificial Sequence
  Description of Artificial Sequence: Synthetic oligonucleotide
  Target: ATXN1; (-) strand; PAM type: NRG; PAM sequence: AAG
gcaaacacagtgttatctgg

SEQ ID NO: 83175 - DNA, 20 bp, Artificial Sequence
  Description of Artificial Sequence: Synthetic oligonucleotide
  Target: ATXN1; (-) strand; PAM type: NRG; PAM sequence: TGG
aatgcaaacacagtgttatc

SEQ ID NO: 83176 - DNA, 20 bp, Artificial Sequence
  Description of Artificial Sequence: Synthetic oligonucleotide
  Target: ATXN1; (-) strand; PAM type: NRG; PAM sequence: CAG
gtagaaagcaaatgcaaaca

SEQ ID NO: 83177 - DNA, 20 bp, Artificial Sequence
  Description of Artificial Sequence: Synthetic oligonucleotide
  Target: ATXN1; (-) strand; PAM type: NRG; PAM sequence: AAG
aaccacatgaatgtggtaga

SEQ ID NO: 83178 - DNA, 20 bp, Artificial Sequence
  Description of Artificial Sequence: Synthetic oligonucleotide
  Target: ATXN1; (-) strand; PAM type: NRG; PAM sequence: TAG
aggaaaccacatgaatgtgg

SEQ ID NO: 83179 - DNA, 20 bp, Artificial Sequence
  Description of Artificial Sequence: Synthetic oligonucleotide
  Target: ATXN1; (-) strand; PAM type: NRG; PAM sequence: TGG
tgcaggaaaccacatgaatg

SEQ ID NO: 83180 - DNA, 20 bp, Artificial Sequence
  Description of Artificial Sequence: Synthetic oligonucleotide
  Target: ATXN1; (-) strand; PAM type: NRG; PAM sequence: AGG
aatattaaattatgaagtgc

SEQ ID NO: 83181 - DNA, 20 bp, Artificial Sequence
  Description of Artificial Sequence: Synthetic oligonucleotide
  Target: ATXN1; (-) strand; PAM type: NRG; PAM sequence: CAG
aaatattaaattatgaagtg

SEQ ID NO: 83182 - DNA, 20 bp, Artificial Sequence
  Description of Artificial Sequence: Synthetic oligonucleotide
  Target: ATXN1; (-) strand; PAM type: NRG; PAM sequence: AAG
cttacaaatattaaattatg

SEQ ID NO: 83183 - DNA, 20 bp, Artificial Sequence
  Description of Artificial Sequence: Synthetic oligonucleotide
  Target: ATXN1; (-) strand; PAM type: NRG; PAM sequence: CAG
gcattattggggtttcataa

SEQ ID NO: 83184 - DNA, 20 bp, Artificial Sequence
  Description of Artificial Sequence: Synthetic oligonucleotide
  Target: ATXN1; (-) strand; PAM type: NRG; PAM sequence: GGG
cttcaagtgatgcattattg

SEQ ID NO: 83185 - DNA, 20 bp, Artificial Sequence
  Description of Artificial Sequence: Synthetic oligonucleotide
  Target: ATXN1; (-) strand; PAM type: NRG; PAM sequence: GGG
ccttcaagtgatgcattatt

SEQ ID NO: 83186 - DNA, 20 bp, Artificial Sequence
  Description of Artificial Sequence: Synthetic oligonucleotide
  Target: ATXN1; (-) strand; PAM type: NRG; PAM sequence: TGG
gccttcaagtgatgcattat

SEQ ID NO: 83187 - DNA, 20 bp, Artificial Sequence
  Description of Artificial Sequence: Synthetic oligonucleotide
  Target: ATXN1; (-) strand; PAM type: NRG; PAM sequence: AAG
gcagctggctttctgccttc

SEQ ID NO: 83188 - DNA, 20 bp, Artificial Sequence
  Description of Artificial Sequence: Synthetic oligonucleotide
  Target: ATXN1; (-) strand; PAM type: NRG; PAM sequence: TGG
atgtcactcttgttagcagc

SEQ ID NO: 83189 - DNA, 20 bp, Artificial Sequence
  Description of Artificial Sequence: Synthetic oligonucleotide
  Target: ATXN1; (-) strand; PAM type: NRG; PAM sequence: CAG
tcagatgtcactcttgttag

SEQ ID NO: 83190 - DNA, 20 bp, Artificial Sequence
  Description of Artificial Sequence: Synthetic oligonucleotide
  Target: ATXN1; (-) strand; PAM type: NRG; PAM sequence: TAG
tgctcagatgtcactcttgt

SEQ ID NO: 83191 - DNA, 20 bp, Artificial Sequence
  Description of Artificial Sequence: Synthetic oligonucleotide
  Target: ATXN1; (-) strand; PAM type: NRG; PAM sequence: CAG
agagcttcagaaatgatgct

SEQ ID NO: 83192 - DNA, 20 bp, Artificial Sequence
  Description of Artificial Sequence: Synthetic oligonucleotide
  Target: ATXN1; (-) strand; PAM type: NRG; PAM sequence: CAG
ccctttctgaagcagagctt

SEQ ID NO: 83193 - DNA, 20 bp, Artificial Sequence
  Description of Artificial Sequence: Synthetic oligonucleotide
  Target: ATXN1; (-) strand; PAM type: NRG; PAM sequence: GAG
aacatcccctttctgaagca

SEQ ID NO: 83194 - DNA, 20 bp, Artificial Sequence
  Description of Artificial Sequence: Synthetic oligonucleotide
  Target: ATXN1; (-) strand; PAM type: NRG; PAM sequence: CAG
taaacatcccctttctgaag

SEQ ID NO: 83195 - DNA, 20 bp, Artificial Sequence
  Description of Artificial Sequence: Synthetic oligonucleotide
  Target: ATXN1; (-) strand; PAM type: NRG; PAM sequence: AAG
tactaaacatcccctttctg

SEQ ID NO: 83196 - DNA, 20 bp, Artificial Sequence
  Description of Artificial Sequence: Synthetic oligonucleotide
  Target: ATXN1; (-) strand; PAM type: NRG; PAM sequence: TAG
acactttgttttacgttgaa

SEQ ID NO: 83197 - DNA, 20 bp, Artificial Sequence
  Description of Artificial Sequence: Synthetic oligonucleotide
  Target: ATXN1; (-) strand; PAM type: NRG; PAM sequence: TGG
cggccagcctgttaaccctg

SEQ ID NO: 83198 - DNA, 20 bp, Artificial Sequence
  Description of Artificial Sequence: Synthetic oligonucleotide
  Target: ATXN1; (-) strand; PAM type: NRG; PAM sequence: CAG
ttgtgttactggttaccggc

SEQ ID NO: 83199 - DNA, 20 bp, Artificial Sequence
  Description of Artificial Sequence: Synthetic oligonucleotide
  Target: ATXN1; (-) strand; PAM type: NRG; PAM sequence: CGG
gtcattgtgttactggttac

SEQ ID NO: 83200 - DNA, 20 bp, Artificial Sequence
  Description of Artificial Sequence: Synthetic oligonucleotide
  Target: ATXN1; (-) strand; PAM type: NRG; PAM sequence: TGG
gcttgccgtcattgtgttac

SEQ ID NO: 83201 - DNA, 20 bp, Artificial Sequence
  Description of Artificial Sequence: Synthetic oligonucleotide
  Target: ATXN1; (-) strand; PAM type: NRG; PAM sequence: GGG
tgtcctttgtttttctttag

SEQ ID NO: 83202 - DNA, 20 bp, Artificial Sequence
  Description of Artificial Sequence: Synthetic oligonucleotide
  Target: ATXN1; (-) strand; PAM type: NRG; PAM sequence: GGG
ctgtcctttgtttttcttta

SEQ ID NO: 83203 - DNA, 20 bp, Artificial Sequence
  Description of Artificial Sequence: Synthetic oligonucleotide
  Target: ATXN1; (-) strand; PAM type: NRG; PAM sequence: AGG
actgtcctttgtttttcttt

SEQ ID NO: 83204 - DNA, 20 bp, Artificial Sequence
  Description of Artificial Sequence: Synthetic oligonucleotide
  Target: ATXN1; (-) strand; PAM type: NRG; PAM sequence: TAG
tactgtcctttgtttttctt

SEQ ID NO: 83205 - DNA, 20 bp, Artificial Sequence
  Description of Artificial Sequence: Synthetic oligonucleotide
  Target: ATXN1; (-) strand; PAM type: NRG; PAM sequence: AGG
tatatccaaataagtgagat

SEQ ID NO: 83206 - DNA, 20 bp, Artificial Sequence
  Description of Artificial Sequence: Synthetic oligonucleotide
  Target: ATXN1; (-) strand; PAM type: NRG; PAM sequence: TAG
ttatatccaaataagtgaga

SEQ ID NO: 83207 - DNA, 20 bp, Artificial Sequence
  Description of Artificial Sequence: Synthetic oligonucleotide
  Target: ATXN1; (-) strand; PAM type: NRG; PAM sequence: GAG
aatattatatccaaataagt

SEQ ID NO: 83208 - DNA, 20 bp, Artificial Sequence
  Description of Artificial Sequence: Synthetic oligonucleotide
  Target: ATXN1; (-) strand; PAM type: NRG; PAM sequence: AAG
cctgaatattatatccaaat

SEQ ID NO: 83209 - DNA, 20 bp, Artificial Sequence
  Description of Artificial Sequence: Synthetic oligonucleotide
  Target: ATXN1; (-) strand; PAM type: NRG; PAM sequence: TGG
caggcatgcaccactgtgcc

SEQ ID NO: 83210 - DNA, 20 bp, Artificial Sequence
  Description of Artificial Sequence: Synthetic oligonucleotide
  Target: ATXN1; (-) strand; PAM type: NRG; PAM sequence: AGG
tctcaaagtgctgggattac

SEQ ID NO: 83211 - DNA, 20 bp, Artificial Sequence
  Description of Artificial Sequence: Synthetic oligonucleotide
  Target: ATXN1; (-) strand; PAM type: NRG; PAM sequence: CAG
ctctcaaagtgctgggatta

SEQ ID NO: 83212 - DNA, 20 bp, Artificial Sequence
  Description of Artificial Sequence: Synthetic oligonucleotide
  Target: ATXN1; (-) strand; PAM type: NRG; PAM sequence: GGG
ccttggcctctcaaagtgct

SEQ ID NO: 83213 - DNA, 20 bp, Artificial Sequence
  Description of Artificial Sequence: Synthetic oligonucleotide
  Target: ATXN1; (-) strand; PAM type: NRG; PAM sequence: TGG
gccttggcctctcaaagtgc

SEQ ID NO: 83214 - DNA, 20 bp, Artificial Sequence
  Description of Artificial Sequence: Synthetic oligonucleotide
  Target: ATXN1; (-) strand; PAM type: NRG; PAM sequence: AAG
catcctgccttggcctctca

SEQ ID NO: 83215 - DNA, 20 bp, Artificial Sequence
  Description of Artificial Sequence: Synthetic oligonucleotide
  Target: ATXN1; (-) strand; PAM type: NRG; PAM sequence: TGG
ctccagcaatcatcctgcct

SEQ ID NO: 83216 - DNA, 20 bp, Artificial Sequence
  Description of Artificial Sequence: Synthetic oligonucleotide
  Target: ATXN1; (-) strand; PAM type: NRG; PAM sequence: CAG
ggtctggaactcctgggctc

SEQ ID NO: 83217 - DNA, 20 bp, Artificial Sequence
  Description of Artificial Sequence: Synthetic oligonucleotide
  Target: ATXN1; (-) strand; PAM type: NRG; PAM sequence: GGG
cagactggtctggaactcct

SEQ ID NO: 83218 - DNA, 20 bp, Artificial Sequence
  Description of Artificial Sequence: Synthetic oligonucleotide
  Target: ATXN1; (-) strand; PAM type: NRG; PAM sequence: TGG
ccagactggtctggaactcc

SEQ ID NO: 83219 - DNA, 20 bp, Artificial Sequence
  Description of Artificial Sequence: Synthetic oligonucleotide
  Target: ATXN1; (-) strand; PAM type: NRG; PAM sequence: TGG
ctatgttgtccagactggtc

SEQ ID NO: 83220 - DNA, 20 bp, Artificial Sequence
  Description of Artificial Sequence: Synthetic oligonucleotide
  Target: ATXN1; (-) strand; PAM type: NRG; PAM sequence: TGG
tctcgctatgttgtccagac

SEQ ID NO: 83221 - DNA, 20 bp, Artificial Sequence
  Description of Artificial Sequence: Synthetic oligonucleotide
  Target: ATXN1; (-) strand; PAM type: NRG; PAM sequence: CAG
cgaggtctcgctatgttgtc

SEQ ID NO: 83222 - DNA, 20 bp, Artificial Sequence
  Description of Artificial Sequence: Synthetic oligonucleotide
  Target: ATXN1; (-) strand; PAM type: NRG; PAM sequence: AGG
tccatttttttgtagatacg

SEQ ID NO: 83223 - DNA, 20 bp, Artificial Sequence
  Description of Artificial Sequence: Synthetic oligonucleotide
  Target: ATXN1; (-) strand; PAM type: NRG; PAM sequence: GAG
ttccatttttttgtagatac

SEQ ID NO: 83224 - DNA, 20 bp, Artificial Sequence
  Description of Artificial Sequence: Synthetic oligonucleotide
  Target: ATXN1; (-) strand; PAM type: NRG; PAM sequence: TAG
ctaatttttccatttttttg

SEQ ID NO: 83225 - DNA, 20 bp, Artificial Sequence
  Description of Artificial Sequence: Synthetic oligonucleotide
  Target: ATXN1; (-) strand; PAM type: NRG; PAM sequence: TGG
caggcacgcgccaccatgcc

SEQ ID NO: 83226 - DNA, 20 bp, Artificial Sequence
  Description of Artificial Sequence: Synthetic oligonucleotide
  Target: ATXN1; (-) strand; PAM type: NRG; PAM sequence: AGG
agaccagtagccgagactac

SEQ ID NO: 83227 - DNA, 20 bp, Artificial Sequence
  Description of Artificial Sequence: Synthetic oligonucleotide
  Target: ATXN1; (-) strand; PAM type: NRG; PAM sequence: CAG
cagaccagtagccgagacta

SEQ ID NO: 83228 - DNA, 20 bp, Artificial Sequence
  Description of Artificial Sequence: Synthetic oligonucleotide
  Target: ATXN1; (-) strand; PAM type: NRG; PAM sequence: GAG
atcatcacagaccagtagcc

SEQ ID NO: 83229 - DNA, 20 bp, Artificial Sequence
  Description of Artificial Sequence: Synthetic oligonucleotide
  Target: ATXN1; (-) strand; PAM type: NRG; PAM sequence: TAG
gaatcatcatcacagaccag

SEQ ID NO: 83230 - DNA, 20 bp, Artificial Sequence
  Description of Artificial Sequence: Synthetic oligonucleotide
  Target: ATXN1; (-) strand; PAM type: NRG; PAM sequence: CAG
caggaatcatcatcacagac

SEQ ID NO: 83231 - DNA, 20 bp, Artificial Sequence
  Description of Artificial Sequence: Synthetic oligonucleotide
  Target: ATXN1; (-) strand; PAM type: NRG; PAM sequence: CAG
cagggcaggaatcatcatca

SEQ ID NO: 83232 - DNA, 20 bp, Artificial Sequence
  Description of Artificial Sequence: Synthetic oligonucleotide
  Target: ATXN1; (-) strand; PAM type: NRG; PAM sequence: AGG
ggtacacacagcttcagggc

SEQ ID NO: 83233 - DNA, 20 bp, Artificial Sequence
  Description of Artificial Sequence: Synthetic oligonucleotide
  Target: ATXN1; (-) strand; PAM type: NRG; PAM sequence: CAG
gggtacacacagcttcaggg

SEQ ID NO: 83234 - DNA, 20 bp, Artificial Sequence
  Description of Artificial Sequence: Synthetic oligonucleotide
  Target: ATXN1; (-) strand; PAM type: NRG; PAM sequence: GGG
caggggtacacacagcttca

SEQ ID NO: 83235 - DNA, 20 bp, Artificial Sequence
  Description of Artificial Sequence: Synthetic oligonucleotide
  Target: ATXN1; (-) strand; PAM type: NRG; PAM sequence: AGG
tcaggggtacacacagcttc

SEQ ID NO: 83236 - DNA, 20 bp, Artificial Sequence
  Description of Artificial Sequence: Synthetic oligonucleotide
  Target: ATXN1; (-) strand; PAM type: NRG; PAM sequence: CAG
atcaggggtacacacagctt

SEQ ID NO: 83237 - DNA, 20 bp, Artificial Sequence
  Description of Artificial Sequence: Synthetic oligonucleotide
  Target: ATXN1; (-) strand; PAM type: NRG; PAM sequence: CAG
cacgccatcaggggtacaca

SEQ ID NO: 83238 - DNA, 20 bp, Artificial Sequence
  Description of Artificial Sequence: Synthetic oligonucleotide
  Target: ATXN1; (-) strand; PAM type: NRG; PAM sequence: GGG
gtttgtcatcacgccatcag

SEQ ID NO: 83239 - DNA, 20 bp, Artificial Sequence
  Description of Artificial Sequence: Synthetic oligonucleotide
  Target: ATXN1; (-) strand; PAM type: NRG; PAM sequence: GGG
tgtttgtcatcacgccatca

SEQ ID NO: 83240 - DNA, 20 bp, Artificial Sequence
  Description of Artificial Sequence: Synthetic oligonucleotide
  Target: ATXN1; (-) strand; PAM type: NRG; PAM sequence: AGG
gtgtttgtcatcacgccatc

SEQ ID NO: 83241 - DNA, 20 bp, Artificial Sequence
  Description of Artificial Sequence: Synthetic oligonucleotide
  Target: ATXN1; (-) strand; PAM type: NRG; PAM sequence: CAG
agtgtttgtcatcacgccat

SEQ ID NO: 83242 - DNA, 20 bp, Artificial Sequence
  Description of Artificial Sequence: Synthetic oligonucleotide
  Target: ATXN1; (-) strand; PAM type: NRG; PAM sequence: TAG
actgctatgtgttgttctgt

SEQ ID NO: 83243 - DNA, 20 bp, Artificial Sequence
  Description of Artificial Sequence: Synthetic oligonucleotide
  Target: ATXN1; (-) strand; PAM type: NRG; PAM sequence: GGG
atgaacttctgtcacattta

SEQ ID NO: 83244 - DNA, 20 bp, Artificial Sequence
  Description of Artificial Sequence: Synthetic oligonucleotide
  Target: ATXN1; (-) strand; PAM type: NRG; PAM sequence: AGG
tatgaacttctgtcacattt

SEQ ID NO: 83245 - DNA, 20 bp, Artificial Sequence
  Description of Artificial Sequence: Synthetic oligonucleotide
  Target: ATXN1; (-) strand; PAM type: NRG; PAM sequence: TAG
ttatgaacttctgtcacatt

SEQ ID NO: 83246 - DNA, 20 bp, Artificial Sequence
  Description of Artificial Sequence: Synthetic oligonucleotide
  Target: ATXN1; (-) strand; PAM type: NRG; PAM sequence: TGG
atttttaggacttcgctgac

SEQ ID NO: 83247 - DNA, 20 bp, Artificial Sequence
  Description of Artificial Sequence: Synthetic oligonucleotide
  Target: ATXN1; (-) strand; PAM type: NRG; PAM sequence: AGG
aaagtcttcactgaattttt

SEQ ID NO: 83248 - DNA, 20 bp, Artificial Sequence
  Description of Artificial Sequence: Synthetic oligonucleotide
  Target: ATXN1; (-) strand; PAM type: NRG; PAM sequence: TAG
taaagtcttcactgaatttt

SEQ ID NO: 83249 - DNA, 20 bp, Artificial Sequence
  Description of Artificial Sequence: Synthetic oligonucleotide
  Target: ATXN1; (-) strand; PAM type: NRG; PAM sequence: AAG
tatcctggctgtcattcata

SEQ ID NO: 83250 - DNA, 20 bp, Artificial Sequence
  Description of Artificial Sequence: Synthetic oligonucleotide
  Target: ATXN1; (-) strand; PAM type: NRG; PAM sequence: TGG
atatgagactgggactatcc

SEQ ID NO: 83251 - DNA, 20 bp, Artificial Sequence
  Description of Artificial Sequence: Synthetic oligonucleotide
  Target: ATXN1; (-) strand; PAM type: NRG; PAM sequence: GGG
tgctgggaccatatgagact

SEQ ID NO: 83252 - DNA, 20 bp, Artificial Sequence
  Description of Artificial Sequence: Synthetic oligonucleotide
  Target: ATXN1; (-) strand; PAM type: NRG; PAM sequence: TGG
gtgctgggaccatatgagac

SEQ ID NO: 83253 - DNA, 20 bp, Artificial Sequence
  Description of Artificial Sequence: Synthetic oligonucleotide
  Target: ATXN1; (-) strand; PAM type: NRG; PAM sequence: GAG
agcttgtgctgggaccatat

SEQ ID NO: 83254 - DNA, 20 bp, Artificial Sequence
  Description of Artificial Sequence: Synthetic oligonucleotide
  Target: ATXN1; (-) strand; PAM type: NRG; PAM sequence: GGG
gtgcaatcgtagcttgtgct

SEQ ID NO: 83255 - DNA, 20 bp, Artificial Sequence
  Description of Artificial Sequence: Synthetic oligonucleotide
  Target: ATXN1; (-) strand; PAM type: NRG; PAM sequence: TGG
ggtgcaatcgtagcttgtgc

SEQ ID NO: 83256 - DNA, 20 bp, Artificial Sequence
  Description of Artificial Sequence: Synthetic oligonucleotide
  Target: ATXN1; (-) strand; PAM type: NRG; PAM sequence: TAG
ggactgcagtggtgcaatcg

SEQ ID NO: 83257 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggactgcag

SEQ ID NO: 83258 - DNA, 20 bp, Artificial Sequence
  Description of Artificial Sequence: Synthetic oligonucleotide
  Target: ATXN1; (-) strand; PAM type: NRG; PAM sequence: CAG
ttgttgcccaggctggactg

SEQ ID NO: 83259 - DNA, 20 bp, Artificial Sequence
  Description of Artificial Sequence: Synthetic oligonucleotide
  Target: ATXN1; (-) strand; PAM type: NRG; PAM sequence: TGG
tttctctttgttgcccaggc

SEQ ID NO: 83260 - DNA, 20 bp, Artificial Sequence
  Description of Artificial Sequence: Synthetic oligonucleotide
  Target: ATXN1; (-) strand; PAM type: NRG; PAM sequence: AGG
tttctttctctttgttgccc

SEQ ID NO: 83261 - DNA, 20 bp, Artificial Sequence
  Description of Artificial Sequence: Synthetic oligonucleotide
  Target: ATXN1; (-) strand; PAM type: NRG; PAM sequence: CAG
gtttctttctctttgttgcc

SEQ ID NO: 83262 - DNA, 20 bp, Artificial Sequence
  Description of Artificial Sequence: Synthetic oligonucleotide
  Target: ATXN1; (-) strand; PAM type: NRG; PAM sequence: GGG
ttatttatttatttgagacg

SEQ ID NO: 83263 - DNA, 20 bp, Artificial Sequence
  Description of Artificial Sequence: Synthetic oligonucleotide
  Target: ATXN1; (-) strand; PAM type: NRG; PAM sequence: GGG
tttatttatttatttgagac

SEQ ID NO: 83264 - DNA, 20 bp, Artificial Sequence
  Description of Artificial Sequence: Synthetic oligonucleotide
  Target: ATXN1; (-) strand; PAM type: NRG; PAM sequence: CGG
atttatttatttatttgaga

SEQ ID NO: 83265 - DNA, 20 bp, Artificial Sequence
  Description of Artificial Sequence: Synthetic oligonucleotide
  Target: ATXN1; (-) strand; PAM type: NRG; PAM sequence: GAG
atttatttatttatttattt

SEQ ID NO: 83266 - DNA, 20 bp, Artificial Sequence
  Description of Artificial Sequence: Synthetic oligonucleotide
  Target: ATXN1; (-) strand; PAM type: NRG; PAM sequence: CAG
cattaaaaaaaaatgtggca

SEQ ID NO: 83267 - DNA, 20 bp, Artificial Sequence
  Description of Artificial Sequence: Synthetic oligonucleotide
  Target: ATXN1; (-) strand; PAM type: NRG; PAM sequence: TGG
tgcaacattaaaaaaaaatg

SEQ ID NO: 83268 - DNA, 20 bp, Artificial Sequence
  Description of Artificial Sequence: Synthetic oligonucleotide
  Target: ATXN1; (-) strand; PAM type: NRG; PAM sequence: CAG
gaaccactgcacccggcccg

SEQ ID NO: 83269 - DNA, 20 bp, Artificial Sequence
  Description of Artificial Sequence: Synthetic oligonucleotide
  Target: ATXN1; (-) strand; PAM type: NRG; PAM sequence: CGG
cagatgtgaaccactgcacc

SEQ ID NO: 83270 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 83271 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 83272 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaagtgc

SEQ ID NO: 83273 - DNA, 20 bp, Artificial Sequence
  Description of Artificial Sequence: Synthetic oligonucleotide
  Target: ATXN1; (-) strand; PAM type: NRG; PAM sequence: AAG
ccgcctgcctcagcctccca

SEQ ID NO: 83274 - DNA, 20 bp, Artificial Sequence
  Description of Artificial Sequence: Synthetic oligonucleotide
  Target: ATXN1; (-) strand; PAM type: NRG; PAM sequence: CAG
ctcaggtgatccgcctgcct

SEQ ID NO: 83275 - DNA, 20 bp, Artificial Sequence
  Description of Artificial Sequence: Synthetic oligonucleotide
  Target: ATXN1; (-) strand; PAM type: NRG; PAM sequence: AGG
ggtctcgatctcctcacctc

SEQ ID NO: 83276 - DNA, 20 bp, Artificial Sequence
  Description of Artificial Sequence: Synthetic oligonucleotide
  Target: ATXN1; (-) strand; PAM type: NRG; PAM sequence: CAG
tggtctcgatctcctcacct

SEQ ID NO: 83277 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttagccagga

SEQ ID NO: 83278 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttagcc

SEQ ID NO: 83279 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttagc

SEQ ID NO: 83280 - DNA, 20 bp, Artificial Sequence
  Description of Artificial Sequence: Synthetic oligonucleotide
  Target: ATXN1; (-) strand; PAM type: NRG; PAM sequence: TAG
gagctggggtttcaccatgt

SEQ ID NO: 83281 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagctg

SEQ ID NO: 83282 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagct

SEQ ID NO: 83283 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagagc

SEQ ID NO: 83284 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 83285 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 83286 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 83287 - DNA, 20 bp, Artificial Sequence
  Description of Artificial Sequence: Synthetic oligonucleotide
  Target: ATXN1; (-) strand; PAM type: NRG; PAM sequence: CAG
cagatgcgtgccaccatgcc

SEQ ID NO: 83288 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggacta

SEQ ID NO: 83289 - DNA, 20 bp, Artificial Sequence
  Description of Artificial Sequence: Synthetic oligonucleotide
  Target: ATXN1; (-) strand; PAM type: NRG; PAM sequence: GGG
cctcaacctcccgagtagct

SEQ ID NO: 83290 - DNA, 20 bp, Artificial Sequence
  Description of Artificial Sequence: Synthetic oligonucleotide
  Target: ATXN1; (-) strand; PAM type: NRG; PAM sequence: TGG
gcctcaacctcccgagtagc

SEQ ID NO: 83291 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcaacctcccgag

SEQ ID NO: 83292 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcaacctccc

SEQ ID NO: 83293 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcccaggttc

SEQ ID NO: 83294 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccacctccc

SEQ ID NO: 83295 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccacctcc

SEQ ID NO: 83296 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcacagtct

SEQ ID NO: 83297 - DNA, 20 bp, Artificial Sequence
  Description of Artificial Sequence: Synthetic oligonucleotide
  Target: ATXN1; (-) strand; PAM type: NRG; PAM sequence: CAG
caggctggagtgcagtggca

SEQ ID NO: 83298 - DNA, 20 bp, Artificial Sequence
  Description of Artificial Sequence: Synthetic oligonucleotide
  Target: ATXN1; (-) strand; PAM type: NRG; PAM sequence: TGG
gtcaccaggctggagtgcag

SEQ ID NO: 83299 - DNA, 20 bp, Artificial Sequence
  Description of Artificial Sequence: Synthetic oligonucleotide
  Target: ATXN1; (-) strand; PAM type: NRG; PAM sequence: CAG
tctgtcaccaggctggagtg

SEQ ID NO: 83300 - DNA, 20 bp, Artificial Sequence
  Description of Artificial Sequence: Synthetic oligonucleotide
  Target: ATXN1; (-) strand; PAM type: NRG; PAM sequence: GAG
cttgctctgtcaccaggctg

SEQ ID NO: 83301 - DNA, 20 bp, Artificial Sequence
  Description of Artificial Sequence: Synthetic oligonucleotide
  Target: ATXN1; (-) strand; PAM type: NRG; PAM sequence: TGG
gtcttgctctgtcaccaggc

SEQ ID NO: 83302 - DNA, 20 bp, Artificial Sequence
  Description of Artificial Sequence: Synthetic oligonucleotide
  Target: ATXN1; (-) strand; PAM type: NRG; PAM sequence: AGG
tggagtcttgctctgtcacc

SEQ ID NO: 83303 - DNA, 20 bp, Artificial Sequence
  Description of Artificial Sequence: Synthetic oligonucleotide
  Target: ATXN1; (-) strand; PAM type: NRG; PAM sequence: CAG
atggagtcttgctctgtcac

SEQ ID NO: 83304 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagatg

SEQ ID NO: 83305 - DNA, 20 bp, Artificial Sequence
  Description of Artificial Sequence: Synthetic oligonucleotide
  Target: ATXN1; (-) strand; PAM type: NRG; PAM sequence: TGG
tgttttttttttttttgaga

SEQ ID NO: 83306 - DNA, 20 bp, Artificial Sequence
  Description of Artificial Sequence: Synthetic oligonucleotide
  Target: ATXN1; (-) strand; PAM type: NRG; PAM sequence: GAG
tttttgtttttttttttttt

SEQ ID NO: 83307 - DNA, 20 bp, Artificial Sequence
  Description of Artificial Sequence: Synthetic oligonucleotide
  Target: ATXN1; (-) strand; PAM type: NRG; PAM sequence: CAG
aacaggactgtcagcatctg

SEQ ID NO: 83308 - DNA, 20 bp, Artificial Sequence
  Description of Artificial Sequence: Synthetic oligonucleotide
  Target: ATXN1; (-) strand; PAM type: NRG; PAM sequence: CAG
ctttggtcaaacaggactgt

SEQ ID NO: 83309 - DNA, 20 bp, Artificial Sequence
  Description of Artificial Sequence: Synthetic oligonucleotide
  Target: ATXN1; (-) strand; PAM type: NRG; PAM sequence: AGG
agccagccctttggtcaaac

SEQ ID NO: 83310 - DNA, 20 bp, Artificial Sequence
  Description of Artificial Sequence: Synthetic oligonucleotide
  Target: ATXN1; (-) strand; PAM type: NRG; PAM sequence: CAG
cagccagccctttggtcaaa

SEQ ID NO: 83311 - DNA, 20 bp, Artificial Sequence
  Description of Artificial Sequence: Synthetic oligonucleotide
  Target: ATXN1; (-) strand; PAM type: NRG; PAM sequence: TGG
ccatttgacagccagccctt

SEQ ID NO: 83312 - DNA, 20 bp, Artificial Sequence
  Description of Artificial Sequence: Synthetic oligonucleotide
  Target: ATXN1; (-) strand; PAM type: NRG; PAM sequence: CAG
ccatttgcccatttgacagc

SEQ ID NO: 83313 - DNA, 20 bp, Artificial Sequence
  Description of Artificial Sequence: Synthetic oligonucleotide
  Target: ATXN1; (-) strand; PAM type: NRG; PAM sequence: CAG
ggccccatttgcccatttga

SEQ ID NO: 83314 - DNA, 20 bp, Artificial Sequence
  Description of Artificial Sequence: Synthetic oligonucleotide
  Target: ATXN1; (-) strand; PAM type: NRG; PAM sequence: TGG
ggtcctcggggggtccctcc

SEQ ID NO: 83315 - DNA, 20 bp, Artificial Sequence
  Description of Artificial Sequence: Synthetic oligonucleotide
  Target: ATXN1; (-) strand; PAM type: NRG; PAM sequence: GGG
aaaggagccaggtcctcggg

SEQ ID NO: 83316 - DNA, 20 bp, Artificial Sequence
  Description of Artificial Sequence: Synthetic oligonucleotide
  Target: ATXN1; (-) strand; PAM type: NRG; PAM sequence: GGG
gaaaggagccaggtcctcgg

SEQ ID NO: 83317 - DNA, 20 bp, Artificial Sequence
  Description of Artificial Sequence: Synthetic oligonucleotide
  Target: ATXN1; (-) strand; PAM type: NRG; PAM sequence: GGG
ggaaaggagccaggtcctcg

SEQ ID NO: 83318 - DNA, 20 bp, Artificial Sequence
  Description of Artificial Sequence: Synthetic oligonucleotide
  Target: ATXN1; (-) strand; PAM type: NRG; PAM sequence: GGG
aggaaaggagccaggtcctc

SEQ ID NO: 83319 - DNA, 20 bp, Artificial Sequence
  Description of Artificial Sequence: Synthetic oligonucleotide
  Target: ATXN1; (-) strand; PAM type: NRG; PAM sequence: CGG
gaggaaaggagccaggtcct

SEQ ID NO: 83320 - DNA, 20 bp, Artificial Sequence
  Description of Artificial Sequence: Synthetic oligonucleotide
  Target: ATXN1; (-) strand; PAM type: NRG; PAM sequence: AGG
cagtgtggaggaaaggagcc

SEQ ID NO: 83321 - DNA, 20 bp, Artificial Sequence
  Description of Artificial Sequence: Synthetic oligonucleotide
  Target: ATXN1; (-) strand; PAM type: NRG; PAM sequence: CAG
ccagtgtggaggaaaggagc

SEQ ID NO: 83322 - DNA, 20 bp, Artificial Sequence
  Description of Artificial Sequence: Synthetic oligonucleotide
  Target: ATXN1; (-) strand; PAM type: NRG; PAM sequence: GAG
tcaaccagtgtggaggaaag

SEQ ID NO: 83323 - DNA, 20 bp, Artificial Sequence
  Description of Artificial Sequence: Synthetic oligonucleotide
  Target: ATXN1; (-) strand; PAM type: NRG; PAM sequence: AGG
tatcaaccagtgtggaggaa

SEQ ID NO: 83324 - DNA, 20 bp, Artificial Sequence
  Description of Artificial Sequence: Synthetic oligonucleotide
  Target: ATXN1; (-) strand; PAM type: NRG; PAM sequence: AAG
gtatcaaccagtgtggagga

SEQ ID NO: 83325 - DNA, 20 bp, Artificial Sequence
  Description of Artificial Sequence: Synthetic oligonucleotide
  Target: ATXN1; (-) strand; PAM type: NRG; PAM sequence: AGG
cattgtatcaaccagtgtgg

SEQ ID NO: 83326 - DNA, 20 bp, Artificial Sequence
  Description of Artificial Sequence: Synthetic oligonucleotide
  Target: ATXN1; (-) strand; PAM type: NRG; PAM sequence: GAG
tcattgtatcaaccagtgtg

SEQ ID NO: 83327 - DNA, 20 bp, Artificial Sequence
  Description of Artificial Sequence: Synthetic oligonucleotide
  Target: ATXN1; (-) strand; PAM type: NRG; PAM sequence: TGG
gctcattgtatcaaccagtg

SEQ ID NO: 83328 - DNA, 20 bp, Artificial Sequence
  Description of Artificial Sequence: Synthetic oligonucleotide
  Target: ATXN1; (-) strand; PAM type: NRG; PAM sequence: CAG
gaggggctcattgtatcaac

SEQ ID NO: 83329 - DNA, 20 bp, Artificial Sequence
  Description of Artificial Sequence: Synthetic oligonucleotide
  Target: ATXN1; (-) strand; PAM type: NRG; PAM sequence: GGG
cttggtggtcatttgcagag

SEQ ID NO: 83330 - DNA, 20 bp, Artificial Sequence
  Description of Artificial Sequence: Synthetic oligonucleotide
  Target: ATXN1; (-) strand; PAM type: NRG; PAM sequence: GGG
gcttggtggtcatttgcaga

SEQ ID NO: 83331 - DNA, 20 bp, Artificial Sequence
  Description of Artificial Sequence: Synthetic oligonucleotide
  Target: ATXN1; (-) strand; PAM type: NRG; PAM sequence: AGG
ggcttggtggtcatttgcag

SEQ ID NO: 83332 - DNA, 20 bp, Artificial Sequence
  Description of Artificial Sequence: Synthetic oligonucleotide
  Target: ATXN1; (-) strand; PAM type: NRG; PAM sequence: GAG
aggcttggtggtcatttgca

SEQ ID NO: 83333 - DNA, 20 bp, Artificial Sequence
  Description of Artificial Sequence: Synthetic oligonucleotide
  Target: ATXN1; (-) strand; PAM type: NRG; PAM sequence: CAG
gtaggcttggtggtcatttg

SEQ ID NO: 83334 - DNA, 20 bp, Artificial Sequence
  Description of Artificial Sequence: Synthetic oligonucleotide
  Target: ATXN1; (-) strand; PAM type: NRG; PAM sequence: TGG
gaatttctgtgtaggcttgg

SEQ ID NO: 83335 - DNA, 20 bp, Artificial Sequence
  Description of Artificial Sequence: Synthetic oligonucleotide
  Target: ATXN1; (-) strand; PAM type: NRG; PAM sequence: TGG
acagaatttctgtgtaggct

SEQ ID NO: 83336 - DNA, 20 bp, Artificial Sequence
  Description of Artificial Sequence: Synthetic oligonucleotide
  Target: ATXN1; (-) strand; PAM type: NRG; PAM sequence: AGG
gcccaacagaatttctgtgt

SEQ ID NO: 83337 - DNA, 20 bp, Artificial Sequence
  Description of Artificial Sequence: Synthetic oligonucleotide
  Target: ATXN1; (-) strand; PAM type: NRG; PAM sequence: TAG
tgcccaacagaatttctgtg

SEQ ID NO: 83338 - DNA, 20 bp, Artificial Sequence
  Description of Artificial Sequence: Synthetic oligonucleotide
  Target: ATXN1; (-) strand; PAM type: NRG; PAM sequence: CAG
ccacttcagttcttgcccaa

SEQ ID NO: 83339 - DNA, 20 bp, Artificial Sequence
  Description of Artificial Sequence: Synthetic oligonucleotide
  Target: ATXN1; (-) strand; PAM type: NRG; PAM sequence: CAG
aattaaataattatccactt

SEQ ID NO: 83340 - DNA, 20 bp, Artificial Sequence
  Description of Artificial Sequence: Synthetic oligonucleotide
  Target: ATXN1; (-) strand; PAM type: NRG; PAM sequence: TAG
atttataattcagttccctc

SEQ ID NO: 83341 - DNA, 20 bp, Artificial Sequence
  Description of Artificial Sequence: Synthetic oligonucleotide
  Target: ATXN1; (-) strand; PAM type: NRG; PAM sequence: CAG
tctcctgcaaatttataatt

SEQ ID NO: 83342 - DNA, 20 bp, Artificial Sequence
  Description of Artificial Sequence: Synthetic oligonucleotide
  Target: ATXN1; (-) strand; PAM type: NRG; PAM sequence: AGG
atgtgcctaactgatctcca

SEQ ID NO: 83343 - DNA, 20 bp, Artificial Sequence
  Description of Artificial Sequence: Synthetic oligonucleotide
  Target: ATXN1; (-) strand; PAM type: NRG; PAM sequence: AAG
tatgtgcctaactgatctcc

SEQ ID NO: 83344 - DNA, 20 bp, Artificial Sequence
  Description of Artificial Sequence: Synthetic oligonucleotide
  Target: ATXN1; (-) strand; PAM type: NRG; PAM sequence: AAG
cttggaacgacttgccttta

SEQ ID NO: 83345 - DNA, 20 bp, Artificial Sequence
  Description of Artificial Sequence: Synthetic oligonucleotide
  Target: ATXN1; (-) strand; PAM type: NRG; PAM sequence: TGG
ggagaacttgctcatcatct

SEQ ID NO: 83346 - DNA, 20 bp, Artificial Sequence
  Description of Artificial Sequence: Synthetic oligonucleotide
  Target: ATXN1; (-) strand; PAM type: NRG; PAM sequence: GAG
cacctatcttggtcaccttg

SEQ ID NO: 83347 - DNA, 20 bp, Artificial Sequence
  Description of Artificial Sequence: Synthetic oligonucleotide
  Target: ATXN1; (-) strand; PAM type: NRG; PAM sequence: TGG
cccacctatcttggtcacct

SEQ ID NO: 83348 - DNA, 20 bp, Artificial Sequence
  Description of Artificial Sequence: Synthetic oligonucleotide
  Target: ATXN1; (-) strand; PAM type: NRG; PAM sequence: TGG
taggtctgccccacctatct

SEQ ID NO: 83349 - DNA, 20 bp, Artificial Sequence
  Description of Artificial Sequence: Synthetic oligonucleotide
  Target: ATXN1; (-) strand; PAM type: NRG; PAM sequence: AGG
gagtcctcaaattgaagcct

SEQ ID NO: 83350 - DNA, 20 bp, Artificial Sequence
  Description of Artificial Sequence: Synthetic oligonucleotide
  Target: ATXN1; (-) strand; PAM type: NRG; PAM sequence: TAG
agagtcctcaaattgaagcc

SEQ ID NO: 83351 - DNA, 20 bp, Artificial Sequence
  Description of Artificial Sequence: Synthetic oligonucleotide
  Target: ATXN1; (-) strand; PAM type: NRG; PAM sequence: AAG
gaagcagagtcctcaaattg

SEQ ID NO: 83352 - DNA, 20 bp, Artificial Sequence
  Description of Artificial Sequence: Synthetic oligonucleotide
  Target: ATXN1; (-) strand; PAM type: NRG; PAM sequence: GAG
catgatattacctggaagca

SEQ ID NO: 83353 - DNA, 20 bp, Artificial Sequence
  Description of Artificial Sequence: Synthetic oligonucleotide
  Target: ATXN1; (-) strand; PAM type: NRG; PAM sequence: CAG
ttcatgatattacctggaag

SEQ ID NO: 83354 - DNA, 20 bp, Artificial Sequence
  Description of Artificial Sequence: Synthetic oligonucleotide
  Target: ATXN1; (-) strand; PAM type: NRG; PAM sequence: AAG
ccgttcatgatattacctgg

SEQ ID NO: 83355 - DNA, 20 bp, Artificial Sequence
  Description of Artificial Sequence: Synthetic oligonucleotide
  Target: ATXN1; (-) strand; PAM type: NRG; PAM sequence: TGG
accccgttcatgatattacc

SEQ ID NO: 83356 - DNA, 20 bp, Artificial Sequence
  Description of Artificial Sequence: Synthetic oligonucleotide
  Target: ATXN1; (-) strand; PAM type: NRG; PAM sequence: AGG
ccaacataatgtggacttcc

SEQ ID NO: 83357 - DNA, 20 bp, Artificial Sequence
  Description of Artificial Sequence: Synthetic oligonucleotide
  Target: ATXN1; (-) strand; PAM type: NRG; PAM sequence: CAG
accaacataatgtggacttc

SEQ ID NO: 83358 - DNA, 20 bp, Artificial Sequence
  Description of Artificial Sequence: Synthetic oligonucleotide
  Target: ATXN1; (-) strand; PAM type: NRG; PAM sequence: TGG
gagcatacaccaacataatg

SEQ ID NO: 83359 - DNA, 20 bp, Artificial Sequence
  Description of Artificial Sequence: Synthetic oligonucleotide
  Target: ATXN1; (-) strand; PAM type: NRG; PAM sequence: GAG
taaatgataaaaccattcca

SEQ ID NO: 83360 - DNA, 20 bp, Artificial Sequence
  Description of Artificial Sequence: Synthetic oligonucleotide
  Target: ATXN1; (-) strand; PAM type: NRG; PAM sequence: CAG
aataaatgataaaaccattc

SEQ ID NO: 83361 - DNA, 20 bp, Artificial Sequence
  Description of Artificial Sequence: Synthetic oligonucleotide
  Target: ATXN1; (-) strand; PAM type: NRG; PAM sequence: TGG
gacagtcttagtctgggggt

SEQ ID NO: 83362 - DNA, 20 bp, Artificial Sequence
  Description of Artificial Sequence: Synthetic oligonucleotide
  Target: ATXN1; (-) strand; PAM type: NRG; PAM sequence: GGG
gaatgacagtcttagtctgg

SEQ ID NO: 83363 - DNA, 20 bp, Artificial Sequence
  Description of Artificial Sequence: Synthetic oligonucleotide
  Target: ATXN1; (-) strand; PAM type: NRG; PAM sequence: GGG
tgaatgacagtcttagtctg

SEQ ID NO: 83364 - DNA, 20 bp, Artificial Sequence
  Description of Artificial Sequence: Synthetic oligonucleotide
  Target: ATXN1; (-) strand; PAM type: NRG; PAM sequence: GGG
ttgaatgacagtcttagtct

SEQ ID NO: 83365 - DNA, 20 bp, Artificial Sequence
  Description of Artificial Sequence: Synthetic oligonucleotide
  Target: ATXN1; (-) strand; PAM type: NRG; PAM sequence: TGG
cttgaatgacagtcttagtc

SEQ ID NO: 83366 - DNA, 20 bp, Artificial Sequence
  Description of Artificial Sequence: Synthetic oligonucleotide
  Target: ATXN1; (-) strand; PAM type: NRG; PAM sequence: TAG
gggcccttgaatgacagtct

SEQ ID NO: 83367 - DNA, 20 bp, Artificial Sequence
  Description of Artificial Sequence: Synthetic oligonucleotide
  Target: ATXN1; (-) strand; PAM type: NRG; PAM sequence: CAG
atacatgggcccttgaatga

SEQ ID NO: 83368 - DNA, 20 bp, Artificial Sequence
  Description of Artificial Sequence: Synthetic oligonucleotide
  Target: ATXN1; (-) strand; PAM type: NRG; PAM sequence: GGG
agtaacttttaagtatacat

SEQ ID NO: 83369 - DNA, 20 bp, Artificial Sequence
  Description of Artificial Sequence: Synthetic oligonucleotide
  Target: ATXN1; (-) strand; PAM type: NRG; PAM sequence: TGG
gagtaacttttaagtataca

SEQ ID NO: 83370 - DNA, 20 bp, Artificial Sequence
  Description of Artificial Sequence: Synthetic oligonucleotide
  Target: ATXN1; (-) strand; PAM type: NRG; PAM sequence: AAG
acatttactgagtaactttt

SEQ ID NO: 83371 - DNA, 20 bp, Artificial Sequence
  Description of Artificial Sequence: Synthetic oligonucleotide
  Target: ATXN1; (-) strand; PAM type: NRG; PAM sequence: GAG
ctgttcagcaaacatttact

SEQ ID NO: 83372 - DNA, 20 bp, Artificial Sequence
  Description of Artificial Sequence: Synthetic oligonucleotide
  Target: ATXN1; (-) strand; PAM type: NRG; PAM sequence: CAG
gggggtttccaagtcctgtt

SEQ ID NO: 83373 - DNA, 20 bp, Artificial Sequence
  Description of Artificial Sequence: Synthetic oligonucleotide
  Target: ATXN1; (-) strand; PAM type: NRG; PAM sequence: AAG
gaaagatgatgggggtttcc

SEQ ID NO: 83374 - DNA, 20 bp, Artificial Sequence
  Description of Artificial Sequence: Synthetic oligonucleotide
  Target: ATXN1; (-) strand; PAM type: NRG; PAM sequence: GGG
ggcaaggtgaaagatgatgg

SEQ ID NO: 83375 - DNA, 20 bp, Artificial Sequence
  Description of Artificial Sequence: Synthetic oligonucleotide
  Target: ATXN1; (-) strand; PAM type: NRG; PAM sequence: GGG
gggcaaggtgaaagatgatg

SEQ ID NO: 83376 - DNA, 20 bp, Artificial Sequence
  Description of Artificial Sequence: Synthetic oligonucleotide
  Target: ATXN1; (-) strand; PAM type: NRG; PAM sequence: GGG
tgggcaaggtgaaagatgat

SEQ ID NO: 83377 - DNA, 20 bp, Artificial Sequence
  Description of Artificial Sequence: Synthetic oligonucleotide
  Target: ATXN1; (-) strand; PAM type: NRG; PAM sequence: TGG
atgggcaaggtgaaagatga

SEQ ID NO: 83378 - DNA, 20 bp, Artificial Sequence
  Description of Artificial Sequence: Synthetic oligonucleotide
  Target: ATXN1; (-) strand; PAM type: NRG; PAM sequence: AAG
tattgtgatgggcaaggtga

SEQ ID NO: 83379 - DNA, 20 bp, Artificial Sequence
  Description of Artificial Sequence: Synthetic oligonucleotide
  Target: ATXN1; (-) strand; PAM type: NRG; PAM sequence: AGG
catgactattgtgatgggca

SEQ ID NO: 83380 - DNA, 20 bp, Artificial Sequence
  Description of Artificial Sequence: Synthetic oligonucleotide
  Target: ATXN1; (-) strand; PAM type: NRG; PAM sequence: AAG
gcatgactattgtgatgggc

SEQ ID NO: 83381 - DNA, 20 bp, Artificial Sequence
  Description of Artificial Sequence: Synthetic oligonucleotide
  Target: ATXN1; (-) strand; PAM type: NRG; PAM sequence: GGG
tgatgcatgactattgtgat

SEQ ID NO: 83382 - DNA, 20 bp, Artificial Sequence
  Description of Artificial Sequence: Synthetic oligonucleotide
  Target: ATXN1; (-) strand; PAM type: NRG; PAM sequence: TGG
atgatgcatgactattgtga

SEQ ID NO: 83383 - DNA, 20 bp, Artificial Sequence
  Description of Artificial Sequence: Synthetic oligonucleotide
  Target: ATXN1; (-) strand; PAM type: NRG; PAM sequence: GAG
acctaacaatgcatttctca

SEQ ID NO: 83384 - DNA, 20 bp, Artificial Sequence
  Description of Artificial Sequence: Synthetic oligonucleotide
  Target: ATXN1; (-) strand; PAM type: NRG; PAM sequence: CAG
tcacctaacaatgcatttct

SEQ ID NO: 83385 - DNA, 20 bp, Artificial Sequence
  Description of Artificial Sequence: Synthetic oligonucleotide
  Target: ATXN1; (-) strand; PAM type: NRG; PAM sequence: AAG
tgtgatgttgcacagtgaca

SEQ ID NO: 83386 - DNA, 20 bp, Artificial Sequence
  Description of Artificial Sequence: Synthetic oligonucleotide
  Target: ATXN1; (-) strand; PAM type: NRG; PAM sequence: CAG
aagtactctgtgatgttgca

SEQ ID NO: 83387 - DNA, 20 bp, Artificial Sequence
  Description of Artificial Sequence: Synthetic oligonucleotide
  Target: ATXN1; (-) strand; PAM type: NRG; PAM sequence: AAG
tgtaccatccaggcctgtga

SEQ ID NO: 83388 - DNA, 20 bp, Artificial Sequence
  Description of Artificial Sequence: Synthetic oligonucleotide
  Target: ATXN1; (-) strand; PAM type: NRG; PAM sequence: AGG
tgtagtagggtgtaccatcc

SEQ ID NO: 83389 - DNA, 20 bp, Artificial Sequence
  Description of Artificial Sequence: Synthetic oligonucleotide
  Target: ATXN1; (-) strand; PAM type: NRG; PAM sequence: CAG
gtgtagtagggtgtaccatc

SEQ ID NO: 83390 - DNA, 20 bp, Artificial Sequence
  Description of Artificial Sequence: Synthetic oligonucleotide
  Target: ATXN1; (-) strand; PAM type: NRG; PAM sequence: GGG
tatagcgcaggcgtgtagta

SEQ ID NO: 83391 - DNA, 20 bp, Artificial Sequence
  Description of Artificial Sequence: Synthetic oligonucleotide
  Target: ATXN1; (-) strand; PAM type: NRG; PAM sequence: AGG
gtatagcgcaggcgtgtagt

SEQ ID NO: 83392 - DNA, 20 bp, Artificial Sequence
  Description of Artificial Sequence: Synthetic oligonucleotide
  Target: ATXN1; (-) strand; PAM type: NRG; PAM sequence: TAG
cgtatagcgcaggcgtgtag

SEQ ID NO: 83393 - DNA, 20 bp, Artificial Sequence
  Description of Artificial Sequence: Synthetic oligonucleotide
  Target: ATXN1; (-) strand; PAM type: NRG; PAM sequence: TAG
taccgtatagcgcaggcgtg

SEQ ID NO: 83394 - DNA, 20 bp, Artificial Sequence
  Description of Artificial Sequence: Synthetic oligonucleotide
  Target: ATXN1; (-) strand; PAM type: NRG; PAM sequence: AGG
taagctataccgtatagcgc

SEQ ID NO: 83395 - DNA, 20 bp, Artificial Sequence
  Description of Artificial Sequence: Synthetic oligonucleotide
  Target: ATXN1; (-) strand; PAM type: NRG; PAM sequence: CAG
ataagctataccgtatagcg

SEQ ID NO: 83396 - DNA, 20 bp, Artificial Sequence
  Description of Artificial Sequence: Synthetic oligonucleotide
  Target: ATXN1; (-) strand; PAM type: NRG; PAM sequence: TAG
gagcaataagctataccgta

SEQ ID NO: 83397 - DNA, 20 bp, Artificial Sequence
  Description of Artificial Sequence: Synthetic oligonucleotide
  Target: ATXN1; (-) strand; PAM type: NRG; PAM sequence: AAG
gtttgtagcctaggagcaat

SEQ ID NO: 83398 - DNA, 20 bp, Artificial Sequence
  Description of Artificial Sequence: Synthetic oligonucleotide
  Target: ATXN1; (-) strand; PAM type: NRG; PAM sequence: GAG
cgtccaggtttgtagcctag

SEQ ID NO: 83399 - DNA, 20 bp, Artificial Sequence
  Description of Artificial Sequence: Synthetic oligonucleotide
  Target: ATXN1; (-) strand; PAM type: NRG; PAM sequence: AGG
gccgtccaggtttgtagcct

SEQ ID NO: 83400 - DNA, 20 bp, Artificial Sequence
  Description of Artificial Sequence: Synthetic oligonucleotide
  Target: ATXN1; (-) strand; PAM type: NRG; PAM sequence: TAG
tgccgtccaggtttgtagcc

SEQ ID NO: 83401 - DNA, 20 bp, Artificial Sequence
  Description of Artificial Sequence: Synthetic oligonucleotide
  Target: ATXN1; (-) strand; PAM type: NRG; PAM sequence: TAG
tagcatgccgtccaggtttg

SEQ ID NO: 83402 - DNA, 20 bp, Artificial Sequence
  Description of Artificial Sequence: Synthetic oligonucleotide
  Target: ATXN1; (-) strand; PAM type: NRG; PAM sequence: AGG
actacagtagcatgccgtcc

SEQ ID NO: 83403 - DNA, 20 bp, Artificial Sequence
  Description of Artificial Sequence: Synthetic oligonucleotide
  Target: ATXN1; (-) strand; PAM type: NRG; PAM sequence: CAG
cactacagtagcatgccgtc

SEQ ID NO: 83404 - DNA, 20 bp, Artificial Sequence
  Description of Artificial Sequence: Synthetic oligonucleotide
  Target: ATXN1; (-) strand; PAM type: NRG; PAM sequence: TAG
gcctacagtattcactacag

SEQ ID NO: 83405 - DNA, 20 bp, Artificial Sequence
  Description of Artificial Sequence: Synthetic oligonucleotide
  Target: ATXN1; (-) strand; PAM type: NRG; PAM sequence: CAG
gttgcctacagtattcacta

SEQ ID NO: 83406 - DNA, 20 bp, Artificial Sequence
  Description of Artificial Sequence: Synthetic oligonucleotide
  Target: ATXN1; (-) strand; PAM type: NRG; PAM sequence: CAG
cattgtgttacagttgccta

SEQ ID NO: 83407 - DNA, 20 bp, Artificial Sequence
  Description of Artificial Sequence: Synthetic oligonucleotide
  Target: ATXN1; (-) strand; PAM type: NRG; PAM sequence: CAG
aaatgcctaccattgtgtta

SEQ ID NO: 83408 - DNA, 20 bp, Artificial Sequence
  Description of Artificial Sequence: Synthetic oligonucleotide
  Target: ATXN1; (-) strand; PAM type: NRG; PAM sequence: AGG
ctatgtttagatgtgtttag

SEQ ID NO: 83409 - DNA, 20 bp, Artificial Sequence
  Description of Artificial Sequence: Synthetic oligonucleotide
  Target: ATXN1; (-) strand; PAM type: NRG; PAM sequence: GAG
tctatgtttagatgtgttta

SEQ ID NO: 83410 - DNA, 20 bp, Artificial Sequence
  Description of Artificial Sequence: Synthetic oligonucleotide
  Target: ATXN1; (-) strand; PAM type: NRG; PAM sequence: TAG
tttctatgtttagatgtgtt

SEQ ID NO: 83411 - DNA, 20 bp, Artificial Sequence
  Description of Artificial Sequence: Synthetic oligonucleotide
  Target: ATXN1; (-) strand; PAM type: NRG; PAM sequence: TAG
ggttgtaccttttctatgtt

SEQ ID NO: 83412 - DNA, 20 bp, Artificial Sequence
  Description of Artificial Sequence: Synthetic oligonucleotide
  Target: ATXN1; (-) strand; PAM type: NRG; PAM sequence: TGG
aagattataatactgtattt

SEQ ID NO: 83413 - DNA, 20 bp, Artificial Sequence
  Description of Artificial Sequence: Synthetic oligonucleotide
  Target: ATXN1; (-) strand; PAM type: NRG; PAM sequence: AAG
tcaaaaaaaaaaaaaaaaaa

SEQ ID NO: 83414 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcgacagagc

SEQ ID NO: 83415 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcgaca

SEQ ID NO: 83416 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcga

SEQ ID NO: 83417 - DNA, 20 bp, Artificial Sequence
  Description of Artificial Sequence: Synthetic oligonucleotide
  Target: ATXN1; (-) strand; PAM type: NRG; PAM sequence: GGG
gcaccactgcactccagcct

SEQ ID NO: 83418 - DNA, 20 bp, Artificial Sequence
  Description of Artificial Sequence: Synthetic oligonucleotide
  Target: ATXN1; (-) strand; PAM type: NRG; PAM sequence: TGG
tgcaccactgcactccagcc

SEQ ID NO: 83419 - DNA, 20 bp, Artificial Sequence
  Description of Artificial Sequence: Synthetic oligonucleotide
  Target: ATXN1; (-) strand; PAM type: NRG; PAM sequence: CAG
gagattgcaccactgcactc

SEQ ID NO: 83420 - DNA, 20 bp, Artificial Sequence
  Description of Artificial Sequence: Synthetic oligonucleotide
  Target: ATXN1; (-) strand; PAM type: NRG; PAM sequence: GAG
ggcagagcttgcagtgagcc

SEQ ID NO: 83421 - DNA, 20 bp, Artificial Sequence
  Description of Artificial Sequence: Synthetic oligonucleotide
  Target: ATXN1; (-) strand; PAM type: NRG; PAM sequence: GAG
tgggaggcagagcttgcagt

SEQ ID NO: 83422 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcagagcttg

SEQ ID NO: 83423 - DNA, 20 bp, Artificial Sequence
  Description of Artificial Sequence: Synthetic oligonucleotide
  Target: ATXN1; (-) strand; PAM type: NRG; PAM sequence: GAG
tggcgtgaacctgggaggca

SEQ ID NO: 83424 - DNA, 20 bp, Artificial Sequence
  Description of Artificial Sequence: Synthetic oligonucleotide
  Target: ATXN1; (-) strand; PAM type: NRG; PAM sequence: CAG
aatggcgtgaacctgggagg

SEQ ID NO: 83425 - DNA, 20 bp, Artificial Sequence
  Description of Artificial Sequence: Synthetic oligonucleotide
  Target: ATXN1; (-) strand; PAM type: NRG; PAM sequence: AGG
cagaatggcgtgaacctggg

SEQ ID NO: 83426 - DNA, 20 bp, Artificial Sequence
  Description of Artificial Sequence: Synthetic oligonucleotide
  Target: ATXN1; (-) strand; PAM type: NRG; PAM sequence: GAG
gcagaatggcgtgaacctgg

SEQ ID NO: 83427 - DNA, 20 bp, Artificial Sequence
  Description of Artificial Sequence: Synthetic oligonucleotide
  Target: ATXN1; (-) strand; PAM type: NRG; PAM sequence: GGG
cagcagaatggcgtgaacct

SEQ ID NO: 83428 - DNA, 20 bp, Artificial Sequence
  Description of Artificial Sequence: Synthetic oligonucleotide
  Target: ATXN1; (-) strand; PAM type: NRG; PAM sequence: TGG
gcagcagaatggcgtgaacc

SEQ ID NO: 83429 - DNA, 20 bp, Artificial Sequence
  Description of Artificial Sequence: Synthetic oligonucleotide
  Target: ATXN1; (-) strand; PAM type: NRG; PAM sequence: TGG
gggaggctgaggcagcagaa

SEQ ID NO: 83430 - DNA, 20 bp, Artificial Sequence
  Description of Artificial Sequence: Synthetic oligonucleotide
  Target: ATXN1; (-) strand; PAM type: NRG; PAM sequence: CAG
tacttgggaggctgaggcag

SEQ ID NO: 83431 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 83432 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 83433 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 83434 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctacttggg

SEQ ID NO: 83435 - DNA, 20 bp, Artificial Sequence
  Description of Artificial Sequence: Synthetic oligonucleotide
  Target: ATXN1; (-) strand; PAM type: NRG; PAM sequence: GAG
ttgtagtcccagctacttgg

SEQ ID NO: 83436 - DNA, 20 bp, Artificial Sequence
  Description of Artificial Sequence: Synthetic oligonucleotide
  Target: ATXN1; (-) strand; PAM type: NRG; PAM sequence: GGG
gcttgtagtcccagctactt

SEQ ID NO: 83437 - DNA, 20 bp, Artificial Sequence
  Description of Artificial Sequence: Synthetic oligonucleotide
  Target: ATXN1; (-) strand; PAM type: NRG; PAM sequence: TGG
cgcttgtagtcccagctact

SEQ ID NO: 83438 - DNA, 20 bp, Artificial Sequence
  Description of Artificial Sequence: Synthetic oligonucleotide
  Target: ATXN1; (-) strand; PAM type: NRG; PAM sequence: CAG
gtggcgggcgcttgtagtcc

SEQ ID NO: 83439 - DNA, 20 bp, Artificial Sequence
  Description of Artificial Sequence: Synthetic oligonucleotide
  Target: ATXN1; (-) strand; PAM type: NRG; PAM sequence: TAG
ggtgtagtggcgggcgcttg

SEQ ID NO: 83440 - DNA, 20 bp, Artificial Sequence
  Description of Artificial Sequence: Synthetic oligonucleotide
  Target: ATXN1; (-) strand; PAM type: NRG; PAM sequence: GGG
aattagccgggtgtagtggc

SEQ ID NO: 83441 - DNA, 20 bp, Artificial Sequence
  Description of Artificial Sequence: Synthetic oligonucleotide
  Target: ATXN1; (-) strand; PAM type: NRG; PAM sequence: CGG
aaattagccgggtgtagtgg

SEQ ID NO: 83442 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccgggtgtag

SEQ ID NO: 83443 - DNA, 20 bp, Artificial Sequence
  Description of Artificial Sequence: Synthetic oligonucleotide
  Target: ATXN1; (-) strand; PAM type: NRG; PAM sequence: TAG
aaaaaaaaattagccgggtg

SEQ ID NO: 83444 - DNA, 20 bp, Artificial Sequence
  Description of Artificial Sequence: Synthetic oligonucleotide
  Target: ATXN1; (-) strand; PAM type: NRG; PAM sequence: GGG
atacaaaaaaaaaattagcc

SEQ ID NO: 83445 - DNA, 20 bp, Artificial Sequence
  Description of Artificial Sequence: Synthetic oligonucleotide
  Target: ATXN1; (-) strand; PAM type: NRG; PAM sequence: CGG
aatacaaaaaaaaaattagc

SEQ ID NO: 83446 - DNA, 20 bp, Artificial Sequence
  Description of Artificial Sequence: Synthetic oligonucleotide
  Target: ATXN1; (-) strand; PAM type: NRG; PAM sequence: TAG
taagaatacaaaaaaaaaat

SEQ ID NO: 83447 - DNA, 20 bp, Artificial Sequence
  Description of Artificial Sequence: Synthetic oligonucleotide
  Target: ATXN1; (-) strand; PAM type: NRG; PAM sequence: AAG
ggtgaaaccctgtctctact

SEQ ID NO: 83448 - DNA, 20 bp, Artificial Sequence
  Description of Artificial Sequence: Synthetic oligonucleotide
  Target: ATXN1; (-) strand; PAM type: NRG; PAM sequence: CGG
tgagatcatcctggctaacg

SEQ ID NO: 83449 - DNA, 20 bp, Artificial Sequence
  Description of Artificial Sequence: Synthetic oligonucleotide
  Target: ATXN1; (-) strand; PAM type: NRG; PAM sequence: TGG
tcaggagattgagatcatcc

SEQ ID NO: 83450 - DNA, 20 bp, Artificial Sequence
  Description of Artificial Sequence: Synthetic oligonucleotide
  Target: ATXN1; (-) strand; PAM type: NRG; PAM sequence: GAG
gatcacgaggtcaggagatt

SEQ ID NO: 83451 - DNA, 20 bp, Artificial Sequence
  Description of Artificial Sequence: Synthetic oligonucleotide
  Target: ATXN1; (-) strand; PAM type: NRG; PAM sequence: GAG
cgcgcggatcacgaggtcag

SEQ ID NO: 83452 - DNA, 20 bp, Artificial Sequence
  Description of Artificial Sequence: Synthetic oligonucleotide
  Target: ATXN1; (-) strand; PAM type: NRG; PAM sequence: AGG
ggcgcgcggatcacgaggtc

SEQ ID NO: 83453 - DNA, 20 bp, Artificial Sequence
  Description of Artificial Sequence: Synthetic oligonucleotide
  Target: ATXN1; (-) strand; PAM type: NRG; PAM sequence: CAG
aggcgcgcggatcacgaggt

SEQ ID NO: 83454 - DNA, 20 bp, Artificial Sequence
  Description of Artificial Sequence: Synthetic oligonucleotide
  Target: ATXN1; (-) strand; PAM type: NRG; PAM sequence: AGG
gccgaggcgcgcggatcacg

SEQ ID NO: 83455 - DNA, 20 bp, Artificial Sequence
  Description of Artificial Sequence: Synthetic oligonucleotide
  Target: ATXN1; (-) strand; PAM type: NRG; PAM sequence: GAG
ggccgaggcgcgcggatcac

SEQ ID NO: 83456 - DNA, 20 bp, Artificial Sequence
  Description of Artificial Sequence: Synthetic oligonucleotide
  Target: ATXN1; (-) strand; PAM type: NRG; PAM sequence: CGG
ctttgggaggccgaggcgcg

SEQ ID NO: 83457 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 83458 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 83459 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 83460 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 83461 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 83462 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 83463 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 83464 - DNA, 20 bp, Artificial Sequence
  Description of Artificial Sequence: Synthetic oligonucleotide
  Target: ATXN1; (-) strand; PAM type: NRG; PAM sequence: TGG
taatactgggctgggtgtgg

SEQ ID NO: 83465 - DNA, 20 bp, Artificial Sequence
  Description of Artificial Sequence: Synthetic oligonucleotide
  Target: ATXN1; (-) strand; PAM type: NRG; PAM sequence: TGG
ttataatactgggctgggtg

SEQ ID NO: 83466 - DNA, 20 bp, Artificial Sequence
  Description of Artificial Sequence: Synthetic oligonucleotide
  Target: ATXN1; (-) strand; PAM type: NRG; PAM sequence: GGG
taagattataatactgggct

SEQ ID NO: 83467 - DNA, 20 bp, Artificial Sequence
  Description of Artificial Sequence: Synthetic oligonucleotide
  Target: ATXN1; (-) strand; PAM type: NRG; PAM sequence: TGG
ataagattataatactgggc

SEQ ID NO: 83468 - DNA, 20 bp, Artificial Sequence
  Description of Artificial Sequence: Synthetic oligonucleotide
  Target: ATXN1; (-) strand; PAM type: NRG; PAM sequence: GGG
tcccataagattataatact

SEQ ID NO: 83469 - DNA, 20 bp, Artificial Sequence
  Description of Artificial Sequence: Synthetic oligonucleotide
  Target: ATXN1; (-) strand; PAM type: NRG; PAM sequence: TGG
gtcccataagattataatac

SEQ ID NO: 83470 - DNA, 20 bp, Artificial Sequence
  Description of Artificial Sequence: Synthetic oligonucleotide
  Target: ATXN1; (-) strand; PAM type: NRG; PAM sequence: AAG
acgtattacagtggtcccat

SEQ ID NO: 83471 - DNA, 20 bp, Artificial Sequence
  Description of Artificial Sequence: Synthetic oligonucleotide
  Target: ATXN1; (-) strand; PAM type: NRG; PAM sequence: TGG
acagatcacacgtattacag

SEQ ID NO: 83472 - DNA, 20 bp, Artificial Sequence
  Description of Artificial Sequence: Synthetic oligonucleotide
  Target: ATXN1; (-) strand; PAM type: NRG; PAM sequence: CAG
acgacagatcacacgtatta

SEQ ID NO: 83473 - DNA, 20 bp, Artificial Sequence
  Description of Artificial Sequence: Synthetic oligonucleotide
  Target: ATXN1; (-) strand; PAM type: NRG; PAM sequence: CAG
aatgaagtttcagtcaacga

SEQ ID NO: 83474 - DNA, 20 bp, Artificial Sequence
  Description of Artificial Sequence: Synthetic oligonucleotide
  Target: ATXN1; (-) strand; PAM type: NRG; PAM sequence: CAG
tgtgccacataatgaagttt

SEQ ID NO: 83475 - DNA, 20 bp, Artificial Sequence
  Description of Artificial Sequence: Synthetic oligonucleotide
  Target: ATXN1; (-) strand; PAM type: NRG; PAM sequence: AAG
cagtcatgtgccacataatg

SEQ ID NO: 83476 - DNA, 20 bp, Artificial Sequence
  Description of Artificial Sequence: Synthetic oligonucleotide
  Target: ATXN1; (-) strand; PAM type: NRG; PAM sequence: CAG
ttgcgtcttgtgatcaaata

SEQ ID NO: 83477 - DNA, 20 bp, Artificial Sequence
  Description of Artificial Sequence: Synthetic oligonucleotide
  Target: ATXN1; (-) strand; PAM type: NRG; PAM sequence: AAG
agtagattcaatttaatggc

SEQ ID NO: 83478 - DNA, 20 bp, Artificial Sequence
  Description of Artificial Sequence: Synthetic oligonucleotide
  Target: ATXN1; (-) strand; PAM type: NRG; PAM sequence: TGG
aggaagtagattcaatttaa

SEQ ID NO: 83479 - DNA, 20 bp, Artificial Sequence
  Description of Artificial Sequence: Synthetic oligonucleotide
  Target: ATXN1; (-) strand; PAM type: NRG; PAM sequence: TAG
attaatcgcacgagaggaag

SEQ ID NO: 83480 - DNA, 20 bp, Artificial Sequence
  Description of Artificial Sequence: Synthetic oligonucleotide
  Target: ATXN1; (-) strand; PAM type: NRG; PAM sequence: AAG
gggattaatcgcacgagagg

SEQ ID NO: 83481 - DNA, 20 bp, Artificial Sequence
  Description of Artificial Sequence: Synthetic oligonucleotide
  Target: ATXN1; (-) strand; PAM type: NRG; PAM sequence: AGG
taagggattaatcgcacgag

SEQ ID NO: 83482 - DNA, 20 bp, Artificial Sequence
  Description of Artificial Sequence: Synthetic oligonucleotide
  Target: ATXN1; (-) strand; PAM type: NRG; PAM sequence: GAG
ataagggattaatcgcacga

SEQ ID NO: 83483 - DNA, 20 bp, Artificial Sequence
  Description of Artificial Sequence: Synthetic oligonucleotide
  Target: ATXN1; (-) strand; PAM type: NRG; PAM sequence: GAG
acataagggattaatcgcac

SEQ ID NO: 83484 - DNA, 20 bp, Artificial Sequence
  Description of Artificial Sequence: Synthetic oligonucleotide
  Target: ATXN1; (-) strand; PAM type: NRG; PAM sequence: GGG
cattttagctgaaaacataa

SEQ ID NO: 83485 - DNA, 20 bp, Artificial Sequence
  Description of Artificial Sequence: Synthetic oligonucleotide
  Target: ATXN1; (-) strand; PAM type: NRG; PAM sequence: AGG
ccattttagctgaaaacata

SEQ ID NO: 83486 - DNA, 20 bp, Artificial Sequence
  Description of Artificial Sequence: Synthetic oligonucleotide
  Target: ATXN1; (-) strand; PAM type: NRG; PAM sequence: AAG
tccattttagctgaaaacat

SEQ ID NO: 83487 - DNA, 20 bp, Artificial Sequence
  Description of Artificial Sequence: Synthetic oligonucleotide
  Target: ATXN1; (-) strand; PAM type: NRG; PAM sequence: TAG
atctaccagatactccattt

SEQ ID NO: 83488 - DNA, 20 bp, Artificial Sequence
  Description of Artificial Sequence: Synthetic oligonucleotide
  Target: ATXN1; (-) strand; PAM type: NRG; PAM sequence: CAG
agcaaataaactacatctac

SEQ ID NO: 83489 - DNA, 20 bp, Artificial Sequence
  Description of Artificial Sequence: Synthetic oligonucleotide
  Target: ATXN1; (-) strand; PAM type: NRG; PAM sequence: CAG
caaacaactaaacacacaaa

SEQ ID NO: 83490 - DNA, 20 bp, Artificial Sequence
  Description of Artificial Sequence: Synthetic oligonucleotide
  Target: ATXN1; (-) strand; PAM type: NRG; PAM sequence: AAG
aaagaacaaaagcaaaaaca

SEQ ID NO: 83491 - DNA, 20 bp, Artificial Sequence
  Description of Artificial Sequence: Synthetic oligonucleotide
  Target: ATXN1; (-) strand; PAM type: NRG; PAM sequence: AAG
gtggttagaaaaaagaacaa

SEQ ID NO: 83492 - DNA, 20 bp, Artificial Sequence
  Description of Artificial Sequence: Synthetic oligonucleotide
  Target: ATXN1; (-) strand; PAM type: NRG; PAM sequence: AAG
atgtatttgtggttagaaaa

SEQ ID NO: 83493 - DNA, 20 bp, Artificial Sequence
  Description of Artificial Sequence: Synthetic oligonucleotide
  Target: ATXN1; (-) strand; PAM type: NRG; PAM sequence: TAG
gaatagaatgtatttgtggt

SEQ ID NO: 83494 - DNA, 20 bp, Artificial Sequence
  Description of Artificial Sequence: Synthetic oligonucleotide
  Target: ATXN1; (-) strand; PAM type: NRG; PAM sequence: TGG
atctgaatagaatgtatttg

SEQ ID NO: 83495 - DNA, 20 bp, Artificial Sequence
  Description of Artificial Sequence: Synthetic oligonucleotide
  Target: ATXN1; (-) strand; PAM type: NRG; PAM sequence: TAG
gcagaatagtatgatctgaa

SEQ ID NO: 83496 - DNA, 20 bp, Artificial Sequence
  Description of Artificial Sequence: Synthetic oligonucleotide
  Target: ATXN1; (-) strand; PAM type: NRG; PAM sequence: TAG
tgtttctgaaacttgcagaa

SEQ ID NO: 83497 - DNA, 20 bp, Artificial Sequence
  Description of Artificial Sequence: Synthetic oligonucleotide
  Target: ATXN1; (-) strand; PAM type: NRG; PAM sequence: CAG
gtgtttgtttctgaaacttg

SEQ ID NO: 83498 - DNA, 20 bp, Artificial Sequence
  Description of Artificial Sequence: Synthetic oligonucleotide
  Target: ATXN1; (-) strand; PAM type: NRG; PAM sequence: GAG
ctagtgacagagcactgaga

SEQ ID NO: 83499 - DNA, 20 bp, Artificial Sequence
  Description of Artificial Sequence: Synthetic oligonucleotide
  Target: ATXN1; (-) strand; PAM type: NRG; PAM sequence: GAG
tcctagtgacagagcactga

SEQ ID NO: 83500 - DNA, 20 bp, Artificial Sequence
  Description of Artificial Sequence: Synthetic oligonucleotide
  Target: ATXN1; (-) strand; PAM type: NRG; PAM sequence: GAG
tgtcctagtgacagagcact

SEQ ID NO: 83501 - DNA, 20 bp, Artificial Sequence
  Description of Artificial Sequence: Synthetic oligonucleotide
  Target: ATXN1; (-) strand; PAM type: NRG; PAM sequence: GAG
aaaatgttgtcctagtgaca

SEQ ID NO: 83502 - DNA, 20 bp, Artificial Sequence
  Description of Artificial Sequence: Synthetic oligonucleotide
  Target: ATXN1; (-) strand; PAM type: NRG; PAM sequence: CAG
aaaaaatgttgtcctagtga

SEQ ID NO: 83503 - DNA, 20 bp, Artificial Sequence
  Description of Artificial Sequence: Synthetic oligonucleotide
  Target: ATXN1; (-) strand; PAM type: NRG; PAM sequence: TAG
catttgaaaaaatgttgtcc

SEQ ID NO: 83504 - DNA, 20 bp, Artificial Sequence
  Description of Artificial Sequence: Synthetic oligonucleotide
  Target: ATXN1; (-) strand; PAM type: NRG; PAM sequence: AGG
ttctctacatcctaaataac

SEQ ID NO: 83505 - DNA, 20 bp, Artificial Sequence
  Description of Artificial Sequence: Synthetic oligonucleotide
  Target: ATXN1; (-) strand; PAM type: NRG; PAM sequence: CAG
tttctctacatcctaaataa

SEQ ID NO: 83506 - DNA, 20 bp, Artificial Sequence
  Description of Artificial Sequence: Synthetic oligonucleotide
  Target: ATXN1; (-) strand; PAM type: NRG; PAM sequence: AAG
tgtaccagaacttcttcttc

SEQ ID NO: 83507 - DNA, 20 bp, Artificial Sequence
  Description of Artificial Sequence: Synthetic oligonucleotide
  Target: ATXN1; (-) strand; PAM type: NRG; PAM sequence: CAG
gcatcacttcactggtgtac

SEQ ID NO: 83508 - DNA, 20 bp, Artificial Sequence
  Description of Artificial Sequence: Synthetic oligonucleotide
  Target: ATXN1; (-) strand; PAM type: NRG; PAM sequence: TGG
gtcatcgggcatcacttcac

SEQ ID NO: 83509 - DNA, 20 bp, Artificial Sequence
  Description of Artificial Sequence: Synthetic oligonucleotide
  Target: ATXN1; (-) strand; PAM type: NRG; PAM sequence: GGG
ttttagctttaaatgtcatc

SEQ ID NO: 83510 - DNA, 20 bp, Artificial Sequence
  Description of Artificial Sequence: Synthetic oligonucleotide
  Target: ATXN1; (-) strand; PAM type: NRG; PAM sequence: CGG
cttttagctttaaatgtcat

SEQ ID NO: 83511 - DNA, 20 bp, Artificial Sequence
  Description of Artificial Sequence: Synthetic oligonucleotide
  Target: ATXN1; (-) strand; PAM type: NRG; PAM sequence: TAG
ccaaaagacttgacatcttt

SEQ ID NO: 83512 - DNA, 20 bp, Artificial Sequence
  Description of Artificial Sequence: Synthetic oligonucleotide
  Target: ATXN1; (-) strand; PAM type: NRG; PAM sequence: AAG
gtttttggtaagtcatccaa

SEQ ID NO: 83513 - DNA, 20 bp, Artificial Sequence
  Description of Artificial Sequence: Synthetic oligonucleotide
  Target: ATXN1; (-) strand; PAM type: NRG; PAM sequence: AAG
aaacacaaatggtttttggt

SEQ ID NO: 83514 - DNA, 20 bp, Artificial Sequence
  Description of Artificial Sequence: Synthetic oligonucleotide
  Target: ATXN1; (-) strand; PAM type: NRG; PAM sequence: TGG
cttgaaacacaaatggtttt

SEQ ID NO: 83515 - DNA, 20 bp, Artificial Sequence
  Description of Artificial Sequence: Synthetic oligonucleotide
  Target: ATXN1; (-) strand; PAM type: NRG; PAM sequence: TGG
ggatggtcttgaaacacaaa

SEQ ID NO: 83516 - DNA, 20 bp, Artificial Sequence
  Description of Artificial Sequence: Synthetic oligonucleotide
  Target: ATXN1; (-) strand; PAM type: NRG; PAM sequence: TGG
tggatttcagcctgcacgga

SEQ ID NO: 83517 - DNA, 20 bp, Artificial Sequence
  Description of Artificial Sequence: Synthetic oligonucleotide
  Target: ATXN1; (-) strand; PAM type: NRG; PAM sequence: CGG
agagtggatttcagcctgca

SEQ ID NO: 83518 - DNA, 20 bp, Artificial Sequence
  Description of Artificial Sequence: Synthetic oligonucleotide
  Target: ATXN1; (-) strand; PAM type: NRG; PAM sequence: CAG
aagagagaaagagtggattt

SEQ ID NO: 83519 - DNA, 20 bp, Artificial Sequence
  Description of Artificial Sequence: Synthetic oligonucleotide
  Target: ATXN1; (-) strand; PAM type: NRG; PAM sequence: TGG
caggaacaagagagaaagag

SEQ ID NO: 83520 - DNA, 20 bp, Artificial Sequence
  Description of Artificial Sequence: Synthetic oligonucleotide
  Target: ATXN1; (-) strand; PAM type: NRG; PAM sequence: GAG
gaccaggaacaagagagaaa

SEQ ID NO: 83521 - DNA, 20 bp, Artificial Sequence
  Description of Artificial Sequence: Synthetic oligonucleotide
  Target: ATXN1; (-) strand; PAM type: NRG; PAM sequence: AAG
cagaccaggaacaagagaga

SEQ ID NO: 83522 - DNA, 20 bp, Artificial Sequence
  Description of Artificial Sequence: Synthetic oligonucleotide
  Target: ATXN1; (-) strand; PAM type: NRG; PAM sequence: GAG
gctgcagaccaggaacaaga

SEQ ID NO: 83523 - DNA, 20 bp, Artificial Sequence
  Description of Artificial Sequence: Synthetic oligonucleotide
  Target: ATXN1; (-) strand; PAM type: NRG; PAM sequence: GAG
ctgctgcagaccaggaacaa

SEQ ID NO: 83524 - DNA, 20 bp, Artificial Sequence
  Description of Artificial Sequence: Synthetic oligonucleotide
  Target: ATXN1; (-) strand; PAM type: NRG; PAM sequence: AAG
tgctgctgcagaccaggaac

SEQ ID NO: 83525 - DNA, 20 bp, Artificial Sequence
  Description of Artificial Sequence: Synthetic oligonucleotide
  Target: ATXN1; (-) strand; PAM type: NRG; PAM sequence: AGG
acttagtgctgctgcagacc

SEQ ID NO: 83526 - DNA, 20 bp, Artificial Sequence
  Description of Artificial Sequence: Synthetic oligonucleotide
  Target: ATXN1; (-) strand; PAM type: NRG; PAM sequence: CAG
aacttagtgctgctgcagac

SEQ ID NO: 83527 - DNA, 20 bp, Artificial Sequence
  Description of Artificial Sequence: Synthetic oligonucleotide
  Target: ATXN1; (-) strand; PAM type: NRG; PAM sequence: CAG
cttcaaacttagtgctgctg

SEQ ID NO: 83528 - DNA, 20 bp, Artificial Sequence
  Description of Artificial Sequence: Synthetic oligonucleotide
  Target: ATXN1; (-) strand; PAM type: NRG; PAM sequence: TAG
ctattttgaagcttcaaact

SEQ ID NO: 83529 - DNA, 20 bp, Artificial Sequence
  Description of Artificial Sequence: Synthetic oligonucleotide
  Target: ATXN1; (-) strand; PAM type: NRG; PAM sequence: AAG
tagtgaaagagtctattttg

SEQ ID NO: 83530 - DNA, 20 bp, Artificial Sequence
  Description of Artificial Sequence: Synthetic oligonucleotide
  Target: ATXN1; (-) strand; PAM type: NRG; PAM sequence: GAG
catactggagcatagtgaaa

SEQ ID NO: 83531 - DNA, 20 bp, Artificial Sequence
  Description of Artificial Sequence: Synthetic oligonucleotide
  Target: ATXN1; (-) strand; PAM type: NRG; PAM sequence: AAG
agcatactggagcatagtga

SEQ ID NO: 83532 - DNA, 20 bp, Artificial Sequence
  Description of Artificial Sequence: Synthetic oligonucleotide
  Target: ATXN1; (-) strand; PAM type: NRG; PAM sequence: TAG
gactgcagcatactggagca

SEQ ID NO: 83533 - DNA, 20 bp, Artificial Sequence
  Description of Artificial Sequence: Synthetic oligonucleotide
  Target: ATXN1; (-) strand; PAM type: NRG; PAM sequence: GAG
tgtttgactgcagcatactg

SEQ ID NO: 83534 - DNA, 20 bp, Artificial Sequence
  Description of Artificial Sequence: Synthetic oligonucleotide
  Target: ATXN1; (-) strand; PAM type: NRG; PAM sequence: TGG
tttgtttgactgcagcatac

SEQ ID NO: 83535 - DNA, 20 bp, Artificial Sequence
  Description of Artificial Sequence: Synthetic oligonucleotide
  Target: ATXN1; (-) strand; PAM type: NRG; PAM sequence: CAG
tattttgttttgtttgactg

SEQ ID NO: 83536 - DNA, 20 bp, Artificial Sequence
  Description of Artificial Sequence: Synthetic oligonucleotide
  Target: ATXN1; (-) strand; PAM type: NRG; PAM sequence: TGG
gtggcattttcattctgact

SEQ ID NO: 83537 - DNA, 20 bp, Artificial Sequence
  Description of Artificial Sequence: Synthetic oligonucleotide
  Target: ATXN1; (-) strand; PAM type: NRG; PAM sequence: TGG
tatccactaactgcttgaag

SEQ ID NO: 83538 - DNA, 20 bp, Artificial Sequence
  Description of Artificial Sequence: Synthetic oligonucleotide
  Target: ATXN1; (-) strand; PAM type: NRG; PAM sequence: AAG
gaatatccactaactgcttg

SEQ ID NO: 83539 - DNA, 20 bp, Artificial Sequence
  Description of Artificial Sequence: Synthetic oligonucleotide
  Target: ATXN1; (-) strand; PAM type: NRG; PAM sequence: GGG
tatacatttgagaaaggcca

SEQ ID NO: 83540 - DNA, 20 bp, Artificial Sequence
  Description of Artificial Sequence: Synthetic oligonucleotide
  Target: ATXN1; (-) strand; PAM type: NRG; PAM sequence: AGG
atatacatttgagaaaggcc

SEQ ID NO: 83541 - DNA, 20 bp, Artificial Sequence
  Description of Artificial Sequence: Synthetic oligonucleotide
  Target: ATXN1; (-) strand; PAM type: NRG; PAM sequence: CAG
aatatacatttgagaaaggc

SEQ ID NO: 83542 - DNA, 20 bp, Artificial Sequence
  Description of Artificial Sequence: Synthetic oligonucleotide
  Target: ATXN1; (-) strand; PAM type: NRG; PAM sequence: AGG
atgaaatatacatttgagaa

SEQ ID NO: 83543 - DNA, 20 bp, Artificial Sequence
  Description of Artificial Sequence: Synthetic oligonucleotide
  Target: ATXN1; (-) strand; PAM type: NRG; PAM sequence: AAG
tatgaaatatacatttgaga

SEQ ID NO: 83544 - DNA, 20 bp, Artificial Sequence
  Description of Artificial Sequence: Synthetic oligonucleotide
  Target: ATXN1; (-) strand; PAM type: NRG; PAM sequence: GAG
aggttatgaaatatacattt

SEQ ID NO: 83545 - DNA, 20 bp, Artificial Sequence
  Description of Artificial Sequence: Synthetic oligonucleotide
  Target: ATXN1; (-) strand; PAM type: NRG; PAM sequence: AGG
ataattaacatgcttgtttg

SEQ ID NO: 83546 - DNA, 20 bp, Artificial Sequence
  Description of Artificial Sequence: Synthetic oligonucleotide
  Target: ATXN1; (-) strand; PAM type: NRG; PAM sequence: GAG
gataattaacatgcttgttt

SEQ ID NO: 83547 - DNA, 20 bp, Artificial Sequence
  Description of Artificial Sequence: Synthetic oligonucleotide
  Target: ATXN1; (-) strand; PAM type: NRG; PAM sequence: TGG
tatgtagataagcagtgaga

SEQ ID NO: 83548 - DNA, 20 bp, Artificial Sequence
  Description of Artificial Sequence: Synthetic oligonucleotide
  Target: ATXN1; (-) strand; PAM type: NRG; PAM sequence: GAG
accttatgtagataagcagt

SEQ ID NO: 83549 - DNA, 20 bp, Artificial Sequence
  Description of Artificial Sequence: Synthetic oligonucleotide
  Target: ATXN1; (-) strand; PAM type: NRG; PAM sequence: CAG
gggcaccttatgtagataag

SEQ ID NO: 83550 - DNA, 20 bp, Artificial Sequence
  Description of Artificial Sequence: Synthetic oligonucleotide
  Target: ATXN1; (-) strand; PAM type: NRG; PAM sequence: AAG
ttagggcaccttatgtagat

SEQ ID NO: 83551 - DNA, 20 bp, Artificial Sequence
  Description of Artificial Sequence: Synthetic oligonucleotide
  Target: ATXN1; (-) strand; PAM type: NRG; PAM sequence: TAG
gtattttagggcaccttatg

SEQ ID NO: 83552 - DNA, 20 bp, Artificial Sequence
  Description of Artificial Sequence: Synthetic oligonucleotide
  Target: ATXN1; (-) strand; PAM type: NRG; PAM sequence: GGG
accccacctccagtatttta

SEQ ID NO: 83553 - DNA, 20 bp, Artificial Sequence
  Description of Artificial Sequence: Synthetic oligonucleotide
  Target: ATXN1; (-) strand; PAM type: NRG; PAM sequence: AGG
caccccacctccagtatttt

SEQ ID NO: 83554 - DNA, 20 bp, Artificial Sequence
  Description of Artificial Sequence: Synthetic oligonucleotide
  Target: ATXN1; (-) strand; PAM type: NRG; PAM sequence: TAG
acaccccacctccagtattt

SEQ ID NO: 83555 - DNA, 20 bp, Artificial Sequence
  Description of Artificial Sequence: Synthetic oligonucleotide
  Target: ATXN1; (-) strand; PAM type: NRG; PAM sequence: CAG
tccttcccacaccccacctc

SEQ ID NO: 83556 - DNA, 20 bp, Artificial Sequence
  Description of Artificial Sequence: Synthetic oligonucleotide
  Target: ATXN1; (-) strand; PAM type: NRG; PAM sequence: CAG
tcaagacctgctacctcccc

SEQ ID NO: 83557 - DNA, 20 bp, Artificial Sequence
  Description of Artificial Sequence: Synthetic oligonucleotide
  Target: ATXN1; (-) strand; PAM type: NRG; PAM sequence: AAG
tggtgtacattctgattttc

SEQ ID NO: 83558 - DNA, 20 bp, Artificial Sequence
  Description of Artificial Sequence: Synthetic oligonucleotide
  Target: ATXN1; (-) strand; PAM type: NRG; PAM sequence: TGG
ttttgcaagtgcattcccac

SEQ ID NO: 83559 - DNA, 20 bp, Artificial Sequence
  Description of Artificial Sequence: Synthetic oligonucleotide
  Target: ATXN1; (-) strand; PAM type: NRG; PAM sequence: AAG
cggtaaacttgaaattttgc

SEQ ID NO: 83560 - DNA, 20 bp, Artificial Sequence
  Description of Artificial Sequence: Synthetic oligonucleotide
  Target: ATXN1; (-) strand; PAM type: NRG; PAM sequence: CGG
ctttattcacatctttcaat

SEQ ID NO: 83561 - DNA, 20 bp, Artificial Sequence
  Description of Artificial Sequence: Synthetic oligonucleotide
  Target: ATXN1; (-) strand; PAM type: NRG; PAM sequence: TAG
cacatcagtctttaatcact

SEQ ID NO: 83562 - DNA, 20 bp, Artificial Sequence
  Description of Artificial Sequence: Synthetic oligonucleotide
  Target: ATXN1; (-) strand; PAM type: NRG; PAM sequence: CAG
ctgcccttgatactgcacat

SEQ ID NO: 83563 - DNA, 20 bp, Artificial Sequence
  Description of Artificial Sequence: Synthetic oligonucleotide
  Target: ATXN1; (-) strand; PAM type: NRG; PAM sequence: AAG
tagtctgagtctttcatttg

SEQ ID NO: 83564 - DNA, 20 bp, Artificial Sequence
  Description of Artificial Sequence: Synthetic oligonucleotide
  Target: ATXN1; (-) strand; PAM type: NRG; PAM sequence: GAG
tcacatcagttgattagtct

SEQ ID NO: 83565 - DNA, 20 bp, Artificial Sequence
  Description of Artificial Sequence: Synthetic oligonucleotide
  Target: ATXN1; (-) strand; PAM type: NRG; PAM sequence: TAG
aagtattcacatcagttgat

SEQ ID NO: 83566 - DNA, 20 bp, Artificial Sequence
  Description of Artificial Sequence: Synthetic oligonucleotide
  Target: ATXN1; (-) strand; PAM type: NRG; PAM sequence: CAG
tatttaaaaagtattcacat

SEQ ID NO: 83567 - DNA, 20 bp, Artificial Sequence
  Description of Artificial Sequence: Synthetic oligonucleotide
  Target: ATXN1; (-) strand; PAM type: NRG; PAM sequence: AAG
ttaatagctctttatttaaa

SEQ ID NO: 83568 - DNA, 20 bp, Artificial Sequence
  Description of Artificial Sequence: Synthetic oligonucleotide
  Target: ATXN1; (-) strand; PAM type: NRG; PAM sequence: TAG
tcttttttgttccatcttaa

SEQ ID NO: 83569 - DNA, 20 bp, Artificial Sequence
  Description of Artificial Sequence: Synthetic oligonucleotide
  Target: ATXN1; (-) strand; PAM type: NRG; PAM sequence: TGG
tacctacttatagggcaaaa

SEQ ID NO: 83570 - DNA, 20 bp, Artificial Sequence
  Description of Artificial Sequence: Synthetic oligonucleotide
  Target: ATXN1; (-) strand; PAM type: NRG; PAM sequence: GGG
ccatgcattacctacttata

SEQ ID NO: 83571 - DNA, 20 bp, Artificial Sequence
  Description of Artificial Sequence: Synthetic oligonucleotide
  Target: ATXN1; (-) strand; PAM type: NRG; PAM sequence: AGG
cccatgcattacctacttat

SEQ ID NO: 83572 - DNA, 20 bp, Artificial Sequence
  Description of Artificial Sequence: Synthetic oligonucleotide
  Target: ATXN1; (-) strand; PAM type: NRG; PAM sequence: TAG
acccatgcattacctactta

SEQ ID NO: 83573 - DNA, 20 bp, Artificial Sequence
  Description of Artificial Sequence: Synthetic oligonucleotide
  Target: ATXN1; (-) strand; PAM type: NRG; PAM sequence: GGG
atttatcaagaatcacacaa

SEQ ID NO: 83574 - DNA, 20 bp, Artificial Sequence
  Description of Artificial Sequence: Synthetic oligonucleotide
  Target: ATXN1; (-) strand; PAM type: NRG; PAM sequence: AGG
tatttatcaagaatcacaca

SEQ ID NO: 83575 - DNA, 20 bp, Artificial Sequence
  Description of Artificial Sequence: Synthetic oligonucleotide
  Target: ATXN1; (-) strand; PAM type: NRG; PAM sequence: AAG
gtatttatcaagaatcacac

SEQ ID NO: 83576 - DNA, 20 bp, Artificial Sequence
  Description of Artificial Sequence: Synthetic oligonucleotide
  Target: ATXN1; (-) strand; PAM type: NRG; PAM sequence: AAG
gggtggagaaagtatttatc

SEQ ID NO: 83577 - DNA, 20 bp, Artificial Sequence
  Description of Artificial Sequence: Synthetic oligonucleotide
  Target: ATXN1; (-) strand; PAM type: NRG; PAM sequence: AAG
cttttcagcttgggtggaga

SEQ ID NO: 83578 - DNA, 20 bp, Artificial Sequence
  Description of Artificial Sequence: Synthetic oligonucleotide
  Target: ATXN1; (-) strand; PAM type: NRG; PAM sequence: GAG
actgcttttcagcttgggtg

SEQ ID NO: 83579 - DNA, 20 bp, Artificial Sequence
  Description of Artificial Sequence: Synthetic oligonucleotide
  Target: ATXN1; (-) strand; PAM type: NRG; PAM sequence: TGG
ctactgcttttcagcttggg

SEQ ID NO: 83580 - DNA, 20 bp, Artificial Sequence
  Description of Artificial Sequence: Synthetic oligonucleotide
  Target: ATXN1; (-) strand; PAM type: NRG; PAM sequence: GGG
taactactgcttttcagctt

SEQ ID NO: 83581 - DNA, 20 bp, Artificial Sequence
  Description of Artificial Sequence: Synthetic oligonucleotide
  Target: ATXN1; (-) strand; PAM type: NRG; PAM sequence: TGG
gtaactactgcttttcagct

SEQ ID NO: 83582 - DNA, 20 bp, Artificial Sequence
  Description of Artificial Sequence: Synthetic oligonucleotide
  Target: ATXN1; (-) strand; PAM type: NRG; PAM sequence: CAG
gtaaagtaactactgctttt

SEQ ID NO: 83583 - DNA, 20 bp, Artificial Sequence
  Description of Artificial Sequence: Synthetic oligonucleotide
  Target: ATXN1; (-) strand; PAM type: NRG; PAM sequence: AAG
catttcatattcagtgtgta

SEQ ID NO: 83584 - DNA, 20 bp, Artificial Sequence
  Description of Artificial Sequence: Synthetic oligonucleotide
  Target: ATXN1; (-) strand; PAM type: NRG; PAM sequence: CAG
ttaaacattcatttcatatt

SEQ ID NO: 83585 - DNA, 20 bp, Artificial Sequence
  Description of Artificial Sequence: Synthetic oligonucleotide
  Target: ATXN1; (-) strand; PAM type: NRG; PAM sequence: AGG
tgctctgagtgggggtaaag

SEQ ID NO: 83586 - DNA, 20 bp, Artificial Sequence
  Description of Artificial Sequence: Synthetic oligonucleotide
  Target: ATXN1; (-) strand; PAM type: NRG; PAM sequence: GAG
ctgctctgagtgggggtaaa

SEQ ID NO: 83587 - DNA, 20 bp, Artificial Sequence
  Description of Artificial Sequence: Synthetic oligonucleotide
  Target: ATXN1; (-) strand; PAM type: NRG; PAM sequence: AAG
agctgctctgagtgggggta

SEQ ID NO: 83588 - DNA, 20 bp, Artificial Sequence
  Description of Artificial Sequence: Synthetic oligonucleotide
  Target: ATXN1; (-) strand; PAM type: NRG; PAM sequence: GGG
ttatcagctgctctgagtgg

SEQ ID NO: 83589 - DNA, 20 bp, Artificial Sequence
  Description of Artificial Sequence: Synthetic oligonucleotide
  Target: ATXN1; (-) strand; PAM type: NRG; PAM sequence: GGG
tttatcagctgctctgagtg

SEQ ID NO: 83590 - DNA, 20 bp, Artificial Sequence
  Description of Artificial Sequence: Synthetic oligonucleotide
  Target: ATXN1; (-) strand; PAM type: NRG; PAM sequence: GGG
ctttatcagctgctctgagt

SEQ ID NO: 83591 - DNA, 20 bp, Artificial Sequence
  Description of Artificial Sequence: Synthetic oligonucleotide
  Target: ATXN1; (-) strand; PAM type: NRG; PAM sequence: TGG
gctttatcagctgctctgag

SEQ ID NO: 83592 - DNA, 20 bp, Artificial Sequence
  Description of Artificial Sequence: Synthetic oligonucleotide
  Target: ATXN1; (-) strand; PAM type: NRG; PAM sequence: GAG
taggctttatcagctgctct

SEQ ID NO: 83593 - DNA, 20 bp, Artificial Sequence
  Description of Artificial Sequence: Synthetic oligonucleotide
  Target: ATXN1; (-) strand; PAM type: NRG; PAM sequence: CAG
ttctaatgtgtaggctttat

SEQ ID NO: 83594 - DNA, 20 bp, Artificial Sequence
  Description of Artificial Sequence: Synthetic oligonucleotide
  Target: ATXN1; (-) strand; PAM type: NRG; PAM sequence: AGG
cagacgaggttctaatgtgt

SEQ ID NO: 83595 - DNA, 20 bp, Artificial Sequence
  Description of Artificial Sequence: Synthetic oligonucleotide
  Target: ATXN1; (-) strand; PAM type: NRG; PAM sequence: TAG
tcagacgaggttctaatgtg

SEQ ID NO: 83596 - DNA, 20 bp, Artificial Sequence
  Description of Artificial Sequence: Synthetic oligonucleotide
  Target: ATXN1; (-) strand; PAM type: NRG; PAM sequence: AGG
cagagtgaccttgtcagacg

SEQ ID NO: 83597 - DNA, 20 bp, Artificial Sequence
  Description of Artificial Sequence: Synthetic oligonucleotide
  Target: ATXN1; (-) strand; PAM type: NRG; PAM sequence: GAG
tcagagtgaccttgtcagac

SEQ ID NO: 83598 - DNA, 20 bp, Artificial Sequence
  Description of Artificial Sequence: Synthetic oligonucleotide
  Target: ATXN1; (-) strand; PAM type: NRG; PAM sequence: CAG
acttttcagagtgaccttgt

SEQ ID NO: 83599 - DNA, 20 bp, Artificial Sequence
  Description of Artificial Sequence: Synthetic oligonucleotide
  Target: ATXN1; (-) strand; PAM type: NRG; PAM sequence: GAG
aggcagaaaggaacttttca

SEQ ID NO: 83600 - DNA, 20 bp, Artificial Sequence
  Description of Artificial Sequence: Synthetic oligonucleotide
  Target: ATXN1; (-) strand; PAM type: NRG; PAM sequence: CAG
caaggcagaaaggaactttt

SEQ ID NO: 83601 - DNA, 20 bp, Artificial Sequence
  Description of Artificial Sequence: Synthetic oligonucleotide
  Target: ATXN1; (-) strand; PAM type: NRG; PAM sequence: AGG
taaaagctcacaaggcagaa

SEQ ID NO: 83602 - DNA, 20 bp, Artificial Sequence
  Description of Artificial Sequence: Synthetic oligonucleotide
  Target: ATXN1; (-) strand; PAM type: NRG; PAM sequence: AAG
ttaaaagctcacaaggcaga

SEQ ID NO: 83603 - DNA, 20 bp, Artificial Sequence
  Description of Artificial Sequence: Synthetic oligonucleotide
  Target: ATXN1; (-) strand; PAM type: NRG; PAM sequence: CAG
agcgttaaaagctcacaagg

SEQ ID NO: 83604 - DNA, 20 bp, Artificial Sequence
  Description of Artificial Sequence: Synthetic oligonucleotide
  Target: ATXN1; (-) strand; PAM type: NRG; PAM sequence: AGG
gtgagcgttaaaagctcaca

SEQ ID NO: 83605 - DNA, 20 bp, Artificial Sequence
  Description of Artificial Sequence: Synthetic oligonucleotide
  Target: ATXN1; (-) strand; PAM type: NRG; PAM sequence: AAG
agtgagcgttaaaagctcac

SEQ ID NO: 83606 - DNA, 20 bp, Artificial Sequence
  Description of Artificial Sequence: Synthetic oligonucleotide
  Target: ATXN1; (-) strand; PAM type: NRG; PAM sequence: AAG
ctgtgacaagtgagcgttaa

SEQ ID NO: 83607 - DNA, 20 bp, Artificial Sequence
  Description of Artificial Sequence: Synthetic oligonucleotide
  Target: ATXN1; (-) strand; PAM type: NRG; PAM sequence: GAG
aacaacagcctgtgacaagt

SEQ ID NO: 83608 - DNA, 20 bp, Artificial Sequence
  Description of Artificial Sequence: Synthetic oligonucleotide
  Target: ATXN1; (-) strand; PAM type: NRG; PAM sequence: AAG
ctttaacaacagcctgtgac

SEQ ID NO: 83609 - DNA, 20 bp, Artificial Sequence
  Description of Artificial Sequence: Synthetic oligonucleotide
  Target: ATXN1; (-) strand; PAM type: NRG; PAM sequence: CAG
atcagaagatgctttaacaa

SEQ ID NO: 83610 - DNA, 20 bp, Artificial Sequence
  Description of Artificial Sequence: Synthetic oligonucleotide
  Target: ATXN1; (-) strand; PAM type: NRG; PAM sequence: AAG
tggatttgactaagcatcag

SEQ ID NO: 83611 - DNA, 20 bp, Artificial Sequence
  Description of Artificial Sequence: Synthetic oligonucleotide
  Target: ATXN1; (-) strand; PAM type: NRG; PAM sequence: CAG
gggtggatttgactaagcat

SEQ ID NO: 83612 - DNA, 20 bp, Artificial Sequence
  Description of Artificial Sequence: Synthetic oligonucleotide
  Target: ATXN1; (-) strand; PAM type: NRG; PAM sequence: AAG
acagtggggtggatttgact

SEQ ID NO: 83613 - DNA, 20 bp, Artificial Sequence
  Description of Artificial Sequence: Synthetic oligonucleotide
  Target: ATXN1; (-) strand; PAM type: NRG; PAM sequence: TGG
tcaaaaaacaaacagtgggg

SEQ ID NO: 83614 - DNA, 20 bp, Artificial Sequence
  Description of Artificial Sequence: Synthetic oligonucleotide
  Target: ATXN1; (-) strand; PAM type: NRG; PAM sequence: GGG
ttgtcaaaaaacaaacagtg

SEQ ID NO: 83615 - DNA, 20 bp, Artificial Sequence
  Description of Artificial Sequence: Synthetic oligonucleotide
  Target: ATXN1; (-) strand; PAM type: NRG; PAM sequence: GGG
attgtcaaaaaacaaacagt

SEQ ID NO: 83616 - DNA, 20 bp, Artificial Sequence
  Description of Artificial Sequence: Synthetic oligonucleotide
  Target: ATXN1; (-) strand; PAM type: NRG; PAM sequence: TGG
cattgtcaaaaaacaaacag

SEQ ID NO: 83617 - DNA, 20 bp, Artificial Sequence
  Description of Artificial Sequence: Synthetic oligonucleotide
  Target: ATXN1; (-) strand; PAM type: NRG; PAM sequence: CAG
ggccattgtcaaaaaacaaa

SEQ ID NO: 83618 - DNA, 20 bp, Artificial Sequence
  Description of Artificial Sequence: Synthetic oligonucleotide
  Target: ATXN1; (-) strand; PAM type: NRG; PAM sequence: TGG
actgtttctaggctctcaaa

SEQ ID NO: 83619 - DNA, 20 bp, Artificial Sequence
  Description of Artificial Sequence: Synthetic oligonucleotide
  Target: ATXN1; (-) strand; PAM type: NRG; PAM sequence: AGG
acctttggaagactgtttct

SEQ ID NO: 83620 - DNA, 20 bp, Artificial Sequence
  Description of Artificial Sequence: Synthetic oligonucleotide
  Target: ATXN1; (-) strand; PAM type: NRG; PAM sequence: TAG
cacctttggaagactgtttc

SEQ ID NO: 83621 - DNA, 20 bp, Artificial Sequence
  Description of Artificial Sequence: Synthetic oligonucleotide
  Target: ATXN1; (-) strand; PAM type: NRG; PAM sequence: AAG
aaggaggcagacacctttgg

SEQ ID NO: 83622 - DNA, 20 bp, Artificial Sequence
  Description of Artificial Sequence: Synthetic oligonucleotide
  Target: ATXN1; (-) strand; PAM type: NRG; PAM sequence: TGG
aaaaaggaggcagacacctt

SEQ ID NO: 83623 - DNA, 20 bp, Artificial Sequence
  Description of Artificial Sequence: Synthetic oligonucleotide
  Target: ATXN1; (-) strand; PAM type: NRG; PAM sequence: CAG
taaaaggctaaaaaaggagg

SEQ ID NO: 83624 - DNA, 20 bp, Artificial Sequence
  Description of Artificial Sequence: Synthetic oligonucleotide
  Target: ATXN1; (-) strand; PAM type: NRG; PAM sequence: AGG
tcataaaaggctaaaaaagg

SEQ ID NO: 83625 - DNA, 20 bp, Artificial Sequence
  Description of Artificial Sequence: Synthetic oligonucleotide
  Target: ATXN1; (-) strand; PAM type: NRG; PAM sequence: GAG
ctcataaaaggctaaaaaag

SEQ ID NO: 83626 - DNA, 20 bp, Artificial Sequence
  Description of Artificial Sequence: Synthetic oligonucleotide
  Target: ATXN1; (-) strand; PAM type: NRG; PAM sequence: AGG
agctcataaaaggctaaaaa

SEQ ID NO: 83627 - DNA, 20 bp, Artificial Sequence
  Description of Artificial Sequence: Synthetic oligonucleotide
  Target: ATXN1; (-) strand; PAM type: NRG; PAM sequence: AAG
gagctcataaaaggctaaaa

SEQ ID NO: 83628 - DNA, 20 bp, Artificial Sequence
  Description of Artificial Sequence: Synthetic oligonucleotide
  Target: ATXN1; (-) strand; PAM type: NRG; PAM sequence: AGG
gatgaggatgagctcataaa

SEQ ID NO: 83629 - DNA, 20 bp, Artificial Sequence
  Description of Artificial Sequence: Synthetic oligonucleotide
  Target: ATXN1; (-) strand; PAM type: NRG; PAM sequence: AAG
agatgaggatgagctcataa

SEQ ID NO: 83630 - DNA, 20 bp, Artificial Sequence
  Description of Artificial Sequence: Synthetic oligonucleotide
  Target: ATXN1; (-) strand; PAM type: NRG; PAM sequence: GAG
ttttcaacatagatgaggat

SEQ ID NO: 83631 - DNA, 20 bp, Artificial Sequence
  Description of Artificial Sequence: Synthetic oligonucleotide
  Target: ATXN1; (-) strand; PAM type: NRG; PAM sequence: AGG
atgggttttcaacatagatg

SEQ ID NO: 83632 - DNA, 20 bp, Artificial Sequence
  Description of Artificial Sequence: Synthetic oligonucleotide
  Target: ATXN1; (-) strand; PAM type: NRG; PAM sequence: GAG
gatgggttttcaacatagat

SEQ ID NO: 83633 - DNA, 20 bp, Artificial Sequence
  Description of Artificial Sequence: Synthetic oligonucleotide
  Target: ATXN1; (-) strand; PAM type: NRG; PAM sequence: TAG
cagccgatgggttttcaaca

SEQ ID NO: 83634 - DNA, 20 bp, Artificial Sequence
  Description of Artificial Sequence: Synthetic oligonucleotide
  Target: ATXN1; (-) strand; PAM type: NRG; PAM sequence: GGG
ctggatgacagtcagccgat

SEQ ID NO: 83635 - DNA, 20 bp, Artificial Sequence
  Description of Artificial Sequence: Synthetic oligonucleotide
  Target: ATXN1; (-) strand; PAM type: NRG; PAM sequence: TGG
actggatgacagtcagccga

SEQ ID NO: 83636 - DNA, 20 bp, Artificial Sequence
  Description of Artificial Sequence: Synthetic oligonucleotide
  Target: ATXN1; (-) strand; PAM type: NRG; PAM sequence: CAG
tcagggaactggatgacagt

SEQ ID NO: 83637 - DNA, 20 bp, Artificial Sequence
  Description of Artificial Sequence: Synthetic oligonucleotide
  Target: ATXN1; (-) strand; PAM type: NRG; PAM sequence: CAG
atactcagggaactggatga

SEQ ID NO: 83638 - DNA, 20 bp, Artificial Sequence
  Description of Artificial Sequence: Synthetic oligonucleotide
  Target: ATXN1; (-) strand; PAM type: NRG; PAM sequence: TGG
ggccaccatactcagggaac

SEQ ID NO: 83639 - DNA, 20 bp, Artificial Sequence
  Description of Artificial Sequence: Synthetic oligonucleotide
  Target: ATXN1; (-) strand; PAM type: NRG; PAM sequence: GGG
tgatgtggccaccatactca

SEQ ID NO: 83640 - DNA, 20 bp, Artificial Sequence
  Description of Artificial Sequence: Synthetic oligonucleotide
  Target: ATXN1; (-) strand; PAM type: NRG; PAM sequence: AGG
atgatgtggccaccatactc

SEQ ID NO: 83641 - DNA, 20 bp, Artificial Sequence
  Description of Artificial Sequence: Synthetic oligonucleotide
  Target: ATXN1; (-) strand; PAM type: NRG; PAM sequence: CAG
tatgatgtggccaccatact

SEQ ID NO: 83642 - DNA, 20 bp, Artificial Sequence
  Description of Artificial Sequence: Synthetic oligonucleotide
  Target: ATXN1; (-) strand; PAM type: NRG; PAM sequence: TGG
ttagggttacaagtatgatg

SEQ ID NO: 83643 - DNA, 20 bp, Artificial Sequence
  Description of Artificial Sequence: Synthetic oligonucleotide
  Target: ATXN1; (-) strand; PAM type: NRG; PAM sequence: AAG
tttatggagtttagggttac

SEQ ID NO: 83644 - DNA, 20 bp, Artificial Sequence
  Description of Artificial Sequence: Synthetic oligonucleotide
  Target: ATXN1; (-) strand; PAM type: NRG; PAM sequence: GGG
ttggagatttatggagttta

SEQ ID NO: 83645 - DNA, 20 bp, Artificial Sequence
  Description of Artificial Sequence: Synthetic oligonucleotide
  Target: ATXN1; (-) strand; PAM type: NRG; PAM sequence: AGG
tttggagatttatggagttt

SEQ ID NO: 83646 - DNA, 20 bp, Artificial Sequence
  Description of Artificial Sequence: Synthetic oligonucleotide
  Target: ATXN1; (-) strand; PAM type: NRG; PAM sequence: TAG
ctttggagatttatggagtt

SEQ ID NO: 83647 - DNA, 20 bp, Artificial Sequence
  Description of Artificial Sequence: Synthetic oligonucleotide
  Target: ATXN1; (-) strand; PAM type: NRG; PAM sequence: GAG
gggacctttggagatttatg

SEQ ID NO: 83648 - DNA, 20 bp, Artificial Sequence
  Description of Artificial Sequence: Synthetic oligonucleotide
  Target: ATXN1; (-) strand; PAM type: NRG; PAM sequence: TGG
gtgggacctttggagattta

SEQ ID NO: 83649 - DNA, 20 bp, Artificial Sequence
  Description of Artificial Sequence: Synthetic oligonucleotide
  Target: ATXN1; (-) strand; PAM type: NRG; PAM sequence: GAG
tgatcaccgtgggacctttg

SEQ ID NO: 83650 - DNA, 20 bp, Artificial Sequence
  Description of Artificial Sequence: Synthetic oligonucleotide
  Target: ATXN1; (-) strand; PAM type: NRG; PAM sequence: TGG
gatgatcaccgtgggacctt

SEQ ID NO: 83651 - DNA, 20 bp, Artificial Sequence
  Description of Artificial Sequence: Synthetic oligonucleotide
  Target: ATXN1; (-) strand; PAM type: NRG; PAM sequence: GGG
caatctttgatgatcaccgt

SEQ ID NO: 83652 - DNA, 20 bp, Artificial Sequence
  Description of Artificial Sequence: Synthetic oligonucleotide
  Target: ATXN1; (-) strand; PAM type: NRG; PAM sequence: TGG
ccaatctttgatgatcaccg

SEQ ID NO: 83653 - DNA, 20 bp, Artificial Sequence
  Description of Artificial Sequence: Synthetic oligonucleotide
  Target: ATXN1; (-) strand; PAM type: NRG; PAM sequence: TGG
atatcctctttcttacaact

SEQ ID NO: 83654 - DNA, 20 bp, Artificial Sequence
  Description of Artificial Sequence: Synthetic oligonucleotide
  Target: ATXN1; (-) strand; PAM type: NRG; PAM sequence: GAG
agtaagcttctgaggcatac

SEQ ID NO: 83655 - DNA, 20 bp, Artificial Sequence
  Description of Artificial Sequence: Synthetic oligonucleotide
  Target: ATXN1; (-) strand; PAM type: NRG; PAM sequence: AGG
attcacacagtaagcttctg

SEQ ID NO: 83656 - DNA, 20 bp, Artificial Sequence
  Description of Artificial Sequence: Synthetic oligonucleotide
  Target: ATXN1; (-) strand; PAM type: NRG; PAM sequence: GAG
tattcacacagtaagcttct

SEQ ID NO: 83657 - DNA, 20 bp, Artificial Sequence
  Description of Artificial Sequence: Synthetic oligonucleotide
  Target: ATXN1; (-) strand; PAM type: NRG; PAM sequence: AAG
gaattagttattcacacagt

SEQ ID NO: 83658 - DNA, 20 bp, Artificial Sequence
  Description of Artificial Sequence: Synthetic oligonucleotide
  Target: ATXN1; (-) strand; PAM type: NRG; PAM sequence: CAG
caaggaattagttattcaca

SEQ ID NO: 83659 - DNA, 20 bp, Artificial Sequence
  Description of Artificial Sequence: Synthetic oligonucleotide
  Target: ATXN1; (-) strand; PAM type: NRG; PAM sequence: TAG
acagaaggctttcaaggaat

SEQ ID NO: 83660 - DNA, 20 bp, Artificial Sequence
  Description of Artificial Sequence: Synthetic oligonucleotide
  Target: ATXN1; (-) strand; PAM type: NRG; PAM sequence: AGG
atagttacagaaggctttca

SEQ ID NO: 83661 - DNA, 20 bp, Artificial Sequence
  Description of Artificial Sequence: Synthetic oligonucleotide
  Target: ATXN1; (-) strand; PAM type: NRG; PAM sequence: AAG
aatagttacagaaggctttc

SEQ ID NO: 83662 - DNA, 20 bp, Artificial Sequence
  Description of Artificial Sequence: Synthetic oligonucleotide
  Target: ATXN1; (-) strand; PAM type: NRG; PAM sequence: AGG
cataaagtaatagttacaga

SEQ ID NO: 83663 - DNA, 20 bp, Artificial Sequence
  Description of Artificial Sequence: Synthetic oligonucleotide
  Target: ATXN1; (-) strand; PAM type: NRG; PAM sequence: AAG
ccataaagtaatagttacag

SEQ ID NO: 83664 - DNA, 20 bp, Artificial Sequence
  Description of Artificial Sequence: Synthetic oligonucleotide
  Target: ATXN1; (-) strand; PAM type: NRG; PAM sequence: CAG
attccataaagtaatagtta

SEQ ID NO: 83665 - DNA, 20 bp, Artificial Sequence
  Description of Artificial Sequence: Synthetic oligonucleotide
  Target: ATXN1; (-) strand; PAM type: NRG; PAM sequence: TAG
ttgactattccataaagtaa

SEQ ID NO: 83666 - DNA, 20 bp, Artificial Sequence
  Description of Artificial Sequence: Synthetic oligonucleotide
  Target: ATXN1; (-) strand; PAM type: NRG; PAM sequence: AAG
aaaaggttgactattccata

SEQ ID NO: 83667 - DNA, 20 bp, Artificial Sequence
  Description of Artificial Sequence: Synthetic oligonucleotide
  Target: ATXN1; (-) strand; PAM type: NRG; PAM sequence: AGG
cctcaaacgtcccgaaaaaa

SEQ ID NO: 83668 - DNA, 20 bp, Artificial Sequence
  Description of Artificial Sequence: Synthetic oligonucleotide
  Target: ATXN1; (-) strand; PAM type: NRG; PAM sequence: AAG
tcctcaaacgtcccgaaaaa

SEQ ID NO: 83669 - DNA, 20 bp, Artificial Sequence
  Description of Artificial Sequence: Synthetic oligonucleotide
  Target: ATXN1; (-) strand; PAM type: NRG; PAM sequence: TAG
cccaggaatttaaccacaga

SEQ ID NO: 83670 - DNA, 20 bp, Artificial Sequence
  Description of Artificial Sequence: Synthetic oligonucleotide
  Target: ATXN1; (-) strand; PAM type: NRG; PAM sequence: CAG
tgttcccaggaatttaacca

SEQ ID NO: 83671 - DNA, 20 bp, Artificial Sequence
  Description of Artificial Sequence: Synthetic oligonucleotide
  Target: ATXN1; (-) strand; PAM type: NRG; PAM sequence: AGG
caaaagtttttagtgttccc

SEQ ID NO: 83672 - DNA, 20 bp, Artificial Sequence
  Description of Artificial Sequence: Synthetic oligonucleotide
  Target: ATXN1; (-) strand; PAM type: NRG; PAM sequence: CAG
tcaaaagtttttagtgttcc

SEQ ID NO: 83673 - DNA, 20 bp, Artificial Sequence
  Description of Artificial Sequence: Synthetic oligonucleotide
  Target: ATXN1; (-) strand; PAM type: NRG; PAM sequence: TAG
ttctcctcctcaaaagtttt

SEQ ID NO: 83674 - DNA, 20 bp, Artificial Sequence
  Description of Artificial Sequence: Synthetic oligonucleotide
  Target: ATXN1; (-) strand; PAM type: NRG; PAM sequence: AAG
agacactttctcctcctcaa

SEQ ID NO: 83675 - DNA, 20 bp, Artificial Sequence
  Description of Artificial Sequence: Synthetic oligonucleotide
  Target: ATXN1; (-) strand; PAM type: NRG; PAM sequence: GAG
catgtttaaacattaacgga

SEQ ID NO: 83676 - DNA, 20 bp, Artificial Sequence
  Description of Artificial Sequence: Synthetic oligonucleotide
  Target: ATXN1; (-) strand; PAM type: NRG; PAM sequence: GAG
cacatgtttaaacattaacg

SEQ ID NO: 83677 - DNA, 20 bp, Artificial Sequence
  Description of Artificial Sequence: Synthetic oligonucleotide
  Target: ATXN1; (-) strand; PAM type: NRG; PAM sequence: CGG
ctcacatgtttaaacattaa

SEQ ID NO: 83678 - DNA, 20 bp, Artificial Sequence
  Description of Artificial Sequence: Synthetic oligonucleotide
  Target: ATXN1; (-) strand; PAM type: NRG; PAM sequence: TGG
cggctagatggaaaattgaa

SEQ ID NO: 83679 - DNA, 20 bp, Artificial Sequence
  Description of Artificial Sequence: Synthetic oligonucleotide
  Target: ATXN1; (-) strand; PAM type: NRG; PAM sequence: TGG
cagttgttcctccggctaga

SEQ ID NO: 83680 - DNA, 20 bp, Artificial Sequence
  Description of Artificial Sequence: Synthetic oligonucleotide
  Target: ATXN1; (-) strand; PAM type: NRG; PAM sequence: TAG
caggcagttgttcctccggc

SEQ ID NO: 83681 - DNA, 20 bp, Artificial Sequence
  Description of Artificial Sequence: Synthetic oligonucleotide
  Target: ATXN1; (-) strand; PAM type: NRG; PAM sequence: CGG
ttttcaggcagttgttcctc

SEQ ID NO: 83682 - DNA, 20 bp, Artificial Sequence
  Description of Artificial Sequence: Synthetic oligonucleotide
  Target: ATXN1; (-) strand; PAM type: NRG; PAM sequence: CAG
aggcttttgccattttcagg

SEQ ID NO: 83683 - DNA, 20 bp, Artificial Sequence
  Description of Artificial Sequence: Synthetic oligonucleotide
  Target: ATXN1; (-) strand; PAM type: NRG; PAM sequence: AGG
aaaaggcttttgccattttc

SEQ ID NO: 83684 - DNA, 20 bp, Artificial Sequence
  Description of Artificial Sequence: Synthetic oligonucleotide
  Target: ATXN1; (-) strand; PAM type: NRG; PAM sequence: CAG
aaaaaggcttttgccatttt

SEQ ID NO: 83685 - DNA, 20 bp, Artificial Sequence
  Description of Artificial Sequence: Synthetic oligonucleotide
  Target: ATXN1; (-) strand; PAM type: NRG; PAM sequence: AGG
tagcatccaaaaaataaaaa

SEQ ID NO: 83686 - DNA, 20 bp, Artificial Sequence
  Description of Artificial Sequence: Synthetic oligonucleotide
  Target: ATXN1; (-) strand; PAM type: NRG; PAM sequence: AAG
atagcatccaaaaaataaaa

SEQ ID NO: 83687 - DNA, 20 bp, Artificial Sequence
  Description of Artificial Sequence: Synthetic oligonucleotide
  Target: ATXN1; (-) strand; PAM type: NRG; PAM sequence: TAG
ccattttctgtgggtactga

SEQ ID NO: 83688 - DNA, 20 bp, Artificial Sequence
  Description of Artificial Sequence: Synthetic oligonucleotide
  Target: ATXN1; (-) strand; PAM type: NRG; PAM sequence: GGG
cttacaaccccattttctgt

SEQ ID NO: 83689 - DNA, 20 bp, Artificial Sequence
  Description of Artificial Sequence: Synthetic oligonucleotide
  Target: ATXN1; (-) strand; PAM type: NRG; PAM sequence: TGG
ccttacaaccccattttctg

SEQ ID NO: 83690 - DNA, 20 bp, Artificial Sequence
  Description of Artificial Sequence: Synthetic oligonucleotide
  Target: ATXN1; (-) strand; PAM type: NRG; PAM sequence: GAG
tacacatttgagtgggagct

SEQ ID NO: 83691 - DNA, 20 bp, Artificial Sequence
  Description of Artificial Sequence: Synthetic oligonucleotide
  Target: ATXN1; (-) strand; PAM type: NRG; PAM sequence: GAG
tgccttacacatttgagtgg

SEQ ID NO: 83692 - DNA, 20 bp, Artificial Sequence
  Description of Artificial Sequence: Synthetic oligonucleotide
  Target: ATXN1; (-) strand; PAM type: NRG; PAM sequence: GGG
gttgccttacacatttgagt

SEQ ID NO: 83693 - DNA, 20 bp, Artificial Sequence
  Description of Artificial Sequence: Synthetic oligonucleotide
  Target: ATXN1; (-) strand; PAM type: NRG; PAM sequence: TGG
tgttgccttacacatttgag

SEQ ID NO: 83694 - DNA, 20 bp, Artificial Sequence
  Description of Artificial Sequence: Synthetic oligonucleotide
  Target: ATXN1; (-) strand; PAM type: NRG; PAM sequence: GAG
gtatgttgccttacacattt

SEQ ID NO: 83695 - DNA, 20 bp, Artificial Sequence
  Description of Artificial Sequence: Synthetic oligonucleotide
  Target: ATXN1; (-) strand; PAM type: NRG; PAM sequence: CAG
tggcttatgttgatttctat

SEQ ID NO: 83696 - DNA, 20 bp, Artificial Sequence
  Description of Artificial Sequence: Synthetic oligonucleotide
  Target: ATXN1; (-) strand; PAM type: NRG; PAM sequence: TGG
ttgtcatgctttgaacttcc

SEQ ID NO: 83697 - DNA, 20 bp, Artificial Sequence
  Description of Artificial Sequence: Synthetic oligonucleotide
  Target: ATXN1; (-) strand; PAM type: NRG; PAM sequence: CAG
ccaagccggtaaagtaaaga

SEQ ID NO: 83698 - DNA, 20 bp, Artificial Sequence
  Description of Artificial Sequence: Synthetic oligonucleotide
  Target: ATXN1; (-) strand; PAM type: NRG; PAM sequence: AAG
tttaccaagccggtaaagta

SEQ ID NO: 83699 - DNA, 20 bp, Artificial Sequence
  Description of Artificial Sequence: Synthetic oligonucleotide
  Target: ATXN1; (-) strand; PAM type: NRG; PAM sequence: AAG
ctgtttttaccaagccggta

SEQ ID NO: 83700 - DNA, 20 bp, Artificial Sequence
  Description of Artificial Sequence: Synthetic oligonucleotide
  Target: ATXN1; (-) strand; PAM type: NRG; PAM sequence: CGG
aaattctgtttttaccaagc

SEQ ID NO: 83701 - DNA, 20 bp, Artificial Sequence
  Description of Artificial Sequence: Synthetic oligonucleotide
  Target: ATXN1; (-) strand; PAM type: NRG; PAM sequence: AAG
ctccaaattctgtttttacc

SEQ ID NO: 83702 - DNA, 20 bp, Artificial Sequence
  Description of Artificial Sequence: Synthetic oligonucleotide
  Target: ATXN1; (-) strand; PAM type: NRG; PAM sequence: CAG
tgatacaagccagtaacttg

SEQ ID NO: 83703 - DNA, 20 bp, Artificial Sequence
  Description of Artificial Sequence: Synthetic oligonucleotide
  Target: ATXN1; (-) strand; PAM type: NRG; PAM sequence: CAG
aagaaaagattgatacaagc

SEQ ID NO: 83704 - DNA, 20 bp, Artificial Sequence
  Description of Artificial Sequence: Synthetic oligonucleotide
  Target: ATXN1; (-) strand; PAM type: NRG; PAM sequence: AAG
aaaaaagaaaagattgatac

SEQ ID NO: 83705 - DNA, 20 bp, Artificial Sequence
  Description of Artificial Sequence: Synthetic oligonucleotide
  Target: ATXN1; (-) strand; PAM type: NRG; PAM sequence: AAG
tatttttagttaaaaaagaa

SEQ ID NO: 83706 - DNA, 20 bp, Artificial Sequence
  Description of Artificial Sequence: Synthetic oligonucleotide
  Target: ATXN1; (-) strand; PAM type: NRG; PAM sequence: AAG
caagatatttttagttaaaa

SEQ ID NO: 83707 - DNA, 20 bp, Artificial Sequence
  Description of Artificial Sequence: Synthetic oligonucleotide
  Target: ATXN1; (-) strand; PAM type: NRG; PAM sequence: TAG
gaaatgcagcaagatatttt

SEQ ID NO: 83708 - DNA, 20 bp, Artificial Sequence
  Description of Artificial Sequence: Synthetic oligonucleotide
  Target: ATXN1; (-) strand; PAM type: NRG; PAM sequence: AAG
acaaataagagaaatgcagc

SEQ ID NO: 83709 - DNA, 20 bp, Artificial Sequence
  Description of Artificial Sequence: Synthetic oligonucleotide
  Target: ATXN1; (-) strand; PAM type: NRG; PAM sequence: CAG
ggtaacaaataagagaaatg

SEQ ID NO: 83710 - DNA, 20 bp, Artificial Sequence
  Description of Artificial Sequence: Synthetic oligonucleotide
  Target: ATXN1; (-) strand; PAM type: NRG; PAM sequence: GAG
atgaagttggtaacaaataa

SEQ ID NO: 83711 - DNA, 20 bp, Artificial Sequence
  Description of Artificial Sequence: Synthetic oligonucleotide
  Target: ATXN1; (-) strand; PAM type: NRG; PAM sequence: AAG
atatgaagttggtaacaaat

SEQ ID NO: 83712 - DNA, 20 bp, Artificial Sequence
  Description of Artificial Sequence: Synthetic oligonucleotide
  Target: ATXN1; (-) strand; PAM type: NRG; PAM sequence: TGG
aatacctcgagatatgaagt

SEQ ID NO: 83713 - DNA, 20 bp, Artificial Sequence
  Description of Artificial Sequence: Synthetic oligonucleotide
  Target: ATXN1; (-) strand; PAM type: NRG; PAM sequence: AAG
atagaatacctcgagatatg

SEQ ID NO: 83714 - DNA, 20 bp, Artificial Sequence
  Description of Artificial Sequence: Synthetic oligonucleotide
  Target: ATXN1; (-) strand; PAM type: NRG; PAM sequence: GAG
ttccaattatagaatacctc

SEQ ID NO: 83715 - DNA, 20 bp, Artificial Sequence
  Description of Artificial Sequence: Synthetic oligonucleotide
  Target: ATXN1; (-) strand; PAM type: NRG; PAM sequence: TAG
tcaaggacctcttccaatta

SEQ ID NO: 83716 - DNA, 20 bp, Artificial Sequence
  Description of Artificial Sequence: Synthetic oligonucleotide
  Target: ATXN1; (-) strand; PAM type: NRG; PAM sequence: AGG
gacattggaatgaaacgtca

SEQ ID NO: 83717 - DNA, 20 bp, Artificial Sequence
  Description of Artificial Sequence: Synthetic oligonucleotide
  Target: ATXN1; (-) strand; PAM type: NRG; PAM sequence: AAG
agacattggaatgaaacgtc

SEQ ID NO: 83718 - DNA, 20 bp, Artificial Sequence
  Description of Artificial Sequence: Synthetic oligonucleotide
  Target: ATXN1; (-) strand; PAM type: NRG; PAM sequence: TGG
ggttcctttgcagaagacat

SEQ ID NO: 83719 - DNA, 20 bp, Artificial Sequence
  Description of Artificial Sequence: Synthetic oligonucleotide
  Target: ATXN1; (-) strand; PAM type: NRG; PAM sequence: AAG
gtcagcaggttcctttgcag

SEQ ID NO: 83720 - DNA, 20 bp, Artificial Sequence
  Description of Artificial Sequence: Synthetic oligonucleotide
  Target: ATXN1; (-) strand; PAM type: NRG; PAM sequence: CAG
tgggtcagcaggttcctttg

SEQ ID NO: 83721 - DNA, 20 bp, Artificial Sequence
  Description of Artificial Sequence: Synthetic oligonucleotide
  Target: ATXN1; (-) strand; PAM type: NRG; PAM sequence: AGG
gtcaacctccctgggtcagc

SEQ ID NO: 83722 - DNA, 20 bp, Artificial Sequence
  Description of Artificial Sequence: Synthetic oligonucleotide
  Target: ATXN1; (-) strand; PAM type: NRG; PAM sequence: CAG
tgtcaacctccctgggtcag

SEQ ID NO: 83723 - DNA, 20 bp, Artificial Sequence
  Description of Artificial Sequence: Synthetic oligonucleotide
  Target: ATXN1; (-) strand; PAM type: NRG; PAM sequence: CAG
gtatgtcaacctccctgggt

SEQ ID NO: 83724 - DNA, 20 bp, Artificial Sequence
  Description of Artificial Sequence: Synthetic oligonucleotide
  Target: ATXN1; (-) strand; PAM type: NRG; PAM sequence: GGG
agaggtatgtcaacctccct

SEQ ID NO: 83725 - DNA, 20 bp, Artificial Sequence
  Description of Artificial Sequence: Synthetic oligonucleotide
  Target: ATXN1; (-) strand; PAM type: NRG; PAM sequence: TGG
aagaggtatgtcaacctccc

SEQ ID NO: 83726 - DNA, 20 bp, Artificial Sequence
  Description of Artificial Sequence: Synthetic oligonucleotide
  Target: ATXN1; (-) strand; PAM type: NRG; PAM sequence: AGG
ttctgtatgactttaaaaag

SEQ ID NO: 83727 - DNA, 20 bp, Artificial Sequence
  Description of Artificial Sequence: Synthetic oligonucleotide
  Target: ATXN1; (-) strand; PAM type: NRG; PAM sequence: GAG
tttctgtatgactttaaaaa

SEQ ID NO: 83728 - DNA, 20 bp, Artificial Sequence
  Description of Artificial Sequence: Synthetic oligonucleotide
  Target: ATXN1; (-) strand; PAM type: NRG; PAM sequence: AAG
actttctgtatgactttaaa

SEQ ID NO: 83729 - DNA, 20 bp, Artificial Sequence
  Description of Artificial Sequence: Synthetic oligonucleotide
  Target: ATXN1; (-) strand; PAM type: NRG; PAM sequence: AAG
ttgaacccagaatccagtca

SEQ ID NO: 83730 - DNA, 20 bp, Artificial Sequence
  Description of Artificial Sequence: Synthetic oligonucleotide
  Target: ATXN1; (-) strand; PAM type: NRG; PAM sequence: CAG
gagtggttgaacccagaatc

SEQ ID NO: 83731 - DNA, 20 bp, Artificial Sequence
  Description of Artificial Sequence: Synthetic oligonucleotide
  Target: ATXN1; (-) strand; PAM type: NRG; PAM sequence: CAG
tgagcatgagtggttgaacc

SEQ ID NO: 83732 - DNA, 20 bp, Artificial Sequence
  Description of Artificial Sequence: Synthetic oligonucleotide
  Target: ATXN1; (-) strand; PAM type: NRG; PAM sequence: TGG
taagcgtcaatgagcatgag

SEQ ID NO: 83733 - DNA, 20 bp, Artificial Sequence
  Description of Artificial Sequence: Synthetic oligonucleotide
  Target: ATXN1; (-) strand; PAM type: NRG; PAM sequence: GAG
cattaagcgtcaatgagcat

SEQ ID NO: 83734 - DNA, 20 bp, Artificial Sequence
  Description of Artificial Sequence: Synthetic oligonucleotide
  Target: ATXN1; (-) strand; PAM type: NRG; PAM sequence: GAG
tatgtccattaagcgtcaat

SEQ ID NO: 83735 - DNA, 20 bp, Artificial Sequence
  Description of Artificial Sequence: Synthetic oligonucleotide
  Target: ATXN1; (-) strand; PAM type: NRG; PAM sequence: AAG
taaatgagtttatgtccatt

SEQ ID NO: 83736 - DNA, 20 bp, Artificial Sequence
  Description of Artificial Sequence: Synthetic oligonucleotide
  Target: ATXN1; (-) strand; PAM type: NRG; PAM sequence: GAG
cgcattacatttcattaaat

SEQ ID NO: 83737 - DNA, 20 bp, Artificial Sequence
  Description of Artificial Sequence: Synthetic oligonucleotide
  Target: ATXN1; (-) strand; PAM type: NRG; PAM sequence: TGG
atgaggaagtatcatgctac

SEQ ID NO: 83738 - DNA, 20 bp, Artificial Sequence
  Description of Artificial Sequence: Synthetic oligonucleotide
  Target: ATXN1; (-) strand; PAM type: NRG; PAM sequence: AAG
agaaagagagtactatgagg

SEQ ID NO: 83739 - DNA, 20 bp, Artificial Sequence
  Description of Artificial Sequence: Synthetic oligonucleotide
  Target: ATXN1; (-) strand; PAM type: NRG; PAM sequence: AGG
aacagaaagagagtactatg

SEQ ID NO: 83740 - DNA, 20 bp, Artificial Sequence
  Description of Artificial Sequence: Synthetic oligonucleotide
  Target: ATXN1; (-) strand; PAM type: NRG; PAM sequence: GAG
aaacagaaagagagtactat

SEQ ID NO: 83741 - DNA, 20 bp, Artificial Sequence
  Description of Artificial Sequence: Synthetic oligonucleotide
  Target: ATXN1; (-) strand; PAM type: NRG; PAM sequence: GAG
gcaaaaacaaaacagaaaga

SEQ ID NO: 83742 - DNA, 20 bp, Artificial Sequence
  Description of Artificial Sequence: Synthetic oligonucleotide
  Target: ATXN1; (-) strand; PAM type: NRG; PAM sequence: GAG
tggcaaaaacaaaacagaaa

SEQ ID NO: 83743 - DNA, 20 bp, Artificial Sequence
  Description of Artificial Sequence: Synthetic oligonucleotide
  Target: ATXN1; (-) strand; PAM type: NRG; PAM sequence: AAG
tatggcaaaaacaaaacaga

SEQ ID NO: 83744 - DNA, 20 bp, Artificial Sequence
  Description of Artificial Sequence: Synthetic oligonucleotide
  Target: ATXN1; (-) strand; PAM type: NRG; PAM sequence: CAG
ttcttatggcaaaaacaaaa

SEQ ID NO: 83745 - DNA, 20 bp, Artificial Sequence
  Description of Artificial Sequence: Synthetic oligonucleotide
  Target: ATXN1; (-) strand; PAM type: NRG; PAM sequence: TGG
gaaatgaatttattttctta

SEQ ID NO: 83746 - DNA, 20 bp, Artificial Sequence
  Description of Artificial Sequence: Synthetic oligonucleotide
  Target: ATXN1; (-) strand; PAM type: NRG; PAM sequence: CAG
tagttgaaaataatataatc

SEQ ID NO: 83747 - DNA, 20 bp, Artificial Sequence
  Description of Artificial Sequence: Synthetic oligonucleotide
  Target: ATXN1; (-) strand; PAM type: NRG; PAM sequence: TAG
agatcgattttgctgcaaga

SEQ ID NO: 83748 - DNA, 20 bp, Artificial Sequence
  Description of Artificial Sequence: Synthetic oligonucleotide
  Target: ATXN1; (-) strand; PAM type: NRG; PAM sequence: AAG
tcccagatcgattttgctgc

SEQ ID NO: 83749 - DNA, 20 bp, Artificial Sequence
  Description of Artificial Sequence: Synthetic oligonucleotide
  Target: ATXN1; (-) strand; PAM type: NRG; PAM sequence: CAG
tgggaccattctgcctctcc

SEQ ID NO: 83750 - DNA, 20 bp, Artificial Sequence
  Description of Artificial Sequence: Synthetic oligonucleotide
  Target: ATXN1; (-) strand; PAM type: NRG; PAM sequence: GGG
aggttgttaaagtaacaaat

SEQ ID NO: 83751 - DNA, 20 bp, Artificial Sequence
  Description of Artificial Sequence: Synthetic oligonucleotide
  Target: ATXN1; (-) strand; PAM type: NRG; PAM sequence: TGG
aaggttgttaaagtaacaaa

SEQ ID NO: 83752 - DNA, 20 bp, Artificial Sequence
  Description of Artificial Sequence: Synthetic oligonucleotide
  Target: ATXN1; (-) strand; PAM type: NRG; PAM sequence: AAG
gcagctggtgaaggttgtta

SEQ ID NO: 83753 - DNA, 20 bp, Artificial Sequence
  Description of Artificial Sequence: Synthetic oligonucleotide
  Target: ATXN1; (-) strand; PAM type: NRG; PAM sequence: AGG
ctagctttggcagctggtga

SEQ ID NO: 83754 - DNA, 20 bp, Artificial Sequence
  Description of Artificial Sequence: Synthetic oligonucleotide
  Target: ATXN1; (-) strand; PAM type: NRG; PAM sequence: AAG
cctagctttggcagctggtg

SEQ ID NO: 83755 - DNA, 20 bp, Artificial Sequence
  Description of Artificial Sequence: Synthetic oligonucleotide
  Target: ATXN1; (-) strand; PAM type: NRG; PAM sequence: TGG
ggacacctagctttggcagc

SEQ ID NO: 83756 - DNA, 20 bp, Artificial Sequence
  Description of Artificial Sequence: Synthetic oligonucleotide
  Target: ATXN1; (-) strand; PAM type: NRG; PAM sequence: CAG
ttctggacacctagctttgg

SEQ ID NO: 83757 - DNA, 20 bp, Artificial Sequence
  Description of Artificial Sequence: Synthetic oligonucleotide
  Target: ATXN1; (-) strand; PAM type: NRG; PAM sequence: TGG
cttttctggacacctagctt

SEQ ID NO: 83758 - DNA, 20 bp, Artificial Sequence
  Description of Artificial Sequence: Synthetic oligonucleotide
  Target: ATXN1; (-) strand; PAM type: NRG; PAM sequence: TAG
accttacttttctggacacc

SEQ ID NO: 83759 - DNA, 20 bp, Artificial Sequence
  Description of Artificial Sequence: Synthetic oligonucleotide
  Target: ATXN1; (-) strand; PAM type: NRG; PAM sequence: TGG
tagtataaaccttacttttc

SEQ ID NO: 83760 - DNA, 20 bp, Artificial Sequence
  Description of Artificial Sequence: Synthetic oligonucleotide
  Target: ATXN1; (-) strand; PAM type: NRG; PAM sequence: TAG
attttttttttctgtatgaa

SEQ ID NO: 83761 - DNA, 20 bp, Artificial Sequence
  Description of Artificial Sequence: Synthetic oligonucleotide
  Target: ATXN1; (-) strand; PAM type: NRG; PAM sequence: GAG
gaaaatattgtcacttagat

SEQ ID NO: 83762 - DNA, 20 bp, Artificial Sequence
  Description of Artificial Sequence: Synthetic oligonucleotide
  Target: ATXN1; (-) strand; PAM type: NRG; PAM sequence: TAG
gaatggaaaatattgtcact

SEQ ID NO: 83763 - DNA, 20 bp, Artificial Sequence
  Description of Artificial Sequence: Synthetic oligonucleotide
  Target: ATXN1; (-) strand; PAM type: NRG; PAM sequence: TGG
tctacagatataagtaagaa

SEQ ID NO: 83764 - DNA, 20 bp, Artificial Sequence
  Description of Artificial Sequence: Synthetic oligonucleotide
  Target: ATXN1; (-) strand; PAM type: NRG; PAM sequence: AAG
tcacatctacagatataagt

SEQ ID NO: 83765 - DNA, 20 bp, Artificial Sequence
  Description of Artificial Sequence: Synthetic oligonucleotide
  Target: ATXN1; (-) strand; PAM type: NRG; PAM sequence: AAG
tccttcacatctacagatat

SEQ ID NO: 83766 - DNA, 20 bp, Artificial Sequence
  Description of Artificial Sequence: Synthetic oligonucleotide
  Target: ATXN1; (-) strand; PAM type: NRG; PAM sequence: CAG
ttccaactccttcacatcta

SEQ ID NO: 83767 - DNA, 20 bp, Artificial Sequence
  Description of Artificial Sequence: Synthetic oligonucleotide
  Target: ATXN1; (-) strand; PAM type: NRG; PAM sequence: CAG
tgaaggtcagcgataaatca

SEQ ID NO: 83768 - DNA, 20 bp, Artificial Sequence
  Description of Artificial Sequence: Synthetic oligonucleotide
  Target: ATXN1; (-) strand; PAM type: NRG; PAM sequence: CAG
tagtatgtgcaaatgaaggt

SEQ ID NO: 83769 - DNA, 20 bp, Artificial Sequence
  Description of Artificial Sequence: Synthetic oligonucleotide
  Target: ATXN1; (-) strand; PAM type: NRG; PAM sequence: AGG
gttgtagtatgtgcaaatga

SEQ ID NO: 83770 - DNA, 20 bp, Artificial Sequence
  Description of Artificial Sequence: Synthetic oligonucleotide
  Target: ATXN1; (-) strand; PAM type: NRG; PAM sequence: AAG
tgttgtagtatgtgcaaatg

SEQ ID NO: 83771 - DNA, 20 bp, Artificial Sequence
  Description of Artificial Sequence: Synthetic oligonucleotide
  Target: ATXN1; (-) strand; PAM type: NRG; PAM sequence: TAG
gagttgcctcatagctgttg

SEQ ID NO: 83772 - DNA, 20 bp, Artificial Sequence
  Description of Artificial Sequence: Synthetic oligonucleotide
  Target: ATXN1; (-) strand; PAM type: NRG; PAM sequence: TAG
ttttgataagagttgcctca

SEQ ID NO: 83773 - DNA, 20 bp, Artificial Sequence
  Description of Artificial Sequence: Synthetic oligonucleotide
  Target: ATXN1; (-) strand; PAM type: NRG; PAM sequence: GAG
cagttgttttcttttgataa

SEQ ID NO: 83774 - DNA, 20 bp, Artificial Sequence
  Description of Artificial Sequence: Synthetic oligonucleotide
  Target: ATXN1; (-) strand; PAM type: NRG; PAM sequence: AAG
ttcagttgttttcttttgat

SEQ ID NO: 83775 - DNA, 20 bp, Artificial Sequence
  Description of Artificial Sequence: Synthetic oligonucleotide
  Target: ATXN1; (-) strand; PAM type: NRG; PAM sequence: CAG
aaagaagtgtgtagaatttt

SEQ ID NO: 83776 - DNA, 20 bp, Artificial Sequence
  Description of Artificial Sequence: Synthetic oligonucleotide
  Target: ATXN1; (-) strand; PAM type: NRG; PAM sequence: TAG
attgcttaaaaagaagtgtg

SEQ ID NO: 83777 - DNA, 20 bp, Artificial Sequence
  Description of Artificial Sequence: Synthetic oligonucleotide
  Target: ATXN1; (-) strand; PAM type: NRG; PAM sequence: AAG
tgaaattattgcttaaaaag

SEQ ID NO: 83778 - DNA, 20 bp, Artificial Sequence
  Description of Artificial Sequence: Synthetic oligonucleotide
  Target: ATXN1; (-) strand; PAM type: NRG; PAM sequence: AAG
tattgaaattattgcttaaa

SEQ ID NO: 83779 - DNA, 20 bp, Artificial Sequence
  Description of Artificial Sequence: Synthetic oligonucleotide
  Target: ATXN1; (-) strand; PAM type: NRG; PAM sequence: AAG
aagagtttgctgaaagaggg

SEQ ID NO: 83780 - DNA, 20 bp, Artificial Sequence
  Description of Artificial Sequence: Synthetic oligonucleotide
  Target: ATXN1; (-) strand; PAM type: NRG; PAM sequence: GGG
ataaagagtttgctgaaaga

SEQ ID NO: 83781 - DNA, 20 bp, Artificial Sequence
  Description of Artificial Sequence: Synthetic oligonucleotide
  Target: ATXN1; (-) strand; PAM type: NRG; PAM sequence: AGG
gataaagagtttgctgaaag

SEQ ID NO: 83782 - DNA, 20 bp, Artificial Sequence
  Description of Artificial Sequence: Synthetic oligonucleotide
  Target: ATXN1; (-) strand; PAM type: NRG; PAM sequence: GAG
tgataaagagtttgctgaaa

SEQ ID NO: 83783 - DNA, 20 bp, Artificial Sequence
  Description of Artificial Sequence: Synthetic oligonucleotide
  Target: ATXN1; (-) strand; PAM type: NRG; PAM sequence: AAG
attgataaagagtttgctga

SEQ ID NO: 83784 - DNA, 20 bp, Artificial Sequence
  Description of Artificial Sequence: Synthetic oligonucleotide
  Target: ATXN1; (-) strand; PAM type: NRG; PAM sequence: GAG
ttattaacggtattgataaa

SEQ ID NO: 83785 - DNA, 20 bp, Artificial Sequence
  Description of Artificial Sequence: Synthetic oligonucleotide
  Target: ATXN1; (-) strand; PAM type: NRG; PAM sequence: AAG
tattattaacggtattgata

SEQ ID NO: 83786 - DNA, 20 bp, Artificial Sequence
  Description of Artificial Sequence: Synthetic oligonucleotide
  Target: ATXN1; (-) strand; PAM type: NRG; PAM sequence: CGG
gttttgttgattattattaa

SEQ ID NO: 83787 - DNA, 20 bp, Artificial Sequence
  Description of Artificial Sequence: Synthetic oligonucleotide
  Target: ATXN1; (-) strand; PAM type: NRG; PAM sequence: CAG
gacagagattaaacccaagc

SEQ ID NO: 83788 - DNA, 20 bp, Artificial Sequence
  Description of Artificial Sequence: Synthetic oligonucleotide
  Target: ATXN1; (-) strand; PAM type: NRG; PAM sequence: AAG
aggtgacagagattaaaccc

SEQ ID NO: 83789 - DNA, 20 bp, Artificial Sequence
  Description of Artificial Sequence: Synthetic oligonucleotide
  Target: ATXN1; (-) strand; PAM type: NRG; PAM sequence: GAG
acaagaagggataggtgaca

SEQ ID NO: 83790 - DNA, 20 bp, Artificial Sequence
  Description of Artificial Sequence: Synthetic oligonucleotide
  Target: ATXN1; (-) strand; PAM type: NRG; PAM sequence: CAG
aaacaagaagggataggtga

SEQ ID NO: 83791 - DNA, 20 bp, Artificial Sequence
  Description of Artificial Sequence: Synthetic oligonucleotide
  Target: ATXN1; (-) strand; PAM type: NRG; PAM sequence: AGG
aatggtaaacaagaagggat

SEQ ID NO: 83792 - DNA, 20 bp, Artificial Sequence
  Description of Artificial Sequence: Synthetic oligonucleotide
  Target: ATXN1; (-) strand; PAM type: NRG; PAM sequence: TAG
aaatggtaaacaagaaggga

SEQ ID NO: 83793 - DNA, 20 bp, Artificial Sequence
  Description of Artificial Sequence: Synthetic oligonucleotide
  Target: ATXN1; (-) strand; PAM type: NRG; PAM sequence: GGG
cttcaaatggtaaacaagaa

SEQ ID NO: 83794 - DNA, 20 bp, Artificial Sequence
  Description of Artificial Sequence: Synthetic oligonucleotide
  Target: ATXN1; (-) strand; PAM type: NRG; PAM sequence: AGG
acttcaaatggtaaacaaga

SEQ ID NO: 83795 - DNA, 20 bp, Artificial Sequence
  Description of Artificial Sequence: Synthetic oligonucleotide
  Target: ATXN1; (-) strand; PAM type: NRG; PAM sequence: AAG
aacttcaaatggtaaacaag

SEQ ID NO: 83796 - DNA, 20 bp, Artificial Sequence
  Description of Artificial Sequence: Synthetic oligonucleotide
  Target: ATXN1; (-) strand; PAM type: NRG; PAM sequence: AAG
gataacttcaaatggtaaac

SEQ ID NO: 83797 - DNA, 20 bp, Artificial Sequence
  Description of Artificial Sequence: Synthetic oligonucleotide
  Target: ATXN1; (-) strand; PAM type: NRG; PAM sequence: TGG
ttgcttatgataacttcaaa

SEQ ID NO: 83798 - DNA, 20 bp, Artificial Sequence
  Description of Artificial Sequence: Synthetic oligonucleotide
  Target: ATXN1; (-) strand; PAM type: NRG; PAM sequence: TGG
tcttctgctttttgggcttt

SEQ ID NO: 83799 - DNA, 20 bp, Artificial Sequence
  Description of Artificial Sequence: Synthetic oligonucleotide
  Target: ATXN1; (-) strand; PAM type: NRG; PAM sequence: GGG
tgctttctcttctgcttttt

SEQ ID NO: 83800 - DNA, 20 bp, Artificial Sequence
  Description of Artificial Sequence: Synthetic oligonucleotide
  Target: ATXN1; (-) strand; PAM type: NRG; PAM sequence: TGG
gtgctttctcttctgctttt

SEQ ID NO: 83801 - DNA, 20 bp, Artificial Sequence
  Description of Artificial Sequence: Synthetic oligonucleotide
  Target: ATXN1; (-) strand; PAM type: NRG; PAM sequence: AGG
ggcatatctgtgaatgccct

SEQ ID NO: 83802 - DNA, 20 bp, Artificial Sequence
  Description of Artificial Sequence: Synthetic oligonucleotide
  Target: ATXN1; (-) strand; PAM type: NRG; PAM sequence: TAG
aggcatatctgtgaatgccc

SEQ ID NO: 83803 - DNA, 20 bp, Artificial Sequence
  Description of Artificial Sequence: Synthetic oligonucleotide
  Target: ATXN1; (-) strand; PAM type: NRG; PAM sequence: AGG
tagccaactttcacatatgc

SEQ ID NO: 83804 - DNA, 20 bp, Artificial Sequence
  Description of Artificial Sequence: Synthetic oligonucleotide
  Target: ATXN1; (-) strand; PAM type: NRG; PAM sequence: CAG
atagccaactttcacatatg

SEQ ID NO: 83805 - DNA, 20 bp, Artificial Sequence
  Description of Artificial Sequence: Synthetic oligonucleotide
  Target: ATXN1; (-) strand; PAM type: NRG; PAM sequence: TAG
gtgagatcctttttaaaata

SEQ ID NO: 83806 - DNA, 20 bp, Artificial Sequence
  Description of Artificial Sequence: Synthetic oligonucleotide
  Target: ATXN1; (-) strand; PAM type: NRG; PAM sequence: GAG
attggaaaaccctctggagt

SEQ ID NO: 83807 - DNA, 20 bp, Artificial Sequence
  Description of Artificial Sequence: Synthetic oligonucleotide
  Target: ATXN1; (-) strand; PAM type: NRG; PAM sequence: GAG
tcaaattggaaaaccctctg

SEQ ID NO: 83808 - DNA, 20 bp, Artificial Sequence
  Description of Artificial Sequence: Synthetic oligonucleotide
  Target: ATXN1; (-) strand; PAM type: NRG; PAM sequence: TGG
tatcaaattggaaaaccctc

SEQ ID NO: 83809 - DNA, 20 bp, Artificial Sequence
  Description of Artificial Sequence: Synthetic oligonucleotide
  Target: ATXN1; (-) strand; PAM type: NRG; PAM sequence: TGG
caccaaaatgtctatcaaat

SEQ ID NO: 83810 - DNA, 20 bp, Artificial Sequence
  Description of Artificial Sequence: Synthetic oligonucleotide
  Target: ATXN1; (-) strand; PAM type: NRG; PAM sequence: CAG
tgctgttgcttataactgtt

SEQ ID NO: 83811 - DNA, 20 bp, Artificial Sequence
  Description of Artificial Sequence: Synthetic oligonucleotide
  Target: ATXN1; (-) strand; PAM type: NRG; PAM sequence: AGG
actcccaggtcactgtttat

SEQ ID NO: 83812 - DNA, 20 bp, Artificial Sequence
  Description of Artificial Sequence: Synthetic oligonucleotide
  Target: ATXN1; (-) strand; PAM type: NRG; PAM sequence: TAG
gactcccaggtcactgttta

SEQ ID NO: 83813 - DNA, 20 bp, Artificial Sequence
  Description of Artificial Sequence: Synthetic oligonucleotide
  Target: ATXN1; (-) strand; PAM type: NRG; PAM sequence: AGG
aagtatatttcatgactccc

SEQ ID NO: 83814 - DNA, 20 bp, Artificial Sequence
  Description of Artificial Sequence: Synthetic oligonucleotide
  Target: ATXN1; (-) strand; PAM type: NRG; PAM sequence: CAG
aaagtatatttcatgactcc

SEQ ID NO: 83815 - DNA, 20 bp, Artificial Sequence
  Description of Artificial Sequence: Synthetic oligonucleotide
  Target: ATXN1; (-) strand; PAM type: NRG; PAM sequence: AAG
gctacaacattaagactaaa

SEQ ID NO: 83816 - DNA, 20 bp, Artificial Sequence
  Description of Artificial Sequence: Synthetic oligonucleotide
  Target: ATXN1; (-) strand; PAM type: NRG; PAM sequence: AAG
gtccaattagctacaacatt

SEQ ID NO: 83817 - DNA, 20 bp, Artificial Sequence
  Description of Artificial Sequence: Synthetic oligonucleotide
  Target: ATXN1; (-) strand; PAM type: NRG; PAM sequence: TAG
cttacatttaaaagtccaat

SEQ ID NO: 83818 - DNA, 20 bp, Artificial Sequence
  Description of Artificial Sequence: Synthetic oligonucleotide
  Target: ATXN1; (-) strand; PAM type: NRG; PAM sequence: AAG
aggccgtgacttacatttaa

SEQ ID NO: 83819 - DNA, 20 bp, Artificial Sequence
  Description of Artificial Sequence: Synthetic oligonucleotide
  Target: ATXN1; (-) strand; PAM type: NRG; PAM sequence: AGG
aggaactaattttatttaaa

SEQ ID NO: 83820 - DNA, 20 bp, Artificial Sequence
  Description of Artificial Sequence: Synthetic oligonucleotide
  Target: ATXN1; (-) strand; PAM type: NRG; PAM sequence: AAG
taggaactaattttatttaa

SEQ ID NO: 83821 - DNA, 20 bp, Artificial Sequence
  Description of Artificial Sequence: Synthetic oligonucleotide
  Target: ATXN1; (-) strand; PAM type: NRG; PAM sequence: AGG
gttcctttatttgatagatt

SEQ ID NO: 83822 - DNA, 20 bp, Artificial Sequence
  Description of Artificial Sequence: Synthetic oligonucleotide
  Target: ATXN1; (-) strand; PAM type: NRG; PAM sequence: TAG
agttcctttatttgatagat

SEQ ID NO: 83823 - DNA, 20 bp, Artificial Sequence
  Description of Artificial Sequence: Synthetic oligonucleotide
  Target: ATXN1; (-) strand; PAM type: NRG; PAM sequence: TAG
taataagttcctttatttga

SEQ ID NO: 83824 - DNA, 20 bp, Artificial Sequence
  Description of Artificial Sequence: Synthetic oligonucleotide
  Target: ATXN1; (-) strand; PAM type: NRG; PAM sequence: AAG
aattatggcaaacatttaat

SEQ ID NO: 83825 - DNA, 20 bp, Artificial Sequence
  Description of Artificial Sequence: Synthetic oligonucleotide
  Target: ATXN1; (-) strand; PAM type: NRG; PAM sequence: TGG
ttataattgagaattaatta

SEQ ID NO: 83826 - DNA, 20 bp, Artificial Sequence
  Description of Artificial Sequence: Synthetic oligonucleotide
  Target: ATXN1; (-) strand; PAM type: NRG; PAM sequence: GAG
tgtaaaaacaaattataatt

SEQ ID NO: 83827 - DNA, 20 bp, Artificial Sequence
  Description of Artificial Sequence: Synthetic oligonucleotide
  Target: ATXN1; (-) strand; PAM type: NRG; PAM sequence: TAG
gtctagtaaatcatataaga

SEQ ID NO: 83828 - DNA, 20 bp, Artificial Sequence
  Description of Artificial Sequence: Synthetic oligonucleotide
  Target: ATXN1; (-) strand; PAM type: NRG; PAM sequence: AAG
gtgggtctagtaaatcatat

SEQ ID NO: 83829 - DNA, 20 bp, Artificial Sequence
  Description of Artificial Sequence: Synthetic oligonucleotide
  Target: ATXN1; (-) strand; PAM type: NRG; PAM sequence: TAG
aaagatatacttagtgggtc

SEQ ID NO: 83830 - DNA, 20 bp, Artificial Sequence
  Description of Artificial Sequence: Synthetic oligonucleotide
  Target: ATXN1; (-) strand; PAM type: NRG; PAM sequence: GGG
tgaataaagatatacttagt

SEQ ID NO: 83831 - DNA, 20 bp, Artificial Sequence
  Description of Artificial Sequence: Synthetic oligonucleotide
  Target: ATXN1; (-) strand; PAM type: NRG; PAM sequence: TGG
ttgaataaagatatacttag

SEQ ID NO: 83832 - DNA, 20 bp, Artificial Sequence
  Description of Artificial Sequence: Synthetic oligonucleotide
  Target: ATXN1; (-) strand; PAM type: NRG; PAM sequence: TAG
tttttgaataaagatatact

SEQ ID NO: 83833 - DNA, 20 bp, Artificial Sequence
  Description of Artificial Sequence: Synthetic oligonucleotide
  Target: ATXN1; (-) strand; PAM type: NRG; PAM sequence: AAG
aattgttgcatttttgaata

SEQ ID NO: 83834 - DNA, 20 bp, Artificial Sequence
  Description of Artificial Sequence: Synthetic oligonucleotide
  Target: ATXN1; (-) strand; PAM type: NRG; PAM sequence: GAG
ccctgagttgatattctact

SEQ ID NO: 83835 - DNA, 20 bp, Artificial Sequence
  Description of Artificial Sequence: Synthetic oligonucleotide
  Target: ATXN1; (-) strand; PAM type: NRG; PAM sequence: GAG
aataaacctcttttttccct

SEQ ID NO: 83836 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggtgaaa

SEQ ID NO: 83837 - DNA, 20 bp, Artificial Sequence
  Description of Artificial Sequence: Synthetic oligonucleotide
  Target: ATXN1; (-) strand; PAM type: NRG; PAM sequence: AAG
ctgcactccagcctgggtga

SEQ ID NO: 83838 - DNA, 20 bp, Artificial Sequence
  Description of Artificial Sequence: Synthetic oligonucleotide
  Target: ATXN1; (-) strand; PAM type: NRG; PAM sequence: GGG
actccactgcactccagcct

SEQ ID NO: 83839 - DNA, 20 bp, Artificial Sequence
  Description of Artificial Sequence: Synthetic oligonucleotide
  Target: ATXN1; (-) strand; PAM type: NRG; PAM sequence: TGG
cactccactgcactccagcc

SEQ ID NO: 83840 - DNA, 20 bp, Artificial Sequence
  Description of Artificial Sequence: Synthetic oligonucleotide
  Target: ATXN1; (-) strand; PAM type: NRG; PAM sequence: CAG
gagatcactccactgcactc

SEQ ID NO: 83841 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagct

SEQ ID NO: 83842 - DNA, 20 bp, Artificial Sequence
  Description of Artificial Sequence: Synthetic oligonucleotide
  Target: ATXN1; (-) strand; PAM type: NRG; PAM sequence: GAG
cagaaggcagaggttgcagt

SEQ ID NO: 83843 - DNA, 20 bp, Artificial Sequence
  Description of Artificial Sequence: Synthetic oligonucleotide
  Target: ATXN1; (-) strand; PAM type: NRG; PAM sequence: CAG
aaaccagaaggcagaggttg

SEQ ID NO: 83844 - DNA, 20 bp, Artificial Sequence
  Description of Artificial Sequence: Synthetic oligonucleotide
  Target: ATXN1; (-) strand; PAM type: NRG; PAM sequence: AGG
tgcttgaaaccagaaggcag

SEQ ID NO: 83845 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaaaccagaaggca

SEQ ID NO: 83846 - DNA, 20 bp, Artificial Sequence
  Description of Artificial Sequence: Synthetic oligonucleotide
  Target: ATXN1; (-) strand; PAM type: NRG; PAM sequence: CAG
aattgcttgaaaccagaagg

SEQ ID NO: 83847 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaaaccaga

SEQ ID NO: 83848 - DNA, 20 bp, Artificial Sequence
  Description of Artificial Sequence: Synthetic oligonucleotide
  Target: ATXN1; (-) strand; PAM type: NRG; PAM sequence: AAG
ggagaattgcttgaaaccag

SEQ ID NO: 83849 - DNA, 20 bp, Artificial Sequence
  Description of Artificial Sequence: Synthetic oligonucleotide
  Target: ATXN1; (-) strand; PAM type: NRG; PAM sequence: CAG
gcaggagaattgcttgaaac

SEQ ID NO: 83850 - DNA, 20 bp, Artificial Sequence
  Description of Artificial Sequence: Synthetic oligonucleotide
  Target: ATXN1; (-) strand; PAM type: NRG; PAM sequence: GAG
tacttgggagcctgaggcag

SEQ ID NO: 83851 - DNA, 20 bp, Artificial Sequence
  Description of Artificial Sequence: Synthetic oligonucleotide
  Target: ATXN1; (-) strand; PAM type: NRG; PAM sequence: AGG
gctacttgggagcctgaggc

SEQ ID NO: 83852 - DNA, 20 bp, Artificial Sequence
  Description of Artificial Sequence: Synthetic oligonucleotide
  Target: ATXN1; (-) strand; PAM type: NRG; PAM sequence: CAG
agctacttgggagcctgagg

SEQ ID NO: 83853 - DNA, 20 bp, Artificial Sequence
  Description of Artificial Sequence: Synthetic oligonucleotide
  Target: ATXN1; (-) strand; PAM type: NRG; PAM sequence: AGG
cctagctacttgggagcctg

SEQ ID NO: 83854 - DNA, 20 bp, Artificial Sequence
  Description of Artificial Sequence: Synthetic oligonucleotide
  Target: ATXN1; (-) strand; PAM type: NRG; PAM sequence: GAG
tcctagctacttgggagcct

SEQ ID NO: 83855 - DNA, 20 bp, Artificial Sequence
  Description of Artificial Sequence: Synthetic oligonucleotide
  Target: ATXN1; (-) strand; PAM type: NRG; PAM sequence: GAG
ctatgatcctagctacttgg

SEQ ID NO: 83856 - DNA, 20 bp, Artificial Sequence
  Description of Artificial Sequence: Synthetic oligonucleotide
  Target: ATXN1; (-) strand; PAM type: NRG; PAM sequence: GGG
acctatgatcctagctactt

SEQ ID NO: 83857 - DNA, 20 bp, Artificial Sequence
  Description of Artificial Sequence: Synthetic oligonucleotide
  Target: ATXN1; (-) strand; PAM type: NRG; PAM sequence: TGG
cacctatgatcctagctact

SEQ ID NO: 83858 - DNA, 20 bp, Artificial Sequence
  Description of Artificial Sequence: Synthetic oligonucleotide
  Target: ATXN1; (-) strand; PAM type: NRG; PAM sequence: TAG
gtggtgggcacctatgatcc

SEQ ID NO: 83859 - DNA, 20 bp, Artificial Sequence
  Description of Artificial Sequence: Synthetic oligonucleotide
  Target: ATXN1; (-) strand; PAM type: NRG; PAM sequence: GGG
aattagctgggtgtggtggt

SEQ ID NO: 83860 - DNA, 20 bp, Artificial Sequence
  Description of Artificial Sequence: Synthetic oligonucleotide
  Target: ATXN1; (-) strand; PAM type: NRG; PAM sequence: TGG
aaattagctgggtgtggtgg

SEQ ID NO: 83861 - DNA, 20 bp, Artificial Sequence
  Description of Artificial Sequence: Synthetic oligonucleotide
  Target: ATXN1; (-) strand; PAM type: NRG; PAM sequence: TGG
caaaaattagctgggtgtgg

SEQ ID NO: 83862 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagctgggtg

SEQ ID NO: 83863 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaattagct

SEQ ID NO: 83864 - DNA, 20 bp, Artificial Sequence
  Description of Artificial Sequence: Synthetic oligonucleotide
  Target: ATXN1; (-) strand; PAM type: NRG; PAM sequence: TGG
ctaaaaatacaaaaattagc

SEQ ID NO: 83865 - DNA, 20 bp, Artificial Sequence
  Description of Artificial Sequence: Synthetic oligonucleotide
  Target: ATXN1; (-) strand; PAM type: NRG; PAM sequence: TAG
tccactaaaaatacaaaaat

SEQ ID NO: 83866 - DNA, 20 bp, Artificial Sequence
  Description of Artificial Sequence: Synthetic oligonucleotide
  Target: ATXN1; (-) strand; PAM type: NRG; PAM sequence: TGG
caagaccagcctggccaaca

SEQ ID NO: 83867 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcaagaccagcc

SEQ ID NO: 83868 - DNA, 20 bp, Artificial Sequence
  Description of Artificial Sequence: Synthetic oligonucleotide
  Target: ATXN1; (-) strand; PAM type: NRG; PAM sequence: CAG
cgaggtcaggagttcaagac

SEQ ID NO: 83869 - DNA, 20 bp, Artificial Sequence
  Description of Artificial Sequence: Synthetic oligonucleotide
  Target: ATXN1; (-) strand; PAM type: NRG; PAM sequence: AAG
aatcacgaggtcaggagttc

SEQ ID NO: 83870 - DNA, 20 bp, Artificial Sequence
  Description of Artificial Sequence: Synthetic oligonucleotide
  Target: ATXN1; (-) strand; PAM type: NRG; PAM sequence: GAG
cgggtgaatcacgaggtcag

SEQ ID NO: 83871 - DNA, 20 bp, Artificial Sequence
  Description of Artificial Sequence: Synthetic oligonucleotide
  Target: ATXN1; (-) strand; PAM type: NRG; PAM sequence: AGG
agcgggtgaatcacgaggtc

SEQ ID NO: 83872 - DNA, 20 bp, Artificial Sequence
  Description of Artificial Sequence: Synthetic oligonucleotide
  Target: ATXN1; (-) strand; PAM type: NRG; PAM sequence: CAG
aagcgggtgaatcacgaggt

SEQ ID NO: 83873 - DNA, 20 bp, Artificial Sequence
  Description of Artificial Sequence: Synthetic oligonucleotide
  Target: ATXN1; (-) strand; PAM type: NRG; PAM sequence: AGG
gtcaaagcgggtgaatcacg

SEQ ID NO: 83874 - DNA, 20 bp, Artificial Sequence
  Description of Artificial Sequence: Synthetic oligonucleotide
  Target: ATXN1; (-) strand; PAM type: NRG; PAM sequence: GAG
ggtcaaagcgggtgaatcac

SEQ ID NO: 83875 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggtcaaagc

SEQ ID NO: 83876 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaggtcaaag

SEQ ID NO: 83877 - DNA, 20 bp, Artificial Sequence
  Description of Artificial Sequence: Synthetic oligonucleotide
  Target: ATXN1; (-) strand; PAM type: NRG; PAM sequence: AAG
cccagcactttgggaggtca

SEQ ID NO: 83878 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 83879 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 83880 - DNA, 20 bp, Artificial Sequence
  Description of Artificial Sequence: Synthetic oligonucleotide
  Target: ATXN1; (-) strand; PAM type: NRG; PAM sequence: GGG
atctgtaatcccagcacttt

SEQ ID NO: 83881 - DNA, 20 bp, Artificial Sequence
  Description of Artificial Sequence: Synthetic oligonucleotide
  Target: ATXN1; (-) strand; PAM type: NRG; PAM sequence: TGG
catctgtaatcccagcactt

SEQ ID NO: 83882 - DNA, 20 bp, Artificial Sequence
  Description of Artificial Sequence: Synthetic oligonucleotide
  Target: ATXN1; (-) strand; PAM type: NRG; PAM sequence: CAG
gtggctcacatctgtaatcc

SEQ ID NO: 83883 - DNA, 20 bp, Artificial Sequence
  Description of Artificial Sequence: Synthetic oligonucleotide
  Target: ATXN1; (-) strand; PAM type: NRG; PAM sequence: TGG
ttttcctgggccaggtgcgg

SEQ ID NO: 83884 - DNA, 20 bp, Artificial Sequence
  Description of Artificial Sequence: Synthetic oligonucleotide
  Target: ATXN1; (-) strand; PAM type: NRG; PAM sequence: CGG
cccttttcctgggccaggtg

SEQ ID NO: 83885 - DNA, 20 bp, Artificial Sequence
  Description of Artificial Sequence: Synthetic oligonucleotide
  Target: ATXN1; (-) strand; PAM type: NRG; PAM sequence: AGG
caatacccttttcctgggcc

SEQ ID NO: 83886 - DNA, 20 bp, Artificial Sequence
  Description of Artificial Sequence: Synthetic oligonucleotide
  Target: ATXN1; (-) strand; PAM type: NRG; PAM sequence: CAG
acaatacccttttcctgggc

SEQ ID NO: 83887 - DNA, 20 bp, Artificial Sequence
  Description of Artificial Sequence: Synthetic oligonucleotide
  Target: ATXN1; (-) strand; PAM type: NRG; PAM sequence: GGG
gattacaatacccttttcct

SEQ ID NO: 83888 - DNA, 20 bp, Artificial Sequence
  Description of Artificial Sequence: Synthetic oligonucleotide
  Target: ATXN1; (-) strand; PAM type: NRG; PAM sequence: TGG
tgattacaatacccttttcc

SEQ ID NO: 83889 - DNA, 20 bp, Artificial Sequence
  Description of Artificial Sequence: Synthetic oligonucleotide
  Target: ATXN1; (-) strand; PAM type: NRG; PAM sequence: CAG
aaacgaagagccaggtttcc

SEQ ID NO: 83890 - DNA, 20 bp, Artificial Sequence
  Description of Artificial Sequence: Synthetic oligonucleotide
  Target: ATXN1; (-) strand; PAM type: NRG; PAM sequence: AGG
ctctttcgaaacgaagagcc

SEQ ID NO: 83891 - DNA, 20 bp, Artificial Sequence
  Description of Artificial Sequence: Synthetic oligonucleotide
  Target: ATXN1; (-) strand; PAM type: NRG; PAM sequence: CAG
tctctttcgaaacgaagagc

SEQ ID NO: 83892 - DNA, 20 bp, Artificial Sequence
  Description of Artificial Sequence: Synthetic oligonucleotide
  Target: ATXN1; (-) strand; PAM type: NRG; PAM sequence: GAG
gcaatctctttcgaaacgaa

SEQ ID NO: 83893 - DNA, 20 bp, Artificial Sequence
  Description of Artificial Sequence: Synthetic oligonucleotide
  Target: ATXN1; (-) strand; PAM type: NRG; PAM sequence: AAG
tagcaatctctttcgaaacg

SEQ ID NO: 83894 - DNA, 20 bp, Artificial Sequence
  Description of Artificial Sequence: Synthetic oligonucleotide
  Target: ATXN1; (-) strand; PAM type: NRG; PAM sequence: TAG
attttccatatggtgtaaga

SEQ ID NO: 83895 - DNA, 20 bp, Artificial Sequence
  Description of Artificial Sequence: Synthetic oligonucleotide
  Target: ATXN1; (-) strand; PAM type: NRG; PAM sequence: AAG
atttattttccatatggtgt

SEQ ID NO: 83896 - DNA, 20 bp, Artificial Sequence
  Description of Artificial Sequence: Synthetic oligonucleotide
  Target: ATXN1; (-) strand; PAM type: NRG; PAM sequence: TGG
tctagaatttattttccata

SEQ ID NO: 83897 - DNA, 20 bp, Artificial Sequence
  Description of Artificial Sequence: Synthetic oligonucleotide
  Target: ATXN1; (-) strand; PAM type: NRG; PAM sequence: TAG
tatatgtttagttatatatc

SEQ ID NO: 83898 - DNA, 20 bp, Artificial Sequence
  Description of Artificial Sequence: Synthetic oligonucleotide
  Target: ATXN1; (-) strand; PAM type: NRG; PAM sequence: TAG
taaacacatgtttatatgtt

SEQ ID NO: 83899 - DNA, 20 bp, Artificial Sequence
  Description of Artificial Sequence: Synthetic oligonucleotide
  Target: ATXN1; (-) strand; PAM type: NRG; PAM sequence: AGG
tatctttacaatggcctaca

SEQ ID NO: 83900 - DNA, 20 bp, Artificial Sequence
  Description of Artificial Sequence: Synthetic oligonucleotide
  Target: ATXN1; (-) strand; PAM type: NRG; PAM sequence: AAG
gtatctttacaatggcctac

SEQ ID NO: 83901 - DNA, 20 bp, Artificial Sequence
  Description of Artificial Sequence: Synthetic oligonucleotide
  Target: ATXN1; (-) strand; PAM type: NRG; PAM sequence: TGG
aaaagtcggtatctttacaa

SEQ ID NO: 83902 - DNA, 20 bp, Artificial Sequence
  Description of Artificial Sequence: Synthetic oligonucleotide
  Target: ATXN1; (-) strand; PAM type: NRG; PAM sequence: CGG
ttcccattttacttaaaagt

SEQ ID NO: 83903 - DNA, 20 bp, Artificial Sequence
  Description of Artificial Sequence: Synthetic oligonucleotide
  Target: ATXN1; (-) strand; PAM type: NRG; PAM sequence: AAG
ggtcttcccattttacttaa

SEQ ID NO: 83904 - DNA, 20 bp, Artificial Sequence
  Description of Artificial Sequence: Synthetic oligonucleotide
  Target: ATXN1; (-) strand; PAM type: NRG; PAM sequence: TGG
actgcattaaaaattatctc

SEQ ID NO: 83905 - DNA, 20 bp, Artificial Sequence
  Description of Artificial Sequence: Synthetic oligonucleotide
  Target: ATXN1; (-) strand; PAM type: NRG; PAM sequence: CAG
tgagcccttaaaatgtaagg

SEQ ID NO: 83906 - DNA, 20 bp, Artificial Sequence
  Description of Artificial Sequence: Synthetic oligonucleotide
  Target: ATXN1; (-) strand; PAM type: NRG; PAM sequence: AGG
aaatgagcccttaaaatgta

SEQ ID NO: 83907 - DNA, 20 bp, Artificial Sequence
  Description of Artificial Sequence: Synthetic oligonucleotide
  Target: ATXN1; (-) strand; PAM type: NRG; PAM sequence: AAG
caaatgagcccttaaaatgt

SEQ ID NO: 83908 - DNA, 20 bp, Artificial Sequence
  Description of Artificial Sequence: Synthetic oligonucleotide
  Target: ATXN1; (-) strand; PAM type: NRG; PAM sequence: GAG
tcctgacaatcagaccaaat

SEQ ID NO: 83909 - DNA, 20 bp, Artificial Sequence
  Description of Artificial Sequence: Synthetic oligonucleotide
  Target: ATXN1; (-) strand; PAM type: NRG; PAM sequence: CAG
tatggtctattcctgacaat

SEQ ID NO: 83910 - DNA, 20 bp, Artificial Sequence
  Description of Artificial Sequence: Synthetic oligonucleotide
  Target: ATXN1; (-) strand; PAM type: NRG; PAM sequence: TGG
ctttaatttatatcccctta

SEQ ID NO: 83911 - DNA, 20 bp, Artificial Sequence
  Description of Artificial Sequence: Synthetic oligonucleotide
  Target: ATXN1; (-) strand; PAM type: NRG; PAM sequence: CAG
atcctgcaggctgcttataa

SEQ ID NO: 83912 - DNA, 20 bp, Artificial Sequence
  Description of Artificial Sequence: Synthetic oligonucleotide
  Target: ATXN1; (-) strand; PAM type: NRG; PAM sequence: AGG
atcactggaagccatcctgc

SEQ ID NO: 83913 - DNA, 20 bp, Artificial Sequence
  Description of Artificial Sequence: Synthetic oligonucleotide
  Target: ATXN1; (-) strand; PAM type: NRG; PAM sequence: CAG
gatcactggaagccatcctg

SEQ ID NO: 83914 - DNA, 20 bp, Artificial Sequence
  Description of Artificial Sequence: Synthetic oligonucleotide
  Target: ATXN1; (-) strand; PAM type: NRG; PAM sequence: AAG
ccaagaggtgggatcactgg

SEQ ID NO: 83915 - DNA, 20 bp, Artificial Sequence
  Description of Artificial Sequence: Synthetic oligonucleotide
  Target: ATXN1; (-) strand; PAM type: NRG; PAM sequence: TGG
attccaagaggtgggatcac

SEQ ID NO: 83916 - DNA, 20 bp, Artificial Sequence
  Description of Artificial Sequence: Synthetic oligonucleotide
  Target: ATXN1; (-) strand; PAM type: NRG; PAM sequence: GGG
gggcatgaattccaagaggt

SEQ ID NO: 83917 - DNA, 20 bp, Artificial Sequence
  Description of Artificial Sequence: Synthetic oligonucleotide
  Target: ATXN1; (-) strand; PAM type: NRG; PAM sequence: TGG
agggcatgaattccaagagg

SEQ ID NO: 83918 - DNA, 20 bp, Artificial Sequence
  Description of Artificial Sequence: Synthetic oligonucleotide
  Target: ATXN1; (-) strand; PAM type: NRG; PAM sequence: AGG
acaagggcatgaattccaag

SEQ ID NO: 83919 - DNA, 20 bp, Artificial Sequence
  Description of Artificial Sequence: Synthetic oligonucleotide
  Target: ATXN1; (-) strand; PAM type: NRG; PAM sequence: GAG
tacaagggcatgaattccaa

SEQ ID NO: 83920 - DNA, 20 bp, Artificial Sequence
  Description of Artificial Sequence: Synthetic oligonucleotide
  Target: ATXN1; (-) strand; PAM type: NRG; PAM sequence: AAG
tttacaagggcatgaattcc

SEQ ID NO: 83921 - DNA, 20 bp, Artificial Sequence
  Description of Artificial Sequence: Synthetic oligonucleotide
  Target: ATXN1; (-) strand; PAM type: NRG; PAM sequence: GGG
cactcaagaaggctttacaa

SEQ ID NO: 83922 - DNA, 20 bp, Artificial Sequence
  Description of Artificial Sequence: Synthetic oligonucleotide
  Target: ATXN1; (-) strand; PAM type: NRG; PAM sequence: AGG
acactcaagaaggctttaca

SEQ ID NO: 83923 - DNA, 20 bp, Artificial Sequence
  Description of Artificial Sequence: Synthetic oligonucleotide
  Target: ATXN1; (-) strand; PAM type: NRG; PAM sequence: AAG
cacactcaagaaggctttac

SEQ ID NO: 83924 - DNA, 20 bp, Artificial Sequence
  Description of Artificial Sequence: Synthetic oligonucleotide
  Target: ATXN1; (-) strand; PAM type: NRG; PAM sequence: AGG
aatccagtccacactcaaga

SEQ ID NO: 83925 - DNA, 20 bp, Artificial Sequence
  Description of Artificial Sequence: Synthetic oligonucleotide
  Target: ATXN1; (-) strand; PAM type: NRG; PAM sequence: AAG
aaatccagtccacactcaag

SEQ ID NO: 83926 - DNA, 20 bp, Artificial Sequence
  Description of Artificial Sequence: Synthetic oligonucleotide
  Target: ATXN1; (-) strand; PAM type: NRG; PAM sequence: AAG
actaaatccagtccacactc

SEQ ID NO: 83927 - DNA, 20 bp, Artificial Sequence
  Description of Artificial Sequence: Synthetic oligonucleotide
  Target: ATXN1; (-) strand; PAM type: NRG; PAM sequence: CAG
tagaattgagtcactaaatc

SEQ ID NO: 83928 - DNA, 20 bp, Artificial Sequence
  Description of Artificial Sequence: Synthetic oligonucleotide
  Target: ATXN1; (-) strand; PAM type: NRG; PAM sequence: GAG
acagtctgtttgctagaatt

SEQ ID NO: 83929 - DNA, 20 bp, Artificial Sequence
  Description of Artificial Sequence: Synthetic oligonucleotide
  Target: ATXN1; (-) strand; PAM type: NRG; PAM sequence: TAG
ctttgccacagtctgtttgc

SEQ ID NO: 83930 - DNA, 20 bp, Artificial Sequence
  Description of Artificial Sequence: Synthetic oligonucleotide
  Target: ATXN1; (-) strand; PAM type: NRG; PAM sequence: CAG
atctcccattacctttgcca

SEQ ID NO: 83931 - DNA, 20 bp, Artificial Sequence
  Description of Artificial Sequence: Synthetic oligonucleotide
  Target: ATXN1; (-) strand; PAM type: NRG; PAM sequence: TGG
atcttcatgtaacccagtct

SEQ ID NO: 83932 - DNA, 20 bp, Artificial Sequence
  Description of Artificial Sequence: Synthetic oligonucleotide
  Target: ATXN1; (-) strand; PAM type: NRG; PAM sequence: CAG
gccaccatcttcatgtaacc

SEQ ID NO: 83933 - DNA, 20 bp, Artificial Sequence
  Description of Artificial Sequence: Synthetic oligonucleotide
  Target: ATXN1; (-) strand; PAM type: NRG; PAM sequence: AAG
gatgcaagatcccaagatgg

SEQ ID NO: 83934 - DNA, 20 bp, Artificial Sequence
  Description of Artificial Sequence: Synthetic oligonucleotide
  Target: ATXN1; (-) strand; PAM type: NRG; PAM sequence: TGG
gaggatgcaagatcccaaga

SEQ ID NO: 83935 - DNA, 20 bp, Artificial Sequence
  Description of Artificial Sequence: Synthetic oligonucleotide
  Target: ATXN1; (-) strand; PAM type: NRG; PAM sequence: AAG
agaagaggatgcaagatccc

SEQ ID NO: 83936 - DNA, 20 bp, Artificial Sequence
  Description of Artificial Sequence: Synthetic oligonucleotide
  Target: ATXN1; (-) strand; PAM type: NRG; PAM sequence: AAG
agtaacccagaagaggatgc

SEQ ID NO: 83937 - DNA, 20 bp, Artificial Sequence
  Description of Artificial Sequence: Synthetic oligonucleotide
  Target: ATXN1; (-) strand; PAM type: NRG; PAM sequence: AGG
ccaggtgagtaacccagaag

SEQ ID NO: 83938 - DNA, 20 bp, Artificial Sequence
  Description of Artificial Sequence: Synthetic oligonucleotide
  Target: ATXN1; (-) strand; PAM type: NRG; PAM sequence: GAG
cccaggtgagtaacccagaa

SEQ ID NO: 83939 - DNA, 20 bp, Artificial Sequence
  Description of Artificial Sequence: Synthetic oligonucleotide
  Target: ATXN1; (-) strand; PAM type: NRG; PAM sequence: AAG
cccccaggtgagtaacccag

SEQ ID NO: 83940 - DNA, 20 bp, Artificial Sequence
  Description of Artificial Sequence: Synthetic oligonucleotide
  Target: ATXN1; (-) strand; PAM type: NRG; PAM sequence: CAG
cctcccccaggtgagtaacc

SEQ ID NO: 83941 - DNA, 20 bp, Artificial Sequence
  Description of Artificial Sequence: Synthetic oligonucleotide
  Target: ATXN1; (-) strand; PAM type: NRG; PAM sequence: GAG
gcagtcagcctcccccaggt

SEQ ID NO: 83942 - DNA, 20 bp, Artificial Sequence
  Description of Artificial Sequence: Synthetic oligonucleotide
  Target: ATXN1; (-) strand; PAM type: NRG; PAM sequence: AGG
cctggcagtcagcctccccc

SEQ ID NO: 83943 - DNA, 20 bp, Artificial Sequence
  Description of Artificial Sequence: Synthetic oligonucleotide
  Target: ATXN1; (-) strand; PAM type: NRG; PAM sequence: CAG
gcctggcagtcagcctcccc

SEQ ID NO: 83944 - DNA, 20 bp, Artificial Sequence
  Description of Artificial Sequence: Synthetic oligonucleotide
  Target: ATXN1; (-) strand; PAM type: NRG; PAM sequence: CAG
ctgcatcacagcctggcagt

SEQ ID NO: 83945 - DNA, 20 bp, Artificial Sequence
  Description of Artificial Sequence: Synthetic oligonucleotide
  Target: ATXN1; (-) strand; PAM type: NRG; PAM sequence: CAG
aggactgcatcacagcctgg

SEQ ID NO: 83946 - DNA, 20 bp, Artificial Sequence
  Description of Artificial Sequence: Synthetic oligonucleotide
  Target: ATXN1; (-) strand; PAM type: NRG; PAM sequence: TGG
cacaggactgcatcacagcc

SEQ ID NO: 83947 - DNA, 20 bp, Artificial Sequence
  Description of Artificial Sequence: Synthetic oligonucleotide
  Target: ATXN1; (-) strand; PAM type: NRG; PAM sequence: CAG
ccttccacaggactgcatca

SEQ ID NO: 83948 - DNA, 20 bp, Artificial Sequence
  Description of Artificial Sequence: Synthetic oligonucleotide
  Target: ATXN1; (-) strand; PAM type: NRG; PAM sequence: AGG
tgccatgtgggcccttccac

SEQ ID NO: 83949 - DNA, 20 bp, Artificial Sequence
  Description of Artificial Sequence: Synthetic oligonucleotide
  Target: ATXN1; (-) strand; PAM type: NRG; PAM sequence: CAG
atgccatgtgggcccttcca

SEQ ID NO: 83950 - DNA, 20 bp, Artificial Sequence
  Description of Artificial Sequence: Synthetic oligonucleotide
  Target: ATXN1; (-) strand; PAM type: NRG; PAM sequence: GGG
gcctcagtgatatgccatgt

SEQ ID NO: 83951 - DNA, 20 bp, Artificial Sequence
  Description of Artificial Sequence: Synthetic oligonucleotide
  Target: ATXN1; (-) strand; PAM type: NRG; PAM sequence: TGG
ggcctcagtgatatgccatg

SEQ ID NO: 83952 - DNA, 20 bp, Artificial Sequence
  Description of Artificial Sequence: Synthetic oligonucleotide
  Target: ATXN1; (-) strand; PAM type: NRG; PAM sequence: CAG
acatagatgctagcaggcct

SEQ ID NO: 83953 - DNA, 20 bp, Artificial Sequence
  Description of Artificial Sequence: Synthetic oligonucleotide
  Target: ATXN1; (-) strand; PAM type: NRG; PAM sequence: AGG
ccactcacatagatgctagc

SEQ ID NO: 83954 - DNA, 20 bp, Artificial Sequence
  Description of Artificial Sequence: Synthetic oligonucleotide
  Target: ATXN1; (-) strand; PAM type: NRG; PAM sequence: CAG
tccactcacatagatgctag

SEQ ID NO: 83955 - DNA, 20 bp, Artificial Sequence
  Description of Artificial Sequence: Synthetic oligonucleotide
  Target: ATXN1; (-) strand; PAM type: NRG; PAM sequence: TAG
aaatccactcacatagatgc

SEQ ID NO: 83956 - DNA, 20 bp, Artificial Sequence
  Description of Artificial Sequence: Synthetic oligonucleotide
  Target: ATXN1; (-) strand; PAM type: NRG; PAM sequence: TAG
tgcttccaaatccactcaca

SEQ ID NO: 83957 - DNA, 20 bp, Artificial Sequence
  Description of Artificial Sequence: Synthetic oligonucleotide
  Target: ATXN1; (-) strand; PAM type: NRG; PAM sequence: GGG
aggatagggtgggggcggta

SEQ ID NO: 83958 - DNA, 20 bp, Artificial Sequence
  Description of Artificial Sequence: Synthetic oligonucleotide
  Target: ATXN1; (-) strand; PAM type: NRG; PAM sequence: AGG
aaggatagggtgggggcggt

SEQ ID NO: 83959 - DNA, 20 bp, Artificial Sequence
  Description of Artificial Sequence: Synthetic oligonucleotide
  Target: ATXN1; (-) strand; PAM type: NRG; PAM sequence: TAG
gaaggatagggtgggggcgg

SEQ ID NO: 83960 - DNA, 20 bp, Artificial Sequence
  Description of Artificial Sequence: Synthetic oligonucleotide
  Target: ATXN1; (-) strand; PAM type: NRG; PAM sequence: CGG
tctgaaggatagggtggggg

SEQ ID NO: 83961 - DNA, 20 bp, Artificial Sequence
  Description of Artificial Sequence: Synthetic oligonucleotide
  Target: ATXN1; (-) strand; PAM type: NRG; PAM sequence: GGG
tcatctgaaggatagggtgg

SEQ ID NO: 83962 - DNA, 20 bp, Artificial Sequence
  Description of Artificial Sequence: Synthetic oligonucleotide
  Target: ATXN1; (-) strand; PAM type: NRG; PAM sequence: GGG
ttcatctgaaggatagggtg

SEQ ID NO: 83963 - DNA, 20 bp, Artificial Sequence
  Description of Artificial Sequence: Synthetic oligonucleotide
  Target: ATXN1; (-) strand; PAM type: NRG; PAM sequence: GGG
tttcatctgaaggatagggt

SEQ ID NO: 83964 - DNA, 20 bp, Artificial Sequence
  Description of Artificial Sequence: Synthetic oligonucleotide
  Target: ATXN1; (-) strand; PAM type: NRG; PAM sequence: TGG
gtttcatctgaaggataggg

SEQ ID NO: 83965 - DNA, 20 bp, Artificial Sequence
  Description of Artificial Sequence: Synthetic oligonucleotide
  Target: ATXN1; (-) strand; PAM type: NRG; PAM sequence: GGG
gacgtttcatctgaaggata

SEQ ID NO: 83966 - DNA, 20 bp, Artificial Sequence
  Description of Artificial Sequence: Synthetic oligonucleotide
  Target: ATXN1; (-) strand; PAM type: NRG; PAM sequence: AGG
tgacgtttcatctgaaggat

SEQ ID NO: 83967 - DNA, 20 bp, Artificial Sequence
  Description of Artificial Sequence: Synthetic oligonucleotide
  Target: ATXN1; (-) strand; PAM type: NRG; PAM sequence: TAG
ctgacgtttcatctgaagga

SEQ ID NO: 83968 - DNA, 20 bp, Artificial Sequence
  Description of Artificial Sequence: Synthetic oligonucleotide
  Target: ATXN1; (-) strand; PAM type: NRG; PAM sequence: AGG
tgggctgacgtttcatctga

SEQ ID NO: 83969 - DNA, 20 bp, Artificial Sequence
  Description of Artificial Sequence: Synthetic oligonucleotide
  Target: ATXN1; (-) strand; PAM type: NRG; PAM sequence: AAG
ctgggctgacgtttcatctg

SEQ ID NO: 83970 - DNA, 20 bp, Artificial Sequence
  Description of Artificial Sequence: Synthetic oligonucleotide
  Target: ATXN1; (-) strand; PAM type: NRG; PAM sequence: GGG
tgtagtcaagttgttaacct

SEQ ID NO: 83971 - DNA, 20 bp, Artificial Sequence
  Description of Artificial Sequence: Synthetic oligonucleotide
  Target: ATXN1; (-) strand; PAM type: NRG; PAM sequence: TGG
ttgtagtcaagttgttaacc

SEQ ID NO: 83972 - DNA, 20 bp, Artificial Sequence
  Description of Artificial Sequence: Synthetic oligonucleotide
  Target: ATXN1; (-) strand; PAM type: NRG; PAM sequence: AAG
tctttcatgaggttgtagtc

SEQ ID NO: 83973 - DNA, 20 bp, Artificial Sequence
  Description of Artificial Sequence: Synthetic oligonucleotide
  Target: ATXN1; (-) strand; PAM type: NRG; PAM sequence: TAG
ccaagtctttcatgaggttg

SEQ ID NO: 83974 - DNA, 20 bp, Artificial Sequence
  Description of Artificial Sequence: Synthetic oligonucleotide
  Target: ATXN1; (-) strand; PAM type: NRG; PAM sequence: AGG
ctagctccaagtctttcatg

SEQ ID NO: 83975 - DNA, 20 bp, Artificial Sequence
  Description of Artificial Sequence: Synthetic oligonucleotide
  Target: ATXN1; (-) strand; PAM type: NRG; PAM sequence: GAG
tctagctccaagtctttcat

SEQ ID NO: 83976 - DNA, 20 bp, Artificial Sequence
  Description of Artificial Sequence: Synthetic oligonucleotide
  Target: ATXN1; (-) strand; PAM type: NRG; PAM sequence: AAG
agctgggtgtctctagctcc

SEQ ID NO: 83977 - DNA, 20 bp, Artificial Sequence
  Description of Artificial Sequence: Synthetic oligonucleotide
  Target: ATXN1; (-) strand; PAM type: NRG; PAM sequence: TAG
atatcatagctgggtgtctc

SEQ ID NO: 83978 - DNA, 20 bp, Artificial Sequence
  Description of Artificial Sequence: Synthetic oligonucleotide
  Target: ATXN1; (-) strand; PAM type: NRG; PAM sequence: GGG
aatcactgcatatcatagct

SEQ ID NO: 83979 - DNA, 20 bp, Artificial Sequence
  Description of Artificial Sequence: Synthetic oligonucleotide
  Target: ATXN1; (-) strand; PAM type: NRG; PAM sequence: TGG
gaatcactgcatatcatagc

SEQ ID NO: 83980 - DNA, 20 bp, Artificial Sequence
  Description of Artificial Sequence: Synthetic oligonucleotide
  Target: ATXN1; (-) strand; PAM type: NRG; PAM sequence: TAG
gtgtgaatcactgcatatca

SEQ ID NO: 83981 - DNA, 20 bp, Artificial Sequence
  Description of Artificial Sequence: Synthetic oligonucleotide
  Target: ATXN1; (-) strand; PAM type: NRG; PAM sequence: AAG
tattatctctcagtttttct

SEQ ID NO: 83982 - DNA, 20 bp, Artificial Sequence
  Description of Artificial Sequence: Synthetic oligonucleotide
  Target: ATXN1; (-) strand; PAM type: NRG; PAM sequence: CAG
aacaagtgtttattatctct

SEQ ID NO: 83983 - DNA, 20 bp, Artificial Sequence
  Description of Artificial Sequence: Synthetic oligonucleotide
  Target: ATXN1; (-) strand; PAM type: NRG; PAM sequence: AAG
tcttagtggcttaaaacaac

SEQ ID NO: 83984 - DNA, 20 bp, Artificial Sequence
  Description of Artificial Sequence: Synthetic oligonucleotide
  Target: ATXN1; (-) strand; PAM type: NRG; PAM sequence: TGG
gtaattactccaaatcttag

SEQ ID NO: 83985 - DNA, 20 bp, Artificial Sequence
  Description of Artificial Sequence: Synthetic oligonucleotide
  Target: ATXN1; (-) strand; PAM type: NRG; PAM sequence: TAG
taagtaattactccaaatct

SEQ ID NO: 83986 - DNA, 20 bp, Artificial Sequence
  Description of Artificial Sequence: Synthetic oligonucleotide
  Target: ATXN1; (-) strand; PAM type: NRG; PAM sequence: AAG
gtagttatctactgctgtgt

SEQ ID NO: 83987 - DNA, 20 bp, Artificial Sequence
  Description of Artificial Sequence: Synthetic oligonucleotide
  Target: ATXN1; (-) strand; PAM type: NRG; PAM sequence: TAG
ttcatacattgtaactgtag

SEQ ID NO: 83988 - DNA, 20 bp, Artificial Sequence
  Description of Artificial Sequence: Synthetic oligonucleotide
  Target: ATXN1; (-) strand; PAM type: NRG; PAM sequence: TAG
tgtttcatacattgtaactg

SEQ ID NO: 83989 - DNA, 20 bp, Artificial Sequence
  Description of Artificial Sequence: Synthetic oligonucleotide
  Target: ATXN1; (-) strand; PAM type: NRG; PAM sequence: GAG
gtcatgtaaagttcccagaa

SEQ ID NO: 83990 - DNA, 20 bp, Artificial Sequence
  Description of Artificial Sequence: Synthetic oligonucleotide
  Target: ATXN1; (-) strand; PAM type: NRG; PAM sequence: AAG
aagtcatgtaaagttcccag

SEQ ID NO: 83991 - DNA, 20 bp, Artificial Sequence
  Description of Artificial Sequence: Synthetic oligonucleotide
  Target: ATXN1; (-) strand; PAM type: NRG; PAM sequence: CAG
aaaaagtcatgtaaagttcc

SEQ ID NO: 83992 - DNA, 20 bp, Artificial Sequence
  Description of Artificial Sequence: Synthetic oligonucleotide
  Target: ATXN1; (-) strand; PAM type: NRG; PAM sequence: AAG
ccactgtaaaaagtcatgta

SEQ ID NO: 83993 - DNA, 20 bp, Artificial Sequence
  Description of Artificial Sequence: Synthetic oligonucleotide
  Target: ATXN1; (-) strand; PAM type: NRG; PAM sequence: AAG
tcagtttctcccactgtaaa

SEQ ID NO: 83994 - DNA, 20 bp, Artificial Sequence
  Description of Artificial Sequence: Synthetic oligonucleotide
  Target: ATXN1; (-) strand; PAM type: NRG; PAM sequence: CAG
gatttaacttctttggggct

SEQ ID NO: 83995 - DNA, 20 bp, Artificial Sequence
  Description of Artificial Sequence: Synthetic oligonucleotide
  Target: ATXN1; (-) strand; PAM type: NRG; PAM sequence: GGG
caggtgatttaacttctttg

SEQ ID NO: 83996 - DNA, 20 bp, Artificial Sequence
  Description of Artificial Sequence: Synthetic oligonucleotide
  Target: ATXN1; (-) strand; PAM type: NRG; PAM sequence: GGG
acaggtgatttaacttcttt

SEQ ID NO: 83997 - DNA, 20 bp, Artificial Sequence
  Description of Artificial Sequence: Synthetic oligonucleotide
  Target: ATXN1; (-) strand; PAM type: NRG; PAM sequence: TGG
aacaggtgatttaacttctt

SEQ ID NO: 83998 - DNA, 20 bp, Artificial Sequence
  Description of Artificial Sequence: Synthetic oligonucleotide
  Target: ATXN1; (-) strand; PAM type: NRG; PAM sequence: AGG
atgtatgtgtgctgttgaac

SEQ ID NO: 83999 - DNA, 20 bp, Artificial Sequence
  Description of Artificial Sequence: Synthetic oligonucleotide
  Target: ATXN1; (-) strand; PAM type: NRG; PAM sequence: CAG
catgtatgtgtgctgttgaa

SEQ ID NO: 84000 - DNA, 20 bp, Artificial Sequence
  Description of Artificial Sequence: Synthetic oligonucleotide
  Target: ATXN1; (-) strand; PAM type: NRG; PAM sequence: GAG
gagtcagatggcctgagttt

SEQ ID NO: 84001 - DNA, 20 bp, Artificial Sequence
  Description of Artificial Sequence: Synthetic oligonucleotide
  Target: ATXN1; (-) strand; PAM type: NRG; PAM sequence: GAG
tttctggagtcagatggcct

SEQ ID NO: 84002 - DNA, 20 bp, Artificial Sequence
  Description of Artificial Sequence: Synthetic oligonucleotide
  Target: ATXN1; (-) strand; PAM type: NRG; PAM sequence: TGG
acctggtttctggagtcaga

SEQ ID NO: 84003 - DNA, 20 bp, Artificial Sequence
  Description of Artificial Sequence: Synthetic oligonucleotide
  Target: ATXN1; (-) strand; PAM type: NRG; PAM sequence: CAG
aagaacctggtttctggagt

SEQ ID NO: 84004 - DNA, 20 bp, Artificial Sequence
  Description of Artificial Sequence: Synthetic oligonucleotide
  Target: ATXN1; (-) strand; PAM type: NRG; PAM sequence: GAG
gattaagaacctggtttctg

SEQ ID NO: 84005 - DNA, 20 bp, Artificial Sequence
  Description of Artificial Sequence: Synthetic oligonucleotide
  Target: ATXN1; (-) strand; PAM type: NRG; PAM sequence: TGG
gggattaagaacctggtttc

SEQ ID NO: 84006 - DNA, 20 bp, Artificial Sequence
  Description of Artificial Sequence: Synthetic oligonucleotide
  Target: ATXN1; (-) strand; PAM type: NRG; PAM sequence: TGG
tgatgcagggattaagaacc

SEQ ID NO: 84007 - DNA, 20 bp, Artificial Sequence
  Description of Artificial Sequence: Synthetic oligonucleotide
  Target: ATXN1; (-) strand; PAM type: NRG; PAM sequence: AAG
ggtagtgtgatgcagggatt

SEQ ID NO: 84008 - DNA, 20 bp, Artificial Sequence
  Description of Artificial Sequence: Synthetic oligonucleotide
  Target: ATXN1; (-) strand; PAM type: NRG; PAM sequence: GGG
taaaggggtagtgtgatgca

SEQ ID NO: 84009 - DNA, 20 bp, Artificial Sequence
  Description of Artificial Sequence: Synthetic oligonucleotide
  Target: ATXN1; (-) strand; PAM type: NRG; PAM sequence: AGG
ttaaaggggtagtgtgatgc

SEQ ID NO: 84010 - DNA, 20 bp, Artificial Sequence
  Description of Artificial Sequence: Synthetic oligonucleotide
  Target: ATXN1; (-) strand; PAM type: NRG; PAM sequence: CAG
cttaaaggggtagtgtgatg

SEQ ID NO: 84011 - DNA, 20 bp, Artificial Sequence
  Description of Artificial Sequence: Synthetic oligonucleotide
  Target: ATXN1; (-) strand; PAM type: NRG; PAM sequence: TAG
aaaaatggttcttaaagggg

SEQ ID NO: 84012 - DNA, 20 bp, Artificial Sequence
  Description of Artificial Sequence: Synthetic oligonucleotide
  Target: ATXN1; (-) strand; PAM type: NRG; PAM sequence: GGG
aggaaaaatggttcttaaag

SEQ ID NO: 84013 - DNA, 20 bp, Artificial Sequence
  Description of Artificial Sequence: Synthetic oligonucleotide
  Target: ATXN1; (-) strand; PAM type: NRG; PAM sequence: GGG
taggaaaaatggttcttaaa

SEQ ID NO: 84014 - DNA, 20 bp, Artificial Sequence
  Description of Artificial Sequence: Synthetic oligonucleotide
  Target: ATXN1; (-) strand; PAM type: NRG; PAM sequence: AGG
gtaggaaaaatggttcttaa

SEQ ID NO: 84015 - DNA, 20 bp, Artificial Sequence
  Description of Artificial Sequence: Synthetic oligonucleotide
  Target: ATXN1; (-) strand; PAM type: NRG; PAM sequence: AAG
agtaggaaaaatggttctta

SEQ ID NO: 84016 - DNA, 20 bp, Artificial Sequence
  Description of Artificial Sequence: Synthetic oligonucleotide
  Target: ATXN1; (-) strand; PAM type: NRG; PAM sequence: TGG
cacacctaaagtaggaaaaa

SEQ ID NO: 84017 - DNA, 20 bp, Artificial Sequence
  Description of Artificial Sequence: Synthetic oligonucleotide
  Target: ATXN1; (-) strand; PAM type: NRG; PAM sequence: AGG
caggcatgcacacctaaagt

SEQ ID NO: 84018 - DNA, 20 bp, Artificial Sequence
  Description of Artificial Sequence: Synthetic oligonucleotide
  Target: ATXN1; (-) strand; PAM type: NRG; PAM sequence: TAG
tcaggcatgcacacctaaag

SEQ ID NO: 84019 - DNA, 20 bp, Artificial Sequence
  Description of Artificial Sequence: Synthetic oligonucleotide
  Target: ATXN1; (-) strand; PAM type: NRG; PAM sequence: AAG
atttcaggcatgcacaccta

SEQ ID NO: 84020 - DNA, 20 bp, Artificial Sequence
  Description of Artificial Sequence: Synthetic oligonucleotide
  Target: ATXN1; (-) strand; PAM type: NRG; PAM sequence: AGG
acagtggaaagtcaaatttc

SEQ ID NO: 84021 - DNA, 20 bp, Artificial Sequence
  Description of Artificial Sequence: Synthetic oligonucleotide
  Target: ATXN1; (-) strand; PAM type: NRG; PAM sequence: CAG
tacagtggaaagtcaaattt

SEQ ID NO: 84022 - DNA, 20 bp, Artificial Sequence
  Description of Artificial Sequence: Synthetic oligonucleotide
  Target: ATXN1; (-) strand; PAM type: NRG; PAM sequence: AAG
ttagcatattctacagtgga

SEQ ID NO: 84023 - DNA, 20 bp, Artificial Sequence
  Description of Artificial Sequence: Synthetic oligonucleotide
  Target: ATXN1; (-) strand; PAM type: NRG; PAM sequence: TGG
gattttagcatattctacag

SEQ ID NO: 84024 - DNA, 20 bp, Artificial Sequence
  Description of Artificial Sequence: Synthetic oligonucleotide
  Target: ATXN1; (-) strand; PAM type: NRG; PAM sequence: CAG
tgtgattttagcatattcta

SEQ ID NO: 84025 - DNA, 20 bp, Artificial Sequence
  Description of Artificial Sequence: Synthetic oligonucleotide
  Target: ATXN1; (-) strand; PAM type: NRG; PAM sequence: TAG
ttgtgcaaattgtgtgattt

SEQ ID NO: 84026 - DNA, 20 bp, Artificial Sequence
  Description of Artificial Sequence: Synthetic oligonucleotide
  Target: ATXN1; (-) strand; PAM type: NRG; PAM sequence: CAG
aaagaagtttgatgaagatg

SEQ ID NO: 84027 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaagaagtttgatg

SEQ ID NO: 84028 - DNA, 20 bp, Artificial Sequence
  Description of Artificial Sequence: Synthetic oligonucleotide
  Target: ATXN1; (-) strand; PAM type: NRG; PAM sequence: AAG
atttcaaaaaaaaaaaaaag

SEQ ID NO: 84029 - DNA, 20 bp, Artificial Sequence
  Description of Artificial Sequence: Synthetic oligonucleotide
  Target: ATXN1; (-) strand; PAM type: NRG; PAM sequence: AAG
tctatttcaaaaaaaaaaaa

SEQ ID NO: 84030 - DNA, 20 bp, Artificial Sequence
  Description of Artificial Sequence: Synthetic oligonucleotide
  Target: ATXN1; (-) strand; PAM type: NRG; PAM sequence: GAG
tactccagcctgggcaacaa

SEQ ID NO: 84031 - DNA, 20 bp, Artificial Sequence
  Description of Artificial Sequence: Synthetic oligonucleotide
  Target: ATXN1; (-) strand; PAM type: NRG; PAM sequence: AAG
tgtactccagcctgggcaac

SEQ ID NO: 84032 - DNA, 20 bp, Artificial Sequence
  Description of Artificial Sequence: Synthetic oligonucleotide
  Target: ATXN1; (-) strand; PAM type: NRG; PAM sequence: GGG
acaccattgtactccagcct

SEQ ID NO: 84033 - DNA, 20 bp, Artificial Sequence
  Description of Artificial Sequence: Synthetic oligonucleotide
  Target: ATXN1; (-) strand; PAM type: NRG; PAM sequence: TGG
cacaccattgtactccagcc

SEQ ID NO: 84034 - DNA, 20 bp, Artificial Sequence
  Description of Artificial Sequence: Synthetic oligonucleotide
  Target: ATXN1; (-) strand; PAM type: NRG; PAM sequence: CAG
gagaccacaccattgtactc

SEQ ID NO: 84035 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagct

SEQ ID NO: 84036 - DNA, 20 bp, Artificial Sequence
  Description of Artificial Sequence: Synthetic oligonucleotide
  Target: ATXN1; (-) strand; PAM type: NRG; PAM sequence: GAG
tgagaggcagaggttgcagt

SEQ ID NO: 84037 - DNA, 20 bp, Artificial Sequence
  Description of Artificial Sequence: Synthetic oligonucleotide
  Target: ATXN1; (-) strand; PAM type: NRG; PAM sequence: CAG
aacctgagaggcagaggttg

SEQ ID NO: 84038 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctgagaggcag

SEQ ID NO: 84039 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaacctgagaggca

SEQ ID NO: 84040 - DNA, 20 bp, Artificial Sequence
  Description of Artificial Sequence: Synthetic oligonucleotide
  Target: ATXN1; (-) strand; PAM type: NRG; PAM sequence: CAG
aattgcttgaacctgagagg

SEQ ID NO: 84041 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacctgag

SEQ ID NO: 84042 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcttgaacctga

SEQ ID NO: 84043 - DNA, 20 bp, Artificial Sequence
  Description of Artificial Sequence: Synthetic oligonucleotide
  Target: ATXN1; (-) strand; PAM type: NRG; PAM sequence: GAG
caggagaattgcttgaacct

SEQ ID NO: 84044 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 84045 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 84046 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 84047 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 84048 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 84049 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 84050 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 84051 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagctactt

SEQ ID NO: 84052 - DNA, 20 bp, Artificial Sequence
  Description of Artificial Sequence: Synthetic oligonucleotide
  Target: ATXN1; (-) strand; PAM type: NRG; PAM sequence: TGG
tgcctgtaatcccagctact

SEQ ID NO: 84053 - DNA, 20 bp, Artificial Sequence
  Description of Artificial Sequence: Synthetic oligonucleotide
  Target: ATXN1; (-) strand; PAM type: NRG; PAM sequence: CAG
gtggcgtgtgcctgtaatcc

SEQ ID NO: 84054 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagctgggcgtgg

SEQ ID NO: 84055 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagctgggcg

SEQ ID NO: 84056 - DNA, 20 bp, Artificial Sequence
  Description of Artificial Sequence: Synthetic oligonucleotide
  Target: ATXN1; (-) strand; PAM type: NRG; PAM sequence: GGG
aaaaatacaaaaaattagct

SEQ ID NO: 84057 - DNA, 20 bp, Artificial Sequence
  Description of Artificial Sequence: Synthetic oligonucleotide
  Target: ATXN1; (-) strand; PAM type: NRG; PAM sequence: TGG
taaaaatacaaaaaattagc

SEQ ID NO: 84058 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaatacaaaaaat

SEQ ID NO: 84059 - DNA, 20 bp, Artificial Sequence
  Description of Artificial Sequence: Synthetic oligonucleotide
  Target: ATXN1; (-) strand; PAM type: NRG; PAM sequence: TGG
caagaccagcctggccaaca

SEQ ID NO: 84060 - DNA, 20 bp, Artificial Sequence
  Description of Artificial Sequence: Synthetic oligonucleotide
  Target: ATXN1; (-) strand; PAM type: NRG; PAM sequence: TGG
tcaagagttcaagaccagcc

SEQ ID NO: 84061 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaagagttcaagac

SEQ ID NO: 84062 - DNA, 20 bp, Artificial Sequence
  Description of Artificial Sequence: Synthetic oligonucleotide
  Target: ATXN1; (-) strand; PAM type: NRG; PAM sequence: AAG
tcacctgaggtcaagagttc

SEQ ID NO: 84063 - DNA, 20 bp, Artificial Sequence
  Description of Artificial Sequence: Synthetic oligonucleotide
  Target: ATXN1; (-) strand; PAM type: NRG; PAM sequence: GAG
agcagatcacctgaggtcaa

SEQ ID NO: 84064 - DNA, 20 bp, Artificial Sequence
  Description of Artificial Sequence: Synthetic oligonucleotide
  Target: ATXN1; (-) strand; PAM type: NRG; PAM sequence: AAG
ccagcagatcacctgaggtc

SEQ ID NO: 84065 - DNA, 20 bp, Artificial Sequence
  Description of Artificial Sequence: Synthetic oligonucleotide
  Target: ATXN1; (-) strand; PAM type: NRG; PAM sequence: AGG
cgagaccagcagatcacctg

SEQ ID NO: 84066 - DNA, 20 bp, Artificial Sequence
  Description of Artificial Sequence: Synthetic oligonucleotide
  Target: ATXN1; (-) strand; PAM type: NRG; PAM sequence: GAG
ccgagaccagcagatcacct

SEQ ID NO: 84067 - DNA, 20 bp, Artificial Sequence
  Description of Artificial Sequence: Synthetic oligonucleotide
  Target: ATXN1; (-) strand; PAM type: NRG; PAM sequence: CAG
ctttgggaggccgagaccag

SEQ ID NO: 84068 - DNA, 20 bp, Artificial Sequence
  Description of Artificial Sequence: Synthetic oligonucleotide
  Target: ATXN1; (-) strand; PAM type: NRG; PAM sequence: CAG
gcactttgggaggccgagac

SEQ ID NO: 84069 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 84070 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 84071 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 84072 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 84073 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 84074 - DNA, 20 bp, Artificial Sequence
  Description of Artificial Sequence: Synthetic oligonucleotide
  Target: ATXN1; (-) strand; PAM type: NRG; PAM sequence: CAG
gtggcccacgcctgtaatcc

SEQ ID NO: 84075 - DNA, 20 bp, Artificial Sequence
  Description of Artificial Sequence: Synthetic oligonucleotide
  Target: ATXN1; (-) strand; PAM type: NRG; PAM sequence: TGG
tgatgaatggccgggtgcag

SEQ ID NO: 84076 - DNA, 20 bp, Artificial Sequence
  Description of Artificial Sequence: Synthetic oligonucleotide
  Target: ATXN1; (-) strand; PAM type: NRG; PAM sequence: CAG
gcctgatgaatggccgggtg

SEQ ID NO: 84077 - DNA, 20 bp, Artificial Sequence
  Description of Artificial Sequence: Synthetic oligonucleotide
  Target: ATXN1; (-) strand; PAM type: NRG; PAM sequence: GGG
aagaagcctgatgaatggcc

SEQ ID NO: 84078 - DNA, 20 bp, Artificial Sequence
  Description of Artificial Sequence: Synthetic oligonucleotide
  Target: ATXN1; (-) strand; PAM type: NRG; PAM sequence: CGG
taagaagcctgatgaatggc

SEQ ID NO: 84079 - DNA, 20 bp, Artificial Sequence
  Description of Artificial Sequence: Synthetic oligonucleotide
  Target: ATXN1; (-) strand; PAM type: NRG; PAM sequence: TGG
aggttaagaagcctgatgaa

SEQ ID NO: 84080 - DNA, 20 bp, Artificial Sequence
  Description of Artificial Sequence: Synthetic oligonucleotide
  Target: ATXN1; (-) strand; PAM type: NRG; PAM sequence: AAG
gagctatgtggcaggttaag

SEQ ID NO: 84081 - DNA, 20 bp, Artificial Sequence
  Description of Artificial Sequence: Synthetic oligonucleotide
  Target: ATXN1; (-) strand; PAM type: NRG; PAM sequence: AAG
gtagagctatgtggcaggtt

SEQ ID NO: 84082 - DNA, 20 bp, Artificial Sequence
  Description of Artificial Sequence: Synthetic oligonucleotide
  Target: ATXN1; (-) strand; PAM type: NRG; PAM sequence: AGG
gaattgtagagctatgtggc

SEQ ID NO: 84083 - DNA, 20 bp, Artificial Sequence
  Description of Artificial Sequence: Synthetic oligonucleotide
  Target: ATXN1; (-) strand; PAM type: NRG; PAM sequence: CAG
agaattgtagagctatgtgg

SEQ ID NO: 84084 - DNA, 20 bp, Artificial Sequence
  Description of Artificial Sequence: Synthetic oligonucleotide
  Target: ATXN1; (-) strand; PAM type: NRG; PAM sequence: TGG
gcaagaattgtagagctatg

SEQ ID NO: 84085 - DNA, 20 bp, Artificial Sequence
  Description of Artificial Sequence: Synthetic oligonucleotide
  Target: ATXN1; (-) strand; PAM type: NRG; PAM sequence: GAG
tcaaagatgcaagaattgta

SEQ ID NO: 84086 - DNA, 20 bp, Artificial Sequence
  Description of Artificial Sequence: Synthetic oligonucleotide
  Target: ATXN1; (-) strand; PAM type: NRG; PAM sequence: TAG
tatcaaagatgcaagaattg

SEQ ID NO: 84087 - DNA, 20 bp, Artificial Sequence
  Description of Artificial Sequence: Synthetic oligonucleotide
  Target: ATXN1; (-) strand; PAM type: NRG; PAM sequence: AAG
agttaaggtatcaaagatgc

SEQ ID NO: 84088 - DNA, 20 bp, Artificial Sequence
  Description of Artificial Sequence: Synthetic oligonucleotide
  Target: ATXN1; (-) strand; PAM type: NRG; PAM sequence: AAG
atgatatagttaaggtatca

SEQ ID NO: 84089 - DNA, 20 bp, Artificial Sequence
  Description of Artificial Sequence: Synthetic oligonucleotide
  Target: ATXN1; (-) strand; PAM type: NRG; PAM sequence: AGG
tatagcttatgatatagtta

SEQ ID NO: 84090 - DNA, 20 bp, Artificial Sequence
  Description of Artificial Sequence: Synthetic oligonucleotide
  Target: ATXN1; (-) strand; PAM type: NRG; PAM sequence: AAG
atatagcttatgatatagtt

SEQ ID NO: 84091 - DNA, 20 bp, Artificial Sequence
  Description of Artificial Sequence: Synthetic oligonucleotide
  Target: ATXN1; (-) strand; PAM type: NRG; PAM sequence: TAG
actgaatatagcttatgata

SEQ ID NO: 84092 - DNA, 20 bp, Artificial Sequence
  Description of Artificial Sequence: Synthetic oligonucleotide
  Target: ATXN1; (-) strand; PAM type: NRG; PAM sequence: TAG
ttttctttgacaactgaata

SEQ ID NO: 84093 - DNA, 20 bp, Artificial Sequence
  Description of Artificial Sequence: Synthetic oligonucleotide
  Target: ATXN1; (-) strand; PAM type: NRG; PAM sequence: AGG
gttgctcttcaaacagcaag

SEQ ID NO: 84094 - DNA, 20 bp, Artificial Sequence
  Description of Artificial Sequence: Synthetic oligonucleotide
  Target: ATXN1; (-) strand; PAM type: NRG; PAM sequence: GAG
ggttgctcttcaaacagcaa

SEQ ID NO: 84095 - DNA, 20 bp, Artificial Sequence
  Description of Artificial Sequence: Synthetic oligonucleotide
  Target: ATXN1; (-) strand; PAM type: NRG; PAM sequence: AAG
gaggttgctcttcaaacagc

SEQ ID NO: 84096 - DNA, 20 bp, Artificial Sequence
  Description of Artificial Sequence: Synthetic oligonucleotide
  Target: ATXN1; (-) strand; PAM type: NRG; PAM sequence: CAG
tactgaggttgctcttcaaa

SEQ ID NO: 84097 - DNA, 20 bp, Artificial Sequence
  Description of Artificial Sequence: Synthetic oligonucleotide
  Target: ATXN1; (-) strand; PAM type: NRG; PAM sequence: AGG
gaaatggaagaaccatactg

SEQ ID NO: 84098 - DNA, 20 bp, Artificial Sequence
  Description of Artificial Sequence: Synthetic oligonucleotide
  Target: ATXN1; (-) strand; PAM type: NRG; PAM sequence: GAG
tgaaatggaagaaccatact

SEQ ID NO: 84099 - DNA, 20 bp, Artificial Sequence
  Description of Artificial Sequence: Synthetic oligonucleotide
  Target: ATXN1; (-) strand; PAM type: NRG; PAM sequence: AAG
aattaaccagactgaaatgg

SEQ ID NO: 84100 - DNA, 20 bp, Artificial Sequence
  Description of Artificial Sequence: Synthetic oligonucleotide
  Target: ATXN1; (-) strand; PAM type: NRG; PAM sequence: TGG
gcaaattaaccagactgaaa

SEQ ID NO: 84101 - DNA, 20 bp, Artificial Sequence
  Description of Artificial Sequence: Synthetic oligonucleotide
  Target: ATXN1; (-) strand; PAM type: NRG; PAM sequence: CAG
gttaaatgacgcaaattaac

SEQ ID NO: 84102 - DNA, 20 bp, Artificial Sequence
  Description of Artificial Sequence: Synthetic oligonucleotide
  Target: ATXN1; (-) strand; PAM type: NRG; PAM sequence: TAG
tggtgctggaaattctctaa

SEQ ID NO: 84103 - DNA, 20 bp, Artificial Sequence
  Description of Artificial Sequence: Synthetic oligonucleotide
  Target: ATXN1; (-) strand; PAM type: NRG; PAM sequence: TGG
acagcgttggcaaatggtgc

SEQ ID NO: 84104 - DNA, 20 bp, Artificial Sequence
  Description of Artificial Sequence: Synthetic oligonucleotide
  Target: ATXN1; (-) strand; PAM type: NRG; PAM sequence: TGG
tttattacagcgttggcaaa

SEQ ID NO: 84105 - DNA, 20 bp, Artificial Sequence
  Description of Artificial Sequence: Synthetic oligonucleotide
  Target: ATXN1; (-) strand; PAM type: NRG; PAM sequence: TGG
aggactatttattacagcgt

SEQ ID NO: 84106 - DNA, 20 bp, Artificial Sequence
  Description of Artificial Sequence: Synthetic oligonucleotide
  Target: ATXN1; (-) strand; PAM type: NRG; PAM sequence: CAG
gtttataggactatttatta

SEQ ID NO: 84107 - DNA, 20 bp, Artificial Sequence
  Description of Artificial Sequence: Synthetic oligonucleotide
  Target: ATXN1; (-) strand; PAM type: NRG; PAM sequence: AGG
caaaaagacattcagtttat

SEQ ID NO: 84108 - DNA, 20 bp, Artificial Sequence
  Description of Artificial Sequence: Synthetic oligonucleotide
  Target: ATXN1; (-) strand; PAM type: NRG; PAM sequence: TAG
gcaaaaagacattcagttta

SEQ ID NO: 84109 - DNA, 20 bp, Artificial Sequence
  Description of Artificial Sequence: Synthetic oligonucleotide
  Target: ATXN1; (-) strand; PAM type: NRG; PAM sequence: CAG
tacaattgcaaaaagacatt

SEQ ID NO: 84110 - DNA, 20 bp, Artificial Sequence
  Description of Artificial Sequence: Synthetic oligonucleotide
  Target: ATXN1; (-) strand; PAM type: NRG; PAM sequence: AAG
aaaccctttacaattgcaaa

SEQ ID NO: 84111 - DNA, 20 bp, Artificial Sequence
  Description of Artificial Sequence: Synthetic oligonucleotide
  Target: ATXN1; (-) strand; PAM type: NRG; PAM sequence: GGG
cttaccactgagtagtttca

SEQ ID NO: 84112 - DNA, 20 bp, Artificial Sequence
  Description of Artificial Sequence: Synthetic oligonucleotide
  Target: ATXN1; (-) strand; PAM type: NRG; PAM sequence: AGG
ccttaccactgagtagtttc

SEQ ID NO: 84113 - DNA, 20 bp, Artificial Sequence
  Description of Artificial Sequence: Synthetic oligonucleotide
  Target: ATXN1; (-) strand; PAM type: NRG; PAM sequence: CAG
tccttaccactgagtagttt

SEQ ID NO: 84114 - DNA, 20 bp, Artificial Sequence
  Description of Artificial Sequence: Synthetic oligonucleotide
  Target: ATXN1; (-) strand; PAM type: NRG; PAM sequence: TAG
ttcttttccttaccactgag

SEQ ID NO: 84115 - DNA, 20 bp, Artificial Sequence
  Description of Artificial Sequence: Synthetic oligonucleotide
  Target: ATXN1; (-) strand; PAM type: NRG; PAM sequence: GAG
ttgttcttttccttaccact

SEQ ID NO: 84116 - DNA, 20 bp, Artificial Sequence
  Description of Artificial Sequence: Synthetic oligonucleotide
  Target: ATXN1; (-) strand; PAM type: NRG; PAM sequence: CAG
aatactgtggctatcttatt

SEQ ID NO: 84117 - DNA, 20 bp, Artificial Sequence
  Description of Artificial Sequence: Synthetic oligonucleotide
  Target: ATXN1; (-) strand; PAM type: NRG; PAM sequence: TGG
aatccaaacagaaaatactg

SEQ ID NO: 84118 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaaatccaaa

SEQ ID NO: 84119 - DNA, 20 bp, Artificial Sequence
  Description of Artificial Sequence: Synthetic oligonucleotide
  Target: ATXN1; (-) strand; PAM type: NRG; PAM sequence: GAG
cactacagcctgggcaacaa

SEQ ID NO: 84120 - DNA, 20 bp, Artificial Sequence
  Description of Artificial Sequence: Synthetic oligonucleotide
  Target: ATXN1; (-) strand; PAM type: NRG; PAM sequence: AAG
tgcactacagcctgggcaac

SEQ ID NO: 84121 - DNA, 20 bp, Artificial Sequence
  Description of Artificial Sequence: Synthetic oligonucleotide
  Target: ATXN1; (-) strand; PAM type: NRG; PAM sequence: GGG
gcaccattgcactacagcct

SEQ ID NO: 84122 - DNA, 20 bp, Artificial Sequence
  Description of Artificial Sequence: Synthetic oligonucleotide
  Target: ATXN1; (-) strand; PAM type: NRG; PAM sequence: TGG
tgcaccattgcactacagcc

SEQ ID NO: 84123 - DNA, 20 bp, Artificial Sequence
  Description of Artificial Sequence: Synthetic oligonucleotide
  Target: ATXN1; (-) strand; PAM type: NRG; PAM sequence: CAG
gacattgcaccattgcacta

SEQ ID NO: 84124 - DNA, 20 bp, Artificial Sequence
  Description of Artificial Sequence: Synthetic oligonucleotide
  Target: ATXN1; (-) strand; PAM type: NRG; PAM sequence: GAG
cgggaggcagaggttgcagc

SEQ ID NO: 84125 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggcagaggttg

SEQ ID NO: 84126 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccgggaggcag

SEQ ID NO: 84127 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccgggaggca

SEQ ID NO: 84128 - DNA, 20 bp, Artificial Sequence
  Description of Artificial Sequence: Synthetic oligonucleotide
  Target: ATXN1; (-) strand; PAM type: NRG; PAM sequence: CAG
aatcgcttgaacccgggagg

SEQ ID NO: 84129 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccggg

SEQ ID NO: 84130 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacccgg

SEQ ID NO: 84131 - DNA, 20 bp, Artificial Sequence
  Description of Artificial Sequence: Synthetic oligonucleotide
  Target: ATXN1; (-) strand; PAM type: NRG; PAM sequence: GGG
caggagaatcgcttgaaccc

SEQ ID NO: 84132 - DNA, 20 bp, Artificial Sequence
  Description of Artificial Sequence: Synthetic oligonucleotide
  Target: ATXN1; (-) strand; PAM type: NRG; PAM sequence: CGG
gcaggagaatcgcttgaacc

SEQ ID NO: 84133 - DNA, 20 bp, Artificial Sequence
  Description of Artificial Sequence: Synthetic oligonucleotide
  Target: ATXN1; (-) strand; PAM type: NRG; PAM sequence: GAG
tgcttgggaggctgaggcag

SEQ ID NO: 84134 - DNA, 20 bp, Artificial Sequence
  Description of Artificial Sequence: Synthetic oligonucleotide
  Target: ATXN1; (-) strand; PAM type: NRG; PAM sequence: AGG
gctgcttgggaggctgaggc

SEQ ID NO: 84135 - DNA, 20 bp, Artificial Sequence
  Description of Artificial Sequence: Synthetic oligonucleotide
  Target: ATXN1; (-) strand; PAM type: NRG; PAM sequence: CAG
agctgcttgggaggctgagg

SEQ ID NO: 84136 - DNA, 20 bp, Artificial Sequence
  Description of Artificial Sequence: Synthetic oligonucleotide
  Target: ATXN1; (-) strand; PAM type: NRG; PAM sequence: AGG
cccagctgcttgggaggctg

SEQ ID NO: 84137 - DNA, 20 bp, Artificial Sequence
  Description of Artificial Sequence: Synthetic oligonucleotide
  Target: ATXN1; (-) strand; PAM type: NRG; PAM sequence: GAG
tcccagctgcttgggaggct

SEQ ID NO: 84138 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctgcttggg

SEQ ID NO: 84139 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctgcttgg

SEQ ID NO: 84140 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagctgctt

SEQ ID NO: 84141 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagctgct

SEQ ID NO: 84142 - DNA, 20 bp, Artificial Sequence
  Description of Artificial Sequence: Synthetic oligonucleotide
  Target: ATXN1; (-) strand; PAM type: NRG; PAM sequence: CAG
gtggtggacgcctgtaatcc

SEQ ID NO: 84143 - DNA, 20 bp, Artificial Sequence
  Description of Artificial Sequence: Synthetic oligonucleotide
  Target: ATXN1; (-) strand; PAM type: NRG; PAM sequence: TGG
taattagccaggcatggtgg

SEQ ID NO: 84144 - DNA, 20 bp, Artificial Sequence
  Description of Artificial Sequence: Synthetic oligonucleotide
  Target: ATXN1; (-) strand; PAM type: NRG; PAM sequence: TGG
gattaattagccaggcatgg

SEQ ID NO: 84145 - DNA, 20 bp, Artificial Sequence
  Description of Artificial Sequence: Synthetic oligonucleotide
  Target: ATXN1; (-) strand; PAM type: NRG; PAM sequence: TGG
aaagattaattagccaggca

SEQ ID NO: 84146 - DNA, 20 bp, Artificial Sequence
  Description of Artificial Sequence: Synthetic oligonucleotide
  Target: ATXN1; (-) strand; PAM type: NRG; PAM sequence: AGG
ctactaaagattaattagcc

SEQ ID NO: 84147 - DNA, 20 bp, Artificial Sequence
  Description of Artificial Sequence: Synthetic oligonucleotide
  Target: ATXN1; (-) strand; PAM type: NRG; PAM sequence: CAG
tctactaaagattaattagc

SEQ ID NO: 84148 - DNA, 20 bp, Artificial Sequence
  Description of Artificial Sequence: Synthetic oligonucleotide
  Target: ATXN1; (-) strand; PAM type: NRG; PAM sequence: TAG
cgtctctactaaagattaat

SEQ ID NO: 84149 - DNA, 20 bp, Artificial Sequence
  Description of Artificial Sequence: Synthetic oligonucleotide
  Target: ATXN1; (-) strand; PAM type: NRG; PAM sequence: AAG
gtgaaaccccgtctctacta

SEQ ID NO: 84150 - DNA, 20 bp, Artificial Sequence
  Description of Artificial Sequence: Synthetic oligonucleotide
  Target: ATXN1; (-) strand; PAM type: NRG; PAM sequence: TGG
agagaccagcctgaccaaca

SEQ ID NO: 84151 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttagagac

SEQ ID NO: 84152 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagtta

SEQ ID NO: 84153 - DNA, 20 bp, Artificial Sequence
  Description of Artificial Sequence: Synthetic oligonucleotide
  Target: ATXN1; (-) strand; PAM type: NRG; PAM sequence: TAG
gatcacctgaggtcaggagt

SEQ ID NO: 84154 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcag

SEQ ID NO: 84155 - DNA, 20 bp, Artificial Sequence
  Description of Artificial Sequence: Synthetic oligonucleotide
  Target: ATXN1; (-) strand; PAM type: NRG; PAM sequence: AGG
tgggtggatcacctgaggtc

SEQ ID NO: 84156 - DNA, 20 bp, Artificial Sequence
  Description of Artificial Sequence: Synthetic oligonucleotide
  Target: ATXN1; (-) strand; PAM type: NRG; PAM sequence: CAG
gtgggtggatcacctgaggt

SEQ ID NO: 84157 - DNA, 20 bp, Artificial Sequence
  Description of Artificial Sequence: Synthetic oligonucleotide
  Target: ATXN1; (-) strand; PAM type: NRG; PAM sequence: AGG
cgaggtgggtggatcacctg

SEQ ID NO: 84158 - DNA, 20 bp, Artificial Sequence
  Description of Artificial Sequence: Synthetic oligonucleotide
  Target: ATXN1; (-) strand; PAM type: NRG; PAM sequence: GAG
ccgaggtgggtggatcacct

SEQ ID NO: 84159 - DNA, 20 bp, Artificial Sequence
  Description of Artificial Sequence: Synthetic oligonucleotide
  Target: ATXN1; (-) strand; PAM type: NRG; PAM sequence: TGG
cttcgggaggccgaggtggg

SEQ ID NO: 84160 - DNA, 20 bp, Artificial Sequence
  Description of Artificial Sequence: Synthetic oligonucleotide
  Target: ATXN1; (-) strand; PAM type: NRG; PAM sequence: GGG
gcacttcgggaggccgaggt

SEQ ID NO: 84161 - DNA, 20 bp, Artificial Sequence
  Description of Artificial Sequence: Synthetic oligonucleotide
  Target: ATXN1; (-) strand; PAM type: NRG; PAM sequence: TGG
agcacttcgggaggccgagg

SEQ ID NO: 84162 - DNA, 20 bp, Artificial Sequence
  Description of Artificial Sequence: Synthetic oligonucleotide
  Target: ATXN1; (-) strand; PAM type: NRG; PAM sequence: AGG
cctagcacttcgggaggccg

SEQ ID NO: 84163 - DNA, 20 bp, Artificial Sequence
  Description of Artificial Sequence: Synthetic oligonucleotide
  Target: ATXN1; (-) strand; PAM type: NRG; PAM sequence: GAG
tcctagcacttcgggaggcc

SEQ ID NO: 84164 - DNA, 20 bp, Artificial Sequence
  Description of Artificial Sequence: Synthetic oligonucleotide
  Target: ATXN1; (-) strand; PAM type: NRG; PAM sequence: AGG
tgtaatcctagcacttcggg

SEQ ID NO: 84165 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcctagcacttcgg

SEQ ID NO: 84166 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcctagcacttc

SEQ ID NO: 84167 - DNA, 20 bp, Artificial Sequence
  Description of Artificial Sequence: Synthetic oligonucleotide
  Target: ATXN1; (-) strand; PAM type: NRG; PAM sequence: CGG
tgcctgtaatcctagcactt

SEQ ID NO: 84168 - DNA, 20 bp, Artificial Sequence
  Description of Artificial Sequence: Synthetic oligonucleotide
  Target: ATXN1; (-) strand; PAM type: NRG; PAM sequence: TAG
gtggctcctgcctgtaatcc

SEQ ID NO: 84169 - DNA, 20 bp, Artificial Sequence
  Description of Artificial Sequence: Synthetic oligonucleotide
  Target: ATXN1; (-) strand; PAM type: NRG; PAM sequence: TGG
aaaaatccagccgggcacgg

SEQ ID NO: 84170 - DNA, 20 bp, Artificial Sequence
  Description of Artificial Sequence: Synthetic oligonucleotide
  Target: ATXN1; (-) strand; PAM type: NRG; PAM sequence: CGG
aaaaaaaatccagccgggca

SEQ ID NO: 84171 - DNA, 20 bp, Artificial Sequence
  Description of Artificial Sequence: Synthetic oligonucleotide
  Target: ATXN1; (-) strand; PAM type: NRG; PAM sequence: GGG
tattaaaaaaaaatccagcc

SEQ ID NO: 84172 - DNA, 20 bp, Artificial Sequence
  Description of Artificial Sequence: Synthetic oligonucleotide
  Target: ATXN1; (-) strand; PAM type: NRG; PAM sequence: CGG
atattaaaaaaaaatccagc

SEQ ID NO: 84173 - DNA, 20 bp, Artificial Sequence
  Description of Artificial Sequence: Synthetic oligonucleotide
  Target: ATXN1; (-) strand; PAM type: NRG; PAM sequence: CAG
tcctatattaaaaaaaaatc

SEQ ID NO: 84174 - DNA, 20 bp, Artificial Sequence
  Description of Artificial Sequence: Synthetic oligonucleotide
  Target: ATXN1; (-) strand; PAM type: NRG; PAM sequence: TAG
cttcgtacagtttgaatcct

SEQ ID NO: 84175 - DNA, 20 bp, Artificial Sequence
  Description of Artificial Sequence: Synthetic oligonucleotide
  Target: ATXN1; (-) strand; PAM type: NRG; PAM sequence: CAG
tcctactgaaacacttcgta

SEQ ID NO: 84176 - DNA, 20 bp, Artificial Sequence
  Description of Artificial Sequence: Synthetic oligonucleotide
  Target: ATXN1; (-) strand; PAM type: NRG; PAM sequence: CGG
aaaaaattttttggtcttgc

SEQ ID NO: 84177 - DNA, 20 bp, Artificial Sequence
  Description of Artificial Sequence: Synthetic oligonucleotide
  Target: ATXN1; (-) strand; PAM type: NRG; PAM sequence: TGG
gttctttttaaaaaattttt

SEQ ID NO: 84178 - DNA, 20 bp, Artificial Sequence
  Description of Artificial Sequence: Synthetic oligonucleotide
  Target: ATXN1; (-) strand; PAM type: NRG; PAM sequence: AAG
ctgtattttatataattcaa

SEQ ID NO: 84179 - DNA, 20 bp, Artificial Sequence
  Description of Artificial Sequence: Synthetic oligonucleotide
  Target: ATXN1; (-) strand; PAM type: NRG; PAM sequence: TAG
tataataattatagggacaa

SEQ ID NO: 84180 - DNA, 20 bp, Artificial Sequence
  Description of Artificial Sequence: Synthetic oligonucleotide
  Target: ATXN1; (-) strand; PAM type: NRG; PAM sequence: GGG
aatttgttataataattata

SEQ ID NO: 84181 - DNA, 20 bp, Artificial Sequence
  Description of Artificial Sequence: Synthetic oligonucleotide
  Target: ATXN1; (-) strand; PAM type: NRG; PAM sequence: AGG
taatttgttataataattat

SEQ ID NO: 84182 - DNA, 20 bp, Artificial Sequence
  Description of Artificial Sequence: Synthetic oligonucleotide
  Target: ATXN1; (-) strand; PAM type: NRG; PAM sequence: TAG
ttaatttgttataataatta

SEQ ID NO: 84183 - DNA, 20 bp, Artificial Sequence
  Description of Artificial Sequence: Synthetic oligonucleotide
  Target: ATXN1; (-) strand; PAM type: NRG; PAM sequence: TAG
tgtctatgccacagaaagaa

SEQ ID NO: 84184 - DNA, 20 bp, Artificial Sequence
  Description of Artificial Sequence: Synthetic oligonucleotide
  Target: ATXN1; (-) strand; PAM type: NRG; PAM sequence: AAG
tcacatgtctatgccacaga

SEQ ID NO: 84185 - DNA, 20 bp, Artificial Sequence
  Description of Artificial Sequence: Synthetic oligonucleotide
  Target: ATXN1; (-) strand; PAM type: NRG; PAM sequence: CAG
tatttcacatgtctatgcca

SEQ ID NO: 84186 - DNA, 20 bp, Artificial Sequence
  Description of Artificial Sequence: Synthetic oligonucleotide
  Target: ATXN1; (-) strand; PAM type: NRG; PAM sequence: GAG
tattgaggcaggagtgcagc

SEQ ID NO: 84187 - DNA, 20 bp, Artificial Sequence
  Description of Artificial Sequence: Synthetic oligonucleotide
  Target: ATXN1; (-) strand; PAM type: NRG; PAM sequence: CAG
tttgtattgaggcaggagtg

SEQ ID NO: 84188 - DNA, 20 bp, Artificial Sequence
  Description of Artificial Sequence: Synthetic oligonucleotide
  Target: ATXN1; (-) strand; PAM type: NRG; PAM sequence: GAG
ctaaatttgtattgaggcag

SEQ ID NO: 84189 - DNA, 20 bp, Artificial Sequence
  Description of Artificial Sequence: Synthetic oligonucleotide
  Target: ATXN1; (-) strand; PAM type: NRG; PAM sequence: AGG
ttctaaatttgtattgaggc

SEQ ID NO: 84190 - DNA, 20 bp, Artificial Sequence
  Description of Artificial Sequence: Synthetic oligonucleotide
  Target: ATXN1; (-) strand; PAM type: NRG; PAM sequence: CAG
attctaaatttgtattgagg

SEQ ID NO: 84191 - DNA, 20 bp, Artificial Sequence
  Description of Artificial Sequence: Synthetic oligonucleotide
  Target: ATXN1; (-) strand; PAM type: NRG; PAM sequence: AGG
gccattctaaatttgtattg

SEQ ID NO: 84192 - DNA, 20 bp, Artificial Sequence
  Description of Artificial Sequence: Synthetic oligonucleotide
  Target: ATXN1; (-) strand; PAM type: NRG; PAM sequence: GAG
tgccattctaaatttgtatt

SEQ ID NO: 84193 - DNA, 20 bp, Artificial Sequence
  Description of Artificial Sequence: Synthetic oligonucleotide
  Target: ATXN1; (-) strand; PAM type: NRG; PAM sequence: CAG
gcaccagtttcttcccggca

SEQ ID NO: 84194 - DNA, 20 bp, Artificial Sequence
  Description of Artificial Sequence: Synthetic oligonucleotide
  Target: ATXN1; (-) strand; PAM type: NRG; PAM sequence: CGG
acccagcaccagtttcttcc

SEQ ID NO: 84195 - DNA, 20 bp, Artificial Sequence
  Description of Artificial Sequence: Synthetic oligonucleotide
  Target: ATXN1; (-) strand; PAM type: NRG; PAM sequence: CAG
atacttgcaccacccagcac

SEQ ID NO: 84196 - DNA, 20 bp, Artificial Sequence
  Description of Artificial Sequence: Synthetic oligonucleotide
  Target: ATXN1; (-) strand; PAM type: NRG; PAM sequence: CAG
agactgatacttgcaccacc

SEQ ID NO: 84197 - DNA, 20 bp, Artificial Sequence
  Description of Artificial Sequence: Synthetic oligonucleotide
  Target: ATXN1; (-) strand; PAM type: NRG; PAM sequence: GAG
gcatcatcttcctaagacat

SEQ ID NO: 84198 - DNA, 20 bp, Artificial Sequence
  Description of Artificial Sequence: Synthetic oligonucleotide
  Target: ATXN1; (-) strand; PAM type: NRG; PAM sequence: AAG
gtgatgagcatcatcttcct

SEQ ID NO: 84199 - DNA, 20 bp, Artificial Sequence
  Description of Artificial Sequence: Synthetic oligonucleotide
  Target: ATXN1; (-) strand; PAM type: NRG; PAM sequence: GAG
gctcctggctgctgcgtgat

SEQ ID NO: 84200 - DNA, 20 bp, Artificial Sequence
  Description of Artificial Sequence: Synthetic oligonucleotide
  Target: ATXN1; (-) strand; PAM type: NRG; PAM sequence: TGG
aaaattaaaaaacatgctcc

SEQ ID NO: 84201 - DNA, 20 bp, Artificial Sequence
  Description of Artificial Sequence: Synthetic oligonucleotide
  Target: ATXN1; (-) strand; PAM type: NRG; PAM sequence: AAG
tccagcctaagtgacagagc

SEQ ID NO: 84202 - DNA, 20 bp, Artificial Sequence
  Description of Artificial Sequence: Synthetic oligonucleotide
  Target: ATXN1; (-) strand; PAM type: NRG; PAM sequence: GAG
acactccagcctaagtgaca

SEQ ID NO: 84203 - DNA, 20 bp, Artificial Sequence
  Description of Artificial Sequence: Synthetic oligonucleotide
  Target: ATXN1; (-) strand; PAM type: NRG; PAM sequence: CAG
ctacactccagcctaagtga

SEQ ID NO: 84204 - DNA, 20 bp, Artificial Sequence
  Description of Artificial Sequence: Synthetic oligonucleotide
  Target: ATXN1; (-) strand; PAM type: NRG; PAM sequence: AAG
acaccactacactccagcct

SEQ ID NO: 84205 - DNA, 20 bp, Artificial Sequence
  Description of Artificial Sequence: Synthetic oligonucleotide
  Target: ATXN1; (-) strand; PAM type: NRG; PAM sequence: CAG
atgatcacaccactacactc

SEQ ID NO: 84206 - DNA, 20 bp, Artificial Sequence
  Description of Artificial Sequence: Synthetic oligonucleotide
  Target: ATXN1; (-) strand; PAM type: NRG; PAM sequence: GAG
gaggagttcgaggttgccgt

SEQ ID NO: 84207 - DNA, 20 bp, Artificial Sequence
  Description of Artificial Sequence: Synthetic oligonucleotide
  Target: ATXN1; (-) strand; PAM type: NRG; PAM sequence: AGG
tgcttgagttgaggagttcg

SEQ ID NO: 84208 - DNA, 20 bp, Artificial Sequence
  Description of Artificial Sequence: Synthetic oligonucleotide
  Target: ATXN1; (-) strand; PAM type: NRG; PAM sequence: GAG
ctgcttgagttgaggagttc

SEQ ID NO: 84209 - DNA, 20 bp, Artificial Sequence
  Description of Artificial Sequence: Synthetic oligonucleotide
  Target: ATXN1; (-) strand; PAM type: NRG; PAM sequence: GAG
ggaggactgcttgagttgag

SEQ ID NO: 84210 - DNA, 20 bp, Artificial Sequence
  Description of Artificial Sequence: Synthetic oligonucleotide
  Target: ATXN1; (-) strand; PAM type: NRG; PAM sequence: AGG
tgggaggactgcttgagttg

SEQ ID NO: 84211 - DNA, 20 bp, Artificial Sequence
  Description of Artificial Sequence: Synthetic oligonucleotide
  Target: ATXN1; (-) strand; PAM type: NRG; PAM sequence: GAG
ctgggaggactgcttgagtt

SEQ ID NO: 84212 - DNA, 20 bp, Artificial Sequence
  Description of Artificial Sequence: Synthetic oligonucleotide
  Target: ATXN1; (-) strand; PAM type: NRG; PAM sequence: GAG
ctgagctgggaggactgctt

SEQ ID NO: 84213 - DNA, 20 bp, Artificial Sequence
  Description of Artificial Sequence: Synthetic oligonucleotide
  Target: ATXN1; (-) strand; PAM type: NRG; PAM sequence: AGG
acttgggaggctgagctggg

SEQ ID NO: 84214 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgagctgg

SEQ ID NO: 84215 - DNA, 20 bp, Artificial Sequence
  Description of Artificial Sequence: Synthetic oligonucleotide
  Target: ATXN1; (-) strand; PAM type: NRG; PAM sequence: GGG
gctacttgggaggctgagct

SEQ ID NO: 84216 - DNA, 20 bp, Artificial Sequence
  Description of Artificial Sequence: Synthetic oligonucleotide
  Target: ATXN1; (-) strand; PAM type: NRG; PAM sequence: TGG
agctacttgggaggctgagc

SEQ ID NO: 84217 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 84218 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 84219 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 84220 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagctactt

SEQ ID NO: 84221 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagctact

SEQ ID NO: 84222 - DNA, 20 bp, Artificial Sequence
  Description of Artificial Sequence: Synthetic oligonucleotide
  Target: ATXN1; (-) strand; PAM type: NRG; PAM sequence: CAG
atgggtcacacctgtaatcc

SEQ ID NO: 84223 - DNA, 20 bp, Artificial Sequence
  Description of Artificial Sequence: Synthetic oligonucleotide
  Target: ATXN1; (-) strand; PAM type: NRG; PAM sequence: GGG
tgttcctggccggacatgat

SEQ ID NO: 84224 - DNA, 20 bp, Artificial Sequence
  Description of Artificial Sequence: Synthetic oligonucleotide
  Target: ATXN1; (-) strand; PAM type: NRG; PAM sequence: TGG
atgttcctggccggacatga

SEQ ID NO: 84225 - DNA, 20 bp, Artificial Sequence
  Description of Artificial Sequence: Synthetic oligonucleotide
  Target: ATXN1; (-) strand; PAM type: NRG; PAM sequence: CGG
atcaaaaacatgttcctggc

SEQ ID NO: 84226 - DNA, 20 bp, Artificial Sequence
  Description of Artificial Sequence: Synthetic oligonucleotide
  Target: ATXN1; (-) strand; PAM type: NRG; PAM sequence: TGG
atggatcaaaaacatgttcc

SEQ ID NO: 84227 - DNA, 20 bp, Artificial Sequence
  Description of Artificial Sequence: Synthetic oligonucleotide
  Target: ATXN1; (-) strand; PAM type: NRG; PAM sequence: TGG
taaagaatattccatcagta

SEQ ID NO: 84228 - DNA, 20 bp, Artificial Sequence
  Description of Artificial Sequence: Synthetic oligonucleotide
  Target: ATXN1; (-) strand; PAM type: NRG; PAM sequence: CAG
caaaataaagaatattccat

SEQ ID NO: 84229 - DNA, 20 bp, Artificial Sequence
  Description of Artificial Sequence: Synthetic oligonucleotide
  Target: ATXN1; (-) strand; PAM type: NRG; PAM sequence: AAG
ctaagagtcagaccaaaata

SEQ ID NO: 84230 - DNA, 20 bp, Artificial Sequence
  Description of Artificial Sequence: Synthetic oligonucleotide
  Target: ATXN1; (-) strand; PAM type: NRG; PAM sequence: CAG
gtgggtacaatcctaagagt

SEQ ID NO: 84231 - DNA, 20 bp, Artificial Sequence
  Description of Artificial Sequence: Synthetic oligonucleotide
  Target: ATXN1; (-) strand; PAM type: NRG; PAM sequence: GAG
ggttgtgggtacaatcctaa

SEQ ID NO: 84232 - DNA, 20 bp, Artificial Sequence
  Description of Artificial Sequence: Synthetic oligonucleotide
  Target: ATXN1; (-) strand; PAM type: NRG; PAM sequence: AAG
ttggttgtgggtacaatcct

SEQ ID NO: 84233 - DNA, 20 bp, Artificial Sequence
  Description of Artificial Sequence: Synthetic oligonucleotide
  Target: ATXN1; (-) strand; PAM type: NRG; PAM sequence: GGG
ctttagtttccattggttgt

SEQ ID NO: 84234 - DNA, 20 bp, Artificial Sequence
  Description of Artificial Sequence: Synthetic oligonucleotide
  Target: ATXN1; (-) strand; PAM type: NRG; PAM sequence: TGG
gctttagtttccattggttg

SEQ ID NO: 84235 - DNA, 20 bp, Artificial Sequence
  Description of Artificial Sequence: Synthetic oligonucleotide
  Target: ATXN1; (-) strand; PAM type: NRG; PAM sequence: TGG
tccagtgctttagtttccat

SEQ ID NO: 84236 - DNA, 20 bp, Artificial Sequence
  Description of Artificial Sequence: Synthetic oligonucleotide
  Target: ATXN1; (-) strand; PAM type: NRG; PAM sequence: TAG
attctttctttccagtgctt

SEQ ID NO: 84237 - DNA, 20 bp, Artificial Sequence
  Description of Artificial Sequence: Synthetic oligonucleotide
  Target: ATXN1; (-) strand; PAM type: NRG; PAM sequence: CAG
tttttatgattctttctttc

SEQ ID NO: 84238 - DNA, 20 bp, Artificial Sequence
  Description of Artificial Sequence: Synthetic oligonucleotide
  Target: ATXN1; (-) strand; PAM type: NRG; PAM sequence: GGG
aaagatttagaaatggcagt

SEQ ID NO: 84239 - DNA, 20 bp, Artificial Sequence
  Description of Artificial Sequence: Synthetic oligonucleotide
  Target: ATXN1; (-) strand; PAM type: NRG; PAM sequence: TGG
gaaagatttagaaatggcag

SEQ ID NO: 84240 - DNA, 20 bp, Artificial Sequence
  Description of Artificial Sequence: Synthetic oligonucleotide
  Target: ATXN1; (-) strand; PAM type: NRG; PAM sequence: CAG
acagaaagatttagaaatgg

SEQ ID NO: 84241 - DNA, 20 bp, Artificial Sequence
  Description of Artificial Sequence: Synthetic oligonucleotide
  Target: ATXN1; (-) strand; PAM type: NRG; PAM sequence: TGG
gtaacagaaagatttagaaa

SEQ ID NO: 84242 - DNA, 20 bp, Artificial Sequence
  Description of Artificial Sequence: Synthetic oligonucleotide
  Target: ATXN1; (-) strand; PAM type: NRG; PAM sequence: TAG
ctttgggtaacagaaagatt

SEQ ID NO: 84243 - DNA, 20 bp, Artificial Sequence
  Description of Artificial Sequence: Synthetic oligonucleotide
  Target: ATXN1; (-) strand; PAM type: NRG; PAM sequence: AAG
cagtcactttgggtaacaga

SEQ ID NO: 84244 - DNA, 20 bp, Artificial Sequence
  Description of Artificial Sequence: Synthetic oligonucleotide
  Target: ATXN1; (-) strand; PAM type: NRG; PAM sequence: CAG
aacacagtcactttgggtaa

SEQ ID NO: 84245 - DNA, 20 bp, Artificial Sequence
  Description of Artificial Sequence: Synthetic oligonucleotide
  Target: ATXN1; (-) strand; PAM type: NRG; PAM sequence: GGG
taataaaacacagtcacttt

SEQ ID NO: 84246 - DNA, 20 bp, Artificial Sequence
  Description of Artificial Sequence: Synthetic oligonucleotide
  Target: ATXN1; (-) strand; PAM type: NRG; PAM sequence: TGG
ttaataaaacacagtcactt

SEQ ID NO: 84247 - DNA, 20 bp, Artificial Sequence
  Description of Artificial Sequence: Synthetic oligonucleotide
  Target: ATXN1; (-) strand; PAM type: NRG; PAM sequence: CAG
cacatgcctttaataaaaca

SEQ ID NO: 84248 - DNA, 20 bp, Artificial Sequence
  Description of Artificial Sequence: Synthetic oligonucleotide
  Target: ATXN1; (-) strand; PAM type: NRG; PAM sequence: CGG
taaatggcaaaaaatacctt

SEQ ID NO: 84249 - DNA, 20 bp, Artificial Sequence
  Description of Artificial Sequence: Synthetic oligonucleotide
  Target: ATXN1; (-) strand; PAM type: NRG; PAM sequence: TGG
tactgtttggtatttttaaa

SEQ ID NO: 84250 - DNA, 20 bp, Artificial Sequence
  Description of Artificial Sequence: Synthetic oligonucleotide
  Target: ATXN1; (-) strand; PAM type: NRG; PAM sequence: TGG
gttgagctgttactactgtt

SEQ ID NO: 84251 - DNA, 20 bp, Artificial Sequence
  Description of Artificial Sequence: Synthetic oligonucleotide
  Target: ATXN1; (-) strand; PAM type: NRG; PAM sequence: GAG
gtggtagcagcctagctgtt

SEQ ID NO: 84252 - DNA, 20 bp, Artificial Sequence
  Description of Artificial Sequence: Synthetic oligonucleotide
  Target: ATXN1; (-) strand; PAM type: NRG; PAM sequence: TAG
caggttaagtggtagcagcc

SEQ ID NO: 84253 - DNA, 20 bp, Artificial Sequence
  Description of Artificial Sequence: Synthetic oligonucleotide
  Target: ATXN1; (-) strand; PAM type: NRG; PAM sequence: CAG
aattgcaggttaagtggtag

SEQ ID NO: 84254 - DNA, 20 bp, Artificial Sequence
  Description of Artificial Sequence: Synthetic oligonucleotide
  Target: ATXN1; (-) strand; PAM type: NRG; PAM sequence: TAG
ccaaattgcaggttaagtgg

SEQ ID NO: 84255 - DNA, 20 bp, Artificial Sequence
  Description of Artificial Sequence: Synthetic oligonucleotide
  Target: ATXN1; (-) strand; PAM type: NRG; PAM sequence: TGG
tgtccaaattgcaggttaag

SEQ ID NO: 84256 - DNA, 20 bp, Artificial Sequence
  Description of Artificial Sequence: Synthetic oligonucleotide
  Target: ATXN1; (-) strand; PAM type: NRG; PAM sequence: AAG
aattgtccaaattgcaggtt

SEQ ID NO: 84257 - DNA, 20 bp, Artificial Sequence
  Description of Artificial Sequence: Synthetic oligonucleotide
  Target: ATXN1; (-) strand; PAM type: NRG; PAM sequence: AGG
cacaaaattgtccaaattgc

SEQ ID NO: 84258 - DNA, 20 bp, Artificial Sequence
  Description of Artificial Sequence: Synthetic oligonucleotide
  Target: ATXN1; (-) strand; PAM type: NRG; PAM sequence: CAG
ccacaaaattgtccaaattg

SEQ ID NO: 84259 - DNA, 20 bp, Artificial Sequence
  Description of Artificial Sequence: Synthetic oligonucleotide
  Target: ATXN1; (-) strand; PAM type: NRG; PAM sequence: AAG
gctccatgtgtcataagaca

SEQ ID NO: 84260 - DNA, 20 bp, Artificial Sequence
  Description of Artificial Sequence: Synthetic oligonucleotide
  Target: ATXN1; (-) strand; PAM type: NRG; PAM sequence: AAG
gcatctgctccatgtgtcat

SEQ ID NO: 84261 - DNA, 20 bp, Artificial Sequence
  Description of Artificial Sequence: Synthetic oligonucleotide
  Target: ATXN1; (-) strand; PAM type: NRG; PAM sequence: TAG
catttttgtgtgttaattag

SEQ ID NO: 84262 - DNA, 20 bp, Artificial Sequence
  Description of Artificial Sequence: Synthetic oligonucleotide
  Target: ATXN1; (-) strand; PAM type: NRG; PAM sequence: TAG
agacatttttgtgtgttaat

SEQ ID NO: 84263 - DNA, 20 bp, Artificial Sequence
  Description of Artificial Sequence: Synthetic oligonucleotide
  Target: ATXN1; (-) strand; PAM type: NRG; PAM sequence: TAG
gtttttttaaagctctgttt

SEQ ID NO: 84264 - DNA, 20 bp, Artificial Sequence
  Description of Artificial Sequence: Synthetic oligonucleotide
  Target: ATXN1; (-) strand; PAM type: NRG; PAM sequence: AAG
caaatgcatatgttttttta

SEQ ID NO: 84265 - DNA, 20 bp, Artificial Sequence
  Description of Artificial Sequence: Synthetic oligonucleotide
  Target: ATXN1; (-) strand; PAM type: NRG; PAM sequence: AAG
cattttgcttatactctttg

SEQ ID NO: 84266 - DNA, 20 bp, Artificial Sequence
  Description of Artificial Sequence: Synthetic oligonucleotide
  Target: ATXN1; (-) strand; PAM type: NRG; PAM sequence: AGG
tccatactttatttagagag

SEQ ID NO: 84267 - DNA, 20 bp, Artificial Sequence
  Description of Artificial Sequence: Synthetic oligonucleotide
  Target: ATXN1; (-) strand; PAM type: NRG; PAM sequence: GAG
atccatactttatttagaga

SEQ ID NO: 84268 - DNA, 20 bp, Artificial Sequence
  Description of Artificial Sequence: Synthetic oligonucleotide
  Target: ATXN1; (-) strand; PAM type: NRG; PAM sequence: GAG
aaatccatactttatttaga

SEQ ID NO: 84269 - DNA, 20 bp, Artificial Sequence
  Description of Artificial Sequence: Synthetic oligonucleotide
  Target: ATXN1; (-) strand; PAM type: NRG; PAM sequence: GAG
tcaaatccatactttattta

SEQ ID NO: 84270 - DNA, 20 bp, Artificial Sequence
  Description of Artificial Sequence: Synthetic oligonucleotide
  Target: ATXN1; (-) strand; PAM type: NRG; PAM sequence: TAG
cttcaaatccatactttatt

SEQ ID NO: 84271 - DNA, 20 bp, Artificial Sequence
  Description of Artificial Sequence: Synthetic oligonucleotide
  Target: ATXN1; (-) strand; PAM type: NRG; PAM sequence: AAG
ttaacaaaaaaattaaaagc

SEQ ID NO: 84272 - DNA, 20 bp, Artificial Sequence
  Description of Artificial Sequence: Synthetic oligonucleotide
  Target: ATXN1; (-) strand; PAM type: NRG; PAM sequence: AAG
tccgttaacaaaaaaattaa

SEQ ID NO: 84273 - DNA, 20 bp, Artificial Sequence
  Description of Artificial Sequence: Synthetic oligonucleotide
  Target: ATXN1; (-) strand; PAM type: NRG; PAM sequence: GGG
taccggctggtatatgatat

SEQ ID NO: 84274 - DNA, 20 bp, Artificial Sequence
  Description of Artificial Sequence: Synthetic oligonucleotide
  Target: ATXN1; (-) strand; PAM type: NRG; PAM sequence: TGG
gtaccggctggtatatgata

SEQ ID NO: 84275 - DNA, 20 bp, Artificial Sequence
  Description of Artificial Sequence: Synthetic oligonucleotide
  Target: ATXN1; (-) strand; PAM type: NRG; PAM sequence: TGG
atcctatggaacgtaccggc

SEQ ID NO: 84276 - DNA, 20 bp, Artificial Sequence
  Description of Artificial Sequence: Synthetic oligonucleotide
  Target: ATXN1; (-) strand; PAM type: NRG; PAM sequence: CGG
taacatcctatggaacgtac

SEQ ID NO: 84277 - DNA, 20 bp, Artificial Sequence
  Description of Artificial Sequence: Synthetic oligonucleotide
  Target: ATXN1; (-) strand; PAM type: NRG; PAM sequence: TGG
caatggaatataacatccta

SEQ ID NO: 84278 - DNA, 20 bp, Artificial Sequence
  Description of Artificial Sequence: Synthetic oligonucleotide
  Target: ATXN1; (-) strand; PAM type: NRG; PAM sequence: TGG
cacaacataatgttccacaa

SEQ ID NO: 84279 - DNA, 20 bp, Artificial Sequence
  Description of Artificial Sequence: Synthetic oligonucleotide
  Target: ATXN1; (-) strand; PAM type: NRG; PAM sequence: TGG
ttttatcctccttttaattt

SEQ ID NO: 84280 - DNA, 20 bp, Artificial Sequence
  Description of Artificial Sequence: Synthetic oligonucleotide
  Target: ATXN1; (-) strand; PAM type: NRG; PAM sequence: AAG
tgaacatatgagaccctcca

SEQ ID NO: 84281 - DNA, 20 bp, Artificial Sequence
  Description of Artificial Sequence: Synthetic oligonucleotide
  Target: ATXN1; (-) strand; PAM type: NRG; PAM sequence: GAG
tacaatacacatgaacatat

SEQ ID NO: 84282 - DNA, 20 bp, Artificial Sequence
  Description of Artificial Sequence: Synthetic oligonucleotide
  Target: ATXN1; (-) strand; PAM type: NRG; PAM sequence: TAG
atgagtgctttctcccctca

SEQ ID NO: 84283 - DNA, 20 bp, Artificial Sequence
  Description of Artificial Sequence: Synthetic oligonucleotide
  Target: ATXN1; (-) strand; PAM type: NRG; PAM sequence: GAG
aatatattttgggcctagat

SEQ ID NO: 84284 - DNA, 20 bp, Artificial Sequence
  Description of Artificial Sequence: Synthetic oligonucleotide
  Target: ATXN1; (-) strand; PAM type: NRG; PAM sequence: TAG
ggtaaaatatattttgggcc

SEQ ID NO: 84285 - DNA, 20 bp, Artificial Sequence
  Description of Artificial Sequence: Synthetic oligonucleotide
  Target: ATXN1; (-) strand; PAM type: NRG; PAM sequence: GGG
tctgtggtaaaatatatttt

SEQ ID NO: 84286 - DNA, 20 bp, Artificial Sequence
  Description of Artificial Sequence: Synthetic oligonucleotide
  Target: ATXN1; (-) strand; PAM type: NRG; PAM sequence: TGG
ttctgtggtaaaatatattt

SEQ ID NO: 84287 - DNA, 20 bp, Artificial Sequence
  Description of Artificial Sequence: Synthetic oligonucleotide
  Target: ATXN1; (-) strand; PAM type: NRG; PAM sequence: TGG
cttctggaaaaagtgttctg

SEQ ID NO: 84288 - DNA, 20 bp, Artificial Sequence
  Description of Artificial Sequence: Synthetic oligonucleotide
  Target: ATXN1; (-) strand; PAM type: NRG; PAM sequence: AAG
tttcacctttcttctggaaa

SEQ ID NO: 84289 - DNA, 20 bp, Artificial Sequence
  Description of Artificial Sequence: Synthetic oligonucleotide
  Target: ATXN1; (-) strand; PAM type: NRG; PAM sequence: TGG
cactggtttcacctttcttc

SEQ ID NO: 84290 - DNA, 20 bp, Artificial Sequence
  Description of Artificial Sequence: Synthetic oligonucleotide
  Target: ATXN1; (-) strand; PAM type: NRG; PAM sequence: TGG
tgtctacaccctgtgtccac

SEQ ID NO: 84291 - DNA, 20 bp, Artificial Sequence
  Description of Artificial Sequence: Synthetic oligonucleotide
  Target: ATXN1; (-) strand; PAM type: NRG; PAM sequence: CAG
gaccactggcctagtctggt

SEQ ID NO: 84292 - DNA, 20 bp, Artificial Sequence
  Description of Artificial Sequence: Synthetic oligonucleotide
  Target: ATXN1; (-) strand; PAM type: NRG; PAM sequence: TGG
tgaggaccactggcctagtc

SEQ ID NO: 84293 - DNA, 20 bp, Artificial Sequence
  Description of Artificial Sequence: Synthetic oligonucleotide
  Target: ATXN1; (-) strand; PAM type: NRG; PAM sequence: TAG
aagtgtgaggaccactggcc

SEQ ID NO: 84294 - DNA, 20 bp, Artificial Sequence
  Description of Artificial Sequence: Synthetic oligonucleotide
  Target: ATXN1; (-) strand; PAM type: NRG; PAM sequence: TGG
accaaaagtgtgaggaccac

SEQ ID NO: 84295 - DNA, 20 bp, Artificial Sequence
  Description of Artificial Sequence: Synthetic oligonucleotide
  Target: ATXN1; (-) strand; PAM type: NRG; PAM sequence: AGG
gtgtgaggaccaaaagtgtg

SEQ ID NO: 84296 - DNA, 20 bp, Artificial Sequence
  Description of Artificial Sequence: Synthetic oligonucleotide
  Target: ATXN1; (-) strand; PAM type: NRG; PAM sequence: GAG
agtgtgaggaccaaaagtgt

SEQ ID NO: 84297 - DNA, 20 bp, Artificial Sequence
  Description of Artificial Sequence: Synthetic oligonucleotide
  Target: ATXN1; (-) strand; PAM type: NRG; PAM sequence: AAG
cttttaagtgtgaggaccaa

SEQ ID NO: 84298 - DNA, 20 bp, Artificial Sequence
  Description of Artificial Sequence: Synthetic oligonucleotide
  Target: ATXN1; (-) strand; PAM type: NRG; PAM sequence: AGG
ccaaggagcttttaagtgtg

SEQ ID NO: 84299 - DNA, 20 bp, Artificial Sequence
  Description of Artificial Sequence: Synthetic oligonucleotide
  Target: ATXN1; (-) strand; PAM type: NRG; PAM sequence: GAG
cccaaggagcttttaagtgt

SEQ ID NO: 84300 - DNA, 20 bp, Artificial Sequence
  Description of Artificial Sequence: Synthetic oligonucleotide
  Target: ATXN1; (-) strand; PAM type: NRG; PAM sequence: AAG
tgaggacccaaggagctttt

SEQ ID NO: 84301 - DNA, 20 bp, Artificial Sequence
  Description of Artificial Sequence: Synthetic oligonucleotide
  Target: ATXN1; (-) strand; PAM type: NRG; PAM sequence: GAG
aaatttattgaggacccaag

SEQ ID NO: 84302 - DNA, 20 bp, Artificial Sequence
  Description of Artificial Sequence: Synthetic oligonucleotide
  Target: ATXN1; (-) strand; PAM type: NRG; PAM sequence: AGG
taaaatttattgaggaccca

SEQ ID NO: 84303 - DNA, 20 bp, Artificial Sequence
  Description of Artificial Sequence: Synthetic oligonucleotide
  Target: ATXN1; (-) strand; PAM type: NRG; PAM sequence: AAG
ttaaaatttattgaggaccc

SEQ ID NO: 84304 - DNA, 20 bp, Artificial Sequence
  Description of Artificial Sequence: Synthetic oligonucleotide
  Target: ATXN1; (-) strand; PAM type: NRG; PAM sequence: AGG
tatactcttaaaatttattg

SEQ ID NO: 84305 - DNA, 20 bp, Artificial Sequence
  Description of Artificial Sequence: Synthetic oligonucleotide
  Target: ATXN1; (-) strand; PAM type: NRG; PAM sequence: GAG
ttatactcttaaaatttatt

SEQ ID NO: 84306 - DNA, 20 bp, Artificial Sequence
  Description of Artificial Sequence: Synthetic oligonucleotide
  Target: ATXN1; (-) strand; PAM type: NRG; PAM sequence: AGG
aataaattttaggagtatag

SEQ ID NO: 84307 - DNA, 20 bp, Artificial Sequence
  Description of Artificial Sequence: Synthetic oligonucleotide
  Target: ATXN1; (-) strand; PAM type: NRG; PAM sequence: GAG
caataaattttaggagtata

SEQ ID NO: 84308 - DNA, 20 bp, Artificial Sequence
  Description of Artificial Sequence: Synthetic oligonucleotide
  Target: ATXN1; (-) strand; PAM type: NRG; PAM sequence: TAG
ctcaataaattttaggagta

SEQ ID NO: 84309 - DNA, 20 bp, Artificial Sequence
  Description of Artificial Sequence: Synthetic oligonucleotide
  Target: ATXN1; (-) strand; PAM type: NRG; PAM sequence: GAG
gggtcctcaataaattttag

SEQ ID NO: 84310 - DNA, 20 bp, Artificial Sequence
  Description of Artificial Sequence: Synthetic oligonucleotide
  Target: ATXN1; (-) strand; PAM type: NRG; PAM sequence: AGG
tggggtcctcaataaatttt

SEQ ID NO: 84311 - DNA, 20 bp, Artificial Sequence
  Description of Artificial Sequence: Synthetic oligonucleotide
  Target: ATXN1; (-) strand; PAM type: NRG; PAM sequence: TAG
ttggggtcctcaataaattt

SEQ ID NO: 84312 - DNA, 20 bp, Artificial Sequence
  Description of Artificial Sequence: Synthetic oligonucleotide
  Target: ATXN1; (-) strand; PAM type: NRG; PAM sequence: GGG
acctaatgaaaagttccttg

SEQ ID NO: 84313 - DNA, 20 bp, Artificial Sequence
  Description of Artificial Sequence: Synthetic oligonucleotide
  Target: ATXN1; (-) strand; PAM type: NRG; PAM sequence: GGG
tacctaatgaaaagttcctt

SEQ ID NO: 84314 - DNA, 20 bp, Artificial Sequence
  Description of Artificial Sequence: Synthetic oligonucleotide
  Target: ATXN1; (-) strand; PAM type: NRG; PAM sequence: TGG
ctacctaatgaaaagttcct

SEQ ID NO: 84315 - DNA, 20 bp, Artificial Sequence
  Description of Artificial Sequence: Synthetic oligonucleotide
  Target: ATXN1; (-) strand; PAM type: NRG; PAM sequence: AAG
aatatgatctacctaatgaa

SEQ ID NO: 84316 - DNA, 20 bp, Artificial Sequence
  Description of Artificial Sequence: Synthetic oligonucleotide
  Target: ATXN1; (-) strand; PAM type: NRG; PAM sequence: TAG
ttgcttctaatatggtataa

SEQ ID NO: 84317 - DNA, 20 bp, Artificial Sequence
  Description of Artificial Sequence: Synthetic oligonucleotide
  Target: ATXN1; (-) strand; PAM type: NRG; PAM sequence: TGG
tctcaattttgcttctaata

SEQ ID NO: 84318 - DNA, 20 bp, Artificial Sequence
  Description of Artificial Sequence: Synthetic oligonucleotide
  Target: ATXN1; (-) strand; PAM type: NRG; PAM sequence: TAG
gtagtatgcaatgggtatat

SEQ ID NO: 84319 - DNA, 20 bp, Artificial Sequence
  Description of Artificial Sequence: Synthetic oligonucleotide
  Target: ATXN1; (-) strand; PAM type: NRG; PAM sequence: GGG
tatttcatgtagtatgcaat

SEQ ID NO: 84320 - DNA, 20 bp, Artificial Sequence
  Description of Artificial Sequence: Synthetic oligonucleotide
  Target: ATXN1; (-) strand; PAM type: NRG; PAM sequence: TGG
ttatttcatgtagtatgcaa

SEQ ID NO: 84321 - DNA, 20 bp, Artificial Sequence
  Description of Artificial Sequence: Synthetic oligonucleotide
  Target: ATXN1; (-) strand; PAM type: NRG; PAM sequence: TAG
cataaagatgttatttcatg

SEQ ID NO: 84322 - DNA, 20 bp, Artificial Sequence
  Description of Artificial Sequence: Synthetic oligonucleotide
  Target: ATXN1; (-) strand; PAM type: NRG; PAM sequence: AAG
aatataattattttttcata

SEQ ID NO: 84323 - DNA, 20 bp, Artificial Sequence
  Description of Artificial Sequence: Synthetic oligonucleotide
  Target: ATXN1; (-) strand; PAM type: NRG; PAM sequence: TGG
gagagctgcaaaaatctaaa

SEQ ID NO: 84324 - DNA, 20 bp, Artificial Sequence
  Description of Artificial Sequence: Synthetic oligonucleotide
  Target: ATXN1; (-) strand; PAM type: NRG; PAM sequence: GAG
attaagccaggcattaaaga

SEQ ID NO: 84325 - DNA, 20 bp, Artificial Sequence
  Description of Artificial Sequence: Synthetic oligonucleotide
  Target: ATXN1; (-) strand; PAM type: NRG; PAM sequence: GAG
ccattaagccaggcattaaa

SEQ ID NO: 84326 - DNA, 20 bp, Artificial Sequence
  Description of Artificial Sequence: Synthetic oligonucleotide
  Target: ATXN1; (-) strand; PAM type: NRG; PAM sequence: AAG
ttccattaagccaggcatta

SEQ ID NO: 84327 - DNA, 20 bp, Artificial Sequence
  Description of Artificial Sequence: Synthetic oligonucleotide
  Target: ATXN1; (-) strand; PAM type: NRG; PAM sequence: AGG
taaccattttccattaagcc

SEQ ID NO: 84328 - DNA, 20 bp, Artificial Sequence
  Description of Artificial Sequence: Synthetic oligonucleotide
  Target: ATXN1; (-) strand; PAM type: NRG; PAM sequence: CAG
ttaaccattttccattaagc

SEQ ID NO: 84329 - DNA, 20 bp, Artificial Sequence
  Description of Artificial Sequence: Synthetic oligonucleotide
  Target: ATXN1; (-) strand; PAM type: NRG; PAM sequence: AAG
gaatttaaccattttccatt

SEQ ID NO: 84330 - DNA, 20 bp, Artificial Sequence
  Description of Artificial Sequence: Synthetic oligonucleotide
  Target: ATXN1; (-) strand; PAM type: NRG; PAM sequence: GAG
ctgaattcagaggcacagaa

SEQ ID NO: 84331 - DNA, 20 bp, Artificial Sequence
  Description of Artificial Sequence: Synthetic oligonucleotide
  Target: ATXN1; (-) strand; PAM type: NRG; PAM sequence: AAG
aactgaattcagaggcacag

SEQ ID NO: 84332 - DNA, 20 bp, Artificial Sequence
  Description of Artificial Sequence: Synthetic oligonucleotide
  Target: ATXN1; (-) strand; PAM type: NRG; PAM sequence: CAG
gaaaactgaattcagaggca

SEQ ID NO: 84333 - DNA, 20 bp, Artificial Sequence
  Description of Artificial Sequence: Synthetic oligonucleotide
  Target: ATXN1; (-) strand; PAM type: NRG; PAM sequence: AGG
tcacagaaaactgaattcag

SEQ ID NO: 84334 - DNA, 20 bp, Artificial Sequence
  Description of Artificial Sequence: Synthetic oligonucleotide
  Target: ATXN1; (-) strand; PAM type: NRG; PAM sequence: GAG
atcacagaaaactgaattca

SEQ ID NO: 84335 - DNA, 20 bp, Artificial Sequence
  Description of Artificial Sequence: Synthetic oligonucleotide
  Target: ATXN1; (-) strand; PAM type: NRG; PAM sequence: CAG
atatcacagaaaactgaatt

SEQ ID NO: 84336 - DNA, 20 bp, Artificial Sequence
  Description of Artificial Sequence: Synthetic oligonucleotide
  Target: ATXN1; (-) strand; PAM type: NRG; PAM sequence: CAG
ttcaaccaaacaacatatca

SEQ ID NO: 84337 - DNA, 20 bp, Artificial Sequence
  Description of Artificial Sequence: Synthetic oligonucleotide
  Target: ATXN1; (-) strand; PAM type: NRG; PAM sequence: TGG
tccacaattgctgaaactat

SEQ ID NO: 84338 - DNA, 20 bp, Artificial Sequence
  Description of Artificial Sequence: Synthetic oligonucleotide
  Target: ATXN1; (-) strand; PAM type: NRG; PAM sequence: AAG
gttttggtatgatataaaaa

SEQ ID NO: 84339 - DNA, 20 bp, Artificial Sequence
  Description of Artificial Sequence: Synthetic oligonucleotide
  Target: ATXN1; (-) strand; PAM type: NRG; PAM sequence: TGG
aactaccacttattgagttt

SEQ ID NO: 84340 - DNA, 20 bp, Artificial Sequence
  Description of Artificial Sequence: Synthetic oligonucleotide
  Target: ATXN1; (-) strand; PAM type: NRG; PAM sequence: GAG
ttaagaaactaccacttatt

SEQ ID NO: 84341 - DNA, 20 bp, Artificial Sequence
  Description of Artificial Sequence: Synthetic oligonucleotide
  Target: ATXN1; (-) strand; PAM type: NRG; PAM sequence: AAG
ccatggtgctgctccccttt

SEQ ID NO: 84342 - DNA, 20 bp, Artificial Sequence
  Description of Artificial Sequence: Synthetic oligonucleotide
  Target: ATXN1; (-) strand; PAM type: NRG; PAM sequence: TGG
tttctatgcttcagattcca

SEQ ID NO: 84343 - DNA, 20 bp, Artificial Sequence
  Description of Artificial Sequence: Synthetic oligonucleotide
  Target: ATXN1; (-) strand; PAM type: NRG; PAM sequence: CAG
tagagtttatttctatgctt

SEQ ID NO: 84344 - DNA, 20 bp, Artificial Sequence
  Description of Artificial Sequence: Synthetic oligonucleotide
  Target: ATXN1; (-) strand; PAM type: NRG; PAM sequence: GAG
ttaatataaaagaatactta

SEQ ID NO: 84345 - DNA, 20 bp, Artificial Sequence
  Description of Artificial Sequence: Synthetic oligonucleotide
  Target: ATXN1; (-) strand; PAM type: NRG; PAM sequence: TAG
ttttaatataaaagaatact

SEQ ID NO: 84346 - DNA, 20 bp, Artificial Sequence
  Description of Artificial Sequence: Synthetic oligonucleotide
  Target: ATXN1; (-) strand; PAM type: NRG; PAM sequence: AAG
actaatgaattttaatataa

SEQ ID NO: 84347 - DNA, 20 bp, Artificial Sequence
  Description of Artificial Sequence: Synthetic oligonucleotide
  Target: ATXN1; (-) strand; PAM type: NRG; PAM sequence: TAG
gatccatccaaagttcaaga

SEQ ID NO: 84348 - DNA, 20 bp, Artificial Sequence
  Description of Artificial Sequence: Synthetic oligonucleotide
  Target: ATXN1; (-) strand; PAM type: NRG; PAM sequence: AAG
taaagatccatccaaagttc

SEQ ID NO: 84349 - DNA, 20 bp, Artificial Sequence
  Description of Artificial Sequence: Synthetic oligonucleotide
  Target: ATXN1; (-) strand; PAM type: NRG; PAM sequence: AAG
catagctaaagatccatcca

SEQ ID NO: 84350 - DNA, 20 bp, Artificial Sequence
  Description of Artificial Sequence: Synthetic oligonucleotide
  Target: ATXN1; (-) strand; PAM type: NRG; PAM sequence: AAG
tacaaaatcatgcatagcta

SEQ ID NO: 84351 - DNA, 20 bp, Artificial Sequence
  Description of Artificial Sequence: Synthetic oligonucleotide
  Target: ATXN1; (-) strand; PAM type: NRG; PAM sequence: TAG
tgatgttacaaaatcatgca

SEQ ID NO: 84352 - DNA, 20 bp, Artificial Sequence
  Description of Artificial Sequence: Synthetic oligonucleotide
  Target: ATXN1; (-) strand; PAM type: NRG; PAM sequence: GGG
tataattttccaaatgacca

SEQ ID NO: 84353 - DNA, 20 bp, Artificial Sequence
  Description of Artificial Sequence: Synthetic oligonucleotide
  Target: ATXN1; (-) strand; PAM type: NRG; PAM sequence: AGG
atataattttccaaatgacc

SEQ ID NO: 84354 - DNA, 20 bp, Artificial Sequence
  Description of Artificial Sequence: Synthetic oligonucleotide
  Target: ATXN1; (-) strand; PAM type: NRG; PAM sequence: CAG
aatataattttccaaatgac

SEQ ID NO: 84355 - DNA, 20 bp, Artificial Sequence
  Description of Artificial Sequence: Synthetic oligonucleotide
  Target: ATXN1; (-) strand; PAM type: NRG; PAM sequence: AAG
tgaaatgtgtcaacttttgg

SEQ ID NO: 84356 - DNA, 20 bp, Artificial Sequence
  Description of Artificial Sequence: Synthetic oligonucleotide
  Target: ATXN1; (-) strand; PAM type: NRG; PAM sequence: TGG
taatgaaatgtgtcaacttt

SEQ ID NO: 84357 - DNA, 20 bp, Artificial Sequence
  Description of Artificial Sequence: Synthetic oligonucleotide
  Target: ATXN1; (-) strand; PAM type: NRG; PAM sequence: AGG
tgtacagcggagtttttcag

SEQ ID NO: 84358 - DNA, 20 bp, Artificial Sequence
  Description of Artificial Sequence: Synthetic oligonucleotide
  Target: ATXN1; (-) strand; PAM type: NRG; PAM sequence: GAG
gtgtacagcggagtttttca

SEQ ID NO: 84359 - DNA, 20 bp, Artificial Sequence
  Description of Artificial Sequence: Synthetic oligonucleotide
  Target: ATXN1; (-) strand; PAM type: NRG; PAM sequence: CAG
atgtgtacagcggagttttt

SEQ ID NO: 84360 - DNA, 20 bp, Artificial Sequence
  Description of Artificial Sequence: Synthetic oligonucleotide
  Target: ATXN1; (-) strand; PAM type: NRG; PAM sequence: GAG
tctcttccatgtgtacagcg

SEQ ID NO: 84361 - DNA, 20 bp, Artificial Sequence
  Description of Artificial Sequence: Synthetic oligonucleotide
  Target: ATXN1; (-) strand; PAM type: NRG; PAM sequence: CGG
attctcttccatgtgtacag

SEQ ID NO: 84362 - DNA, 20 bp, Artificial Sequence
  Description of Artificial Sequence: Synthetic oligonucleotide
  Target: ATXN1; (-) strand; PAM type: NRG; PAM sequence: CAG
cccattctcttccatgtgta

SEQ ID NO: 84363 - DNA, 20 bp, Artificial Sequence
  Description of Artificial Sequence: Synthetic oligonucleotide
  Target: ATXN1; (-) strand; PAM type: NRG; PAM sequence: AAG
attatttttatggtaatact

SEQ ID NO: 84364 - DNA, 20 bp, Artificial Sequence
  Description of Artificial Sequence: Synthetic oligonucleotide
  Target: ATXN1; (-) strand; PAM type: NRG; PAM sequence: TGG
taagatcaagattattttta

SEQ ID NO: 84365 - DNA, 20 bp, Artificial Sequence
  Description of Artificial Sequence: Synthetic oligonucleotide
  Target: ATXN1; (-) strand; PAM type: NRG; PAM sequence: AAG
ggagggacatctgtaagatc

SEQ ID NO: 84366 - DNA, 20 bp, Artificial Sequence
  Description of Artificial Sequence: Synthetic oligonucleotide
  Target: ATXN1; (-) strand; PAM type: NRG; PAM sequence: AAG
ttttctggagggacatctgt

SEQ ID NO: 84367 - DNA, 20 bp, Artificial Sequence
  Description of Artificial Sequence: Synthetic oligonucleotide
  Target: ATXN1; (-) strand; PAM type: NRG; PAM sequence: GGG
cacccaagaccttttctgga

SEQ ID NO: 84368 - DNA, 20 bp, Artificial Sequence
  Description of Artificial Sequence: Synthetic oligonucleotide
  Target: ATXN1; (-) strand; PAM type: NRG; PAM sequence: AGG
ccacccaagaccttttctgg

SEQ ID NO: 84369 - DNA, 20 bp, Artificial Sequence
  Description of Artificial Sequence: Synthetic oligonucleotide
  Target: ATXN1; (-) strand; PAM type: NRG; PAM sequence: GAG
cccacccaagaccttttctg

SEQ ID NO: 84370 - DNA, 20 bp, Artificial Sequence
  Description of Artificial Sequence: Synthetic oligonucleotide
  Target: ATXN1; (-) strand; PAM type: NRG; PAM sequence: TGG
cccccacccaagaccttttc

SEQ ID NO: 84371 - DNA, 20 bp, Artificial Sequence
  Description of Artificial Sequence: Synthetic oligonucleotide
  Target: ATXN1; (-) strand; PAM type: NRG; PAM sequence: AAG
gaacccccccacccccaccc

SEQ ID NO: 84372 - DNA, 20 bp, Artificial Sequence
  Description of Artificial Sequence: Synthetic oligonucleotide
  Target: ATXN1; (-) strand; PAM type: NRG; PAM sequence: GGG
tggtcagcagttctcacttt

SEQ ID NO: 84373 - DNA, 20 bp, Artificial Sequence
  Description of Artificial Sequence: Synthetic oligonucleotide
  Target: ATXN1; (-) strand; PAM type: NRG; PAM sequence: TGG
ctggtcagcagttctcactt

SEQ ID NO: 84374 - DNA, 20 bp, Artificial Sequence
  Description of Artificial Sequence: Synthetic oligonucleotide
  Target: ATXN1; (-) strand; PAM type: NRG; PAM sequence: CAG
tagaatgtctgcctggtcag

SEQ ID NO: 84375 - DNA, 20 bp, Artificial Sequence
  Description of Artificial Sequence: Synthetic oligonucleotide
  Target: ATXN1; (-) strand; PAM type: NRG; PAM sequence: CAG
gtttagaatgtctgcctggt

SEQ ID NO: 84376 - DNA, 20 bp, Artificial Sequence
  Description of Artificial Sequence: Synthetic oligonucleotide
  Target: ATXN1; (-) strand; PAM type: NRG; PAM sequence: TGG
tggggtttagaatgtctgcc

SEQ ID NO: 84377 - DNA, 20 bp, Artificial Sequence
  Description of Artificial Sequence: Synthetic oligonucleotide
  Target: ATXN1; (-) strand; PAM type: NRG; PAM sequence: TAG
cagtagggatctgtggggtt

SEQ ID NO: 84378 - DNA, 20 bp, Artificial Sequence
  Description of Artificial Sequence: Synthetic oligonucleotide
  Target: ATXN1; (-) strand; PAM type: NRG; PAM sequence: GGG
acttccagtagggatctgtg

SEQ ID NO: 84379 - DNA, 20 bp, Artificial Sequence
  Description of Artificial Sequence: Synthetic oligonucleotide
  Target: ATXN1; (-) strand; PAM type: NRG; PAM sequence: GGG
tacttccagtagggatctgt

SEQ ID NO: 84380 - DNA, 20 bp, Artificial Sequence
  Description of Artificial Sequence: Synthetic oligonucleotide
  Target: ATXN1; (-) strand; PAM type: NRG; PAM sequence: TGG
ttacttccagtagggatctg

SEQ ID NO: 84381 - DNA, 20 bp, Artificial Sequence
  Description of Artificial Sequence: Synthetic oligonucleotide
  Target: ATXN1; (-) strand; PAM type: NRG; PAM sequence: GGG
ctgtgcttttacttccagta

SEQ ID NO: 84382 - DNA, 20 bp, Artificial Sequence
  Description of Artificial Sequence: Synthetic oligonucleotide
  Target: ATXN1; (-) strand; PAM type: NRG; PAM sequence: AGG
tctgtgcttttacttccagt

SEQ ID NO: 84383 - DNA, 20 bp, Artificial Sequence
  Description of Artificial Sequence: Synthetic oligonucleotide
  Target: ATXN1; (-) strand; PAM type: NRG; PAM sequence: TAG
ttctgtgcttttacttccag

SEQ ID NO: 84384 - DNA, 20 bp, Artificial Sequence
  Description of Artificial Sequence: Synthetic oligonucleotide
  Target: ATXN1; (-) strand; PAM type: NRG; PAM sequence: CAG
gagttctgtgcttttacttc

SEQ ID NO: 84385 - DNA, 20 bp, Artificial Sequence
  Description of Artificial Sequence: Synthetic oligonucleotide
  Target: ATXN1; (-) strand; PAM type: NRG; PAM sequence: GAG
tgaggccagaaggaaaccta

SEQ ID NO: 84386 - DNA, 20 bp, Artificial Sequence
  Description of Artificial Sequence: Synthetic oligonucleotide
  Target: ATXN1; (-) strand; PAM type: NRG; PAM sequence: TAG
attgaggccagaaggaaacc

SEQ ID NO: 84387 - DNA, 20 bp, Artificial Sequence
  Description of Artificial Sequence: Synthetic oligonucleotide
  Target: ATXN1; (-) strand; PAM type: NRG; PAM sequence: AGG
ttatggaaattgaggccaga

SEQ ID NO: 84388 - DNA, 20 bp, Artificial Sequence
  Description of Artificial Sequence: Synthetic oligonucleotide
  Target: ATXN1; (-) strand; PAM type: NRG; PAM sequence: AAG
attatggaaattgaggccag

SEQ ID NO: 84389 - DNA, 20 bp, Artificial Sequence
  Description of Artificial Sequence: Synthetic oligonucleotide
  Target: ATXN1; (-) strand; PAM type: NRG; PAM sequence: CAG
ggaattatggaaattgaggc

SEQ ID NO: 84390 - DNA, 20 bp, Artificial Sequence
  Description of Artificial Sequence: Synthetic oligonucleotide
  Target: ATXN1; (-) strand; PAM type: NRG; PAM sequence: AGG
ggtgggaattatggaaattg

SEQ ID NO: 84391 - DNA, 20 bp, Artificial Sequence
  Description of Artificial Sequence: Synthetic oligonucleotide
  Target: ATXN1; (-) strand; PAM type: NRG; PAM sequence: GAG
tggtgggaattatggaaatt

SEQ ID NO: 84392 - DNA, 20 bp, Artificial Sequence
  Description of Artificial Sequence: Synthetic oligonucleotide
  Target: ATXN1; (-) strand; PAM type: NRG; PAM sequence: TGG
aggacaaatggtgggaatta

SEQ ID NO: 84393 - DNA, 20 bp, Artificial Sequence
  Description of Artificial Sequence: Synthetic oligonucleotide
  Target: ATXN1; (-) strand; PAM type: NRG; PAM sequence: GGG
tccccaagaggacaaatggt

SEQ ID NO: 84394 - DNA, 20 bp, Artificial Sequence
  Description of Artificial Sequence: Synthetic oligonucleotide
  Target: ATXN1; (-) strand; PAM type: NRG; PAM sequence: TGG
atccccaagaggacaaatgg

SEQ ID NO: 84395 - DNA, 20 bp, Artificial Sequence
  Description of Artificial Sequence: Synthetic oligonucleotide
  Target: ATXN1; (-) strand; PAM type: NRG; PAM sequence: TGG
gtgatccccaagaggacaaa

SEQ ID NO: 84396 - DNA, 20 bp, Artificial Sequence
  Description of Artificial Sequence: Synthetic oligonucleotide
  Target: ATXN1; (-) strand; PAM type: NRG; PAM sequence: AGG
tgtactcagtgatccccaag

SEQ ID NO: 84397 - DNA, 20 bp, Artificial Sequence
  Description of Artificial Sequence: Synthetic oligonucleotide
  Target: ATXN1; (-) strand; PAM type: NRG; PAM sequence: GAG
ttgtactcagtgatccccaa

SEQ ID NO: 84398 - DNA, 20 bp, Artificial Sequence
  Description of Artificial Sequence: Synthetic oligonucleotide
  Target: ATXN1; (-) strand; PAM type: NRG; PAM sequence: AAG
ggttgtactcagtgatcccc

SEQ ID NO: 84399 - DNA, 20 bp, Artificial Sequence
  Description of Artificial Sequence: Synthetic oligonucleotide
  Target: ATXN1; (-) strand; PAM type: NRG; PAM sequence: CAG
ggtctttgttaggttgtact

SEQ ID NO: 84400 - DNA, 20 bp, Artificial Sequence
  Description of Artificial Sequence: Synthetic oligonucleotide
  Target: ATXN1; (-) strand; PAM type: NRG; PAM sequence: AGG
atgggttaatggtctttgtt

SEQ ID NO: 84401 - DNA, 20 bp, Artificial Sequence
  Description of Artificial Sequence: Synthetic oligonucleotide
  Target: ATXN1; (-) strand; PAM type: NRG; PAM sequence: TAG
catgggttaatggtctttgt

SEQ ID NO: 84402 - DNA, 20 bp, Artificial Sequence
  Description of Artificial Sequence: Synthetic oligonucleotide
  Target: ATXN1; (-) strand; PAM type: NRG; PAM sequence: TGG
ttcttgaccacatgggttaa

SEQ ID NO: 84403 - DNA, 20 bp, Artificial Sequence
  Description of Artificial Sequence: Synthetic oligonucleotide
  Target: ATXN1; (-) strand; PAM type: NRG; PAM sequence: GGG
tctcatgttcttgaccacat

SEQ ID NO: 84404 - DNA, 20 bp, Artificial Sequence
  Description of Artificial Sequence: Synthetic oligonucleotide
  Target: ATXN1; (-) strand; PAM type: NRG; PAM sequence: TGG
atctcatgttcttgaccaca

SEQ ID NO: 84405 - DNA, 20 bp, Artificial Sequence
  Description of Artificial Sequence: Synthetic oligonucleotide
  Target: ATXN1; (-) strand; PAM type: NRG; PAM sequence: TGG
tcttccctctggtgccctca

SEQ ID NO: 84406 - DNA, 20 bp, Artificial Sequence
  Description of Artificial Sequence: Synthetic oligonucleotide
  Target: ATXN1; (-) strand; PAM type: NRG; PAM sequence: TGG
ccacagataactcttccctc

SEQ ID NO: 84407 - DNA, 20 bp, Artificial Sequence
  Description of Artificial Sequence: Synthetic oligonucleotide
  Target: ATXN1; (-) strand; PAM type: NRG; PAM sequence: CAG
taaatacagttttccgccca

SEQ ID NO: 84408 - DNA, 20 bp, Artificial Sequence
  Description of Artificial Sequence: Synthetic oligonucleotide
  Target: ATXN1; (-) strand; PAM type: NRG; PAM sequence: CAG
tagtagaatccaagtaaata

SEQ ID NO: 84409 - DNA, 20 bp, Artificial Sequence
  Description of Artificial Sequence: Synthetic oligonucleotide
  Target: ATXN1; (-) strand; PAM type: NRG; PAM sequence: AAG
tttcttgcctagtagaatcc

SEQ ID NO: 84410 - DNA, 20 bp, Artificial Sequence
  Description of Artificial Sequence: Synthetic oligonucleotide
  Target: ATXN1; (-) strand; PAM type: NRG; PAM sequence: TAG
tctcacagtttcttgcctag

SEQ ID NO: 84411 - DNA, 20 bp, Artificial Sequence
  Description of Artificial Sequence: Synthetic oligonucleotide
  Target: ATXN1; (-) strand; PAM type: NRG; PAM sequence: TAG
acttctcacagtttcttgcc

SEQ ID NO: 84412 - DNA, 20 bp, Artificial Sequence
  Description of Artificial Sequence: Synthetic oligonucleotide
  Target: ATXN1; (-) strand; PAM type: NRG; PAM sequence: CAG
ttaaaaatgcacacttctca

SEQ ID NO: 84413 - DNA, 20 bp, Artificial Sequence
  Description of Artificial Sequence: Synthetic oligonucleotide
  Target: ATXN1; (-) strand; PAM type: NRG; PAM sequence: GGG
acaaaaagaaatgaagtgat

SEQ ID NO: 84414 - DNA, 20 bp, Artificial Sequence
  Description of Artificial Sequence: Synthetic oligonucleotide
  Target: ATXN1; (-) strand; PAM type: NRG; PAM sequence: TGG
aacaaaaagaaatgaagtga

SEQ ID NO: 84415 - DNA, 20 bp, Artificial Sequence
  Description of Artificial Sequence: Synthetic oligonucleotide
  Target: ATXN1; (-) strand; PAM type: NRG; PAM sequence: AAG
gtccctaacaaaaagaaatg

SEQ ID NO: 84416 - DNA, 20 bp, Artificial Sequence
  Description of Artificial Sequence: Synthetic oligonucleotide
  Target: ATXN1; (-) strand; PAM type: NRG; PAM sequence: AAG
tttggaatgtccctaacaaa

SEQ ID NO: 84417 - DNA, 20 bp, Artificial Sequence
  Description of Artificial Sequence: Synthetic oligonucleotide
  Target: ATXN1; (-) strand; PAM type: NRG; PAM sequence: TGG
aataactagaggaatgaatt

SEQ ID NO: 84418 - DNA, 20 bp, Artificial Sequence
  Description of Artificial Sequence: Synthetic oligonucleotide
  Target: ATXN1; (-) strand; PAM type: NRG; PAM sequence: AGG
gtatatttcaaaataactag

SEQ ID NO: 84419 - DNA, 20 bp, Artificial Sequence
  Description of Artificial Sequence: Synthetic oligonucleotide
  Target: ATXN1; (-) strand; PAM type: NRG; PAM sequence: GAG
tgtatatttcaaaataacta

SEQ ID NO: 84420 - DNA, 20 bp, Artificial Sequence
  Description of Artificial Sequence: Synthetic oligonucleotide
  Target: ATXN1; (-) strand; PAM type: NRG; PAM sequence: TAG
attgtatatttcaaaataac

SEQ ID NO: 84421 - DNA, 20 bp, Artificial Sequence
  Description of Artificial Sequence: Synthetic oligonucleotide
  Target: ATXN1; (-) strand; PAM type: NRG; PAM sequence: TAG
gtagcacaatagggcaacaa

SEQ ID NO: 84422 - DNA, 20 bp, Artificial Sequence
  Description of Artificial Sequence: Synthetic oligonucleotide
  Target: ATXN1; (-) strand; PAM type: NRG; PAM sequence: GGG
tagtgttcagtagcacaata

SEQ ID NO: 84423 - DNA, 20 bp, Artificial Sequence
  Description of Artificial Sequence: Synthetic oligonucleotide
  Target: ATXN1; (-) strand; PAM type: NRG; PAM sequence: AGG
ctagtgttcagtagcacaat

SEQ ID NO: 84424 - DNA, 20 bp, Artificial Sequence
  Description of Artificial Sequence: Synthetic oligonucleotide
  Target: ATXN1; (-) strand; PAM type: NRG; PAM sequence: TAG
gctagtgttcagtagcacaa

SEQ ID NO: 84425 - DNA, 20 bp, Artificial Sequence
  Description of Artificial Sequence: Synthetic oligonucleotide
  Target: ATXN1; (-) strand; PAM type: NRG; PAM sequence: TAG
gaataagagctagtgttcag

SEQ ID NO: 84426 - DNA, 20 bp, Artificial Sequence
  Description of Artificial Sequence: Synthetic oligonucleotide
  Target: ATXN1; (-) strand; PAM type: NRG; PAM sequence: CAG
taggaataagagctagtgtt

SEQ ID NO: 84427 - DNA, 20 bp, Artificial Sequence
  Description of Artificial Sequence: Synthetic oligonucleotide
  Target: ATXN1; (-) strand; PAM type: NRG; PAM sequence: TAG
tagatagtaggaataagagc

SEQ ID NO: 84428 - DNA, 20 bp, Artificial Sequence
  Description of Artificial Sequence: Synthetic oligonucleotide
  Target: ATXN1; (-) strand; PAM type: NRG; PAM sequence: GAG
tagttagatagtaggaataa

SEQ ID NO: 84429 - DNA, 20 bp, Artificial Sequence
  Description of Artificial Sequence: Synthetic oligonucleotide
  Target: ATXN1; (-) strand; PAM type: NRG; PAM sequence: AAG
tatagttagatagtaggaat

SEQ ID NO: 84430 - DNA, 20 bp, Artificial Sequence
  Description of Artificial Sequence: Synthetic oligonucleotide
  Target: ATXN1; (-) strand; PAM type: NRG; PAM sequence: AGG
taaaaatatagttagatagt

SEQ ID NO: 84431 - DNA, 20 bp, Artificial Sequence
  Description of Artificial Sequence: Synthetic oligonucleotide
  Target: ATXN1; (-) strand; PAM type: NRG; PAM sequence: TAG
ataaaaatatagttagatag

SEQ ID NO: 84432 - DNA, 20 bp, Artificial Sequence
  Description of Artificial Sequence: Synthetic oligonucleotide
  Target: ATXN1; (-) strand; PAM type: NRG; PAM sequence: TAG
gctataaaaatatagttaga

SEQ ID NO: 84433 - DNA, 20 bp, Artificial Sequence
  Description of Artificial Sequence: Synthetic oligonucleotide
  Target: ATXN1; (-) strand; PAM type: NRG; PAM sequence: TAG
agtggctataaaaatatagt

SEQ ID NO: 84434 - DNA, 20 bp, Artificial Sequence
  Description of Artificial Sequence: Synthetic oligonucleotide
  Target: ATXN1; (-) strand; PAM type: NRG; PAM sequence: TAG
ggttagtggctataaaaata

SEQ ID NO: 84435 - DNA, 20 bp, Artificial Sequence
  Description of Artificial Sequence: Synthetic oligonucleotide
  Target: ATXN1; (-) strand; PAM type: NRG; PAM sequence: TGG
aataaagagaggttggttag

SEQ ID NO: 84436 - DNA, 20 bp, Artificial Sequence
  Description of Artificial Sequence: Synthetic oligonucleotide
  Target: ATXN1; (-) strand; PAM type: NRG; PAM sequence: TAG
aggaataaagagaggttggt

SEQ ID NO: 84437 - DNA, 20 bp, Artificial Sequence
  Description of Artificial Sequence: Synthetic oligonucleotide
  Target: ATXN1; (-) strand; PAM type: NRG; PAM sequence: TGG
agggaggaataaagagaggt

SEQ ID NO: 84438 - DNA, 20 bp, Artificial Sequence
  Description of Artificial Sequence: Synthetic oligonucleotide
  Target: ATXN1; (-) strand; PAM type: NRG; PAM sequence: AGG
gaggagggaggaataaagag

SEQ ID NO: 84439 - DNA, 20 bp, Artificial Sequence
  Description of Artificial Sequence: Synthetic oligonucleotide
  Target: ATXN1; (-) strand; PAM type: NRG; PAM sequence: GAG
tgaggagggaggaataaaga

SEQ ID NO: 84440 - DNA, 20 bp, Artificial Sequence
  Description of Artificial Sequence: Synthetic oligonucleotide
  Target: ATXN1; (-) strand; PAM type: NRG; PAM sequence: GAG
agtgaggagggaggaataaa

SEQ ID NO: 84441 - DNA, 20 bp, Artificial Sequence
  Description of Artificial Sequence: Synthetic oligonucleotide
  Target: ATXN1; (-) strand; PAM type: NRG; PAM sequence: AAG
gtagtgaggagggaggaata

SEQ ID NO: 84442 - DNA, 20 bp, Artificial Sequence
  Description of Artificial Sequence: Synthetic oligonucleotide
  Target: ATXN1; (-) strand; PAM type: NRG; PAM sequence: AGG
ggaaagggtagtgaggaggg

SEQ ID NO: 84443 - DNA, 20 bp, Artificial Sequence
  Description of Artificial Sequence: Synthetic oligonucleotide
  Target: ATXN1; (-) strand; PAM type: NRG; PAM sequence: GAG
tggaaagggtagtgaggagg

SEQ ID NO: 84444 - DNA, 20 bp, Artificial Sequence
  Description of Artificial Sequence: Synthetic oligonucleotide
  Target: ATXN1; (-) strand; PAM type: NRG; PAM sequence: GGG
gatggaaagggtagtgagga

SEQ ID NO: 84445 - DNA, 20 bp, Artificial Sequence
  Description of Artificial Sequence: Synthetic oligonucleotide
  Target: ATXN1; (-) strand; PAM type: NRG; PAM sequence: AGG
ggatggaaagggtagtgagg

SEQ ID NO: 84446 - DNA, 20 bp, Artificial Sequence
  Description of Artificial Sequence: Synthetic oligonucleotide
  Target: ATXN1; (-) strand; PAM type: NRG; PAM sequence: GAG
aggatggaaagggtagtgag

SEQ ID NO: 84447 - DNA, 20 bp, Artificial Sequence
  Description of Artificial Sequence: Synthetic oligonucleotide
  Target: ATXN1; (-) strand; PAM type: NRG; PAM sequence: AGG
agaggatggaaagggtagtg

SEQ ID NO: 84448 - DNA, 20 bp, Artificial Sequence
  Description of Artificial Sequence: Synthetic oligonucleotide
  Target: ATXN1; (-) strand; PAM type: NRG; PAM sequence: GAG
cagaggatggaaagggtagt

SEQ ID NO: 84449 - DNA, 20 bp, Artificial Sequence
  Description of Artificial Sequence: Synthetic oligonucleotide
  Target: ATXN1; (-) strand; PAM type: NRG; PAM sequence: TAG
ttagcagaggatggaaaggg

SEQ ID NO: 84450 - DNA, 20 bp, Artificial Sequence
  Description of Artificial Sequence: Synthetic oligonucleotide
  Target: ATXN1; (-) strand; PAM type: NRG; PAM sequence: GGG
tggttagcagaggatggaaa

SEQ ID NO: 84451 - DNA, 20 bp, Artificial Sequence
  Description of Artificial Sequence: Synthetic oligonucleotide
  Target: ATXN1; (-) strand; PAM type: NRG; PAM sequence: AGG
atggttagcagaggatggaa

SEQ ID NO: 84452 - DNA, 20 bp, Artificial Sequence
  Description of Artificial Sequence: Synthetic oligonucleotide
  Target: ATXN1; (-) strand; PAM type: NRG; PAM sequence: AAG
gatggttagcagaggatgga

SEQ ID NO: 84453 - DNA, 20 bp, Artificial Sequence
  Description of Artificial Sequence: Synthetic oligonucleotide
  Target: ATXN1; (-) strand; PAM type: NRG; PAM sequence: TGG
gaatgatggttagcagagga

SEQ ID NO: 84454 - DNA, 20 bp, Artificial Sequence
  Description of Artificial Sequence: Synthetic oligonucleotide
  Target: ATXN1; (-) strand; PAM type: NRG; PAM sequence: AGG
agtagaatgatggttagcag

SEQ ID NO: 84455 - DNA, 20 bp, Artificial Sequence
  Description of Artificial Sequence: Synthetic oligonucleotide
  Target: ATXN1; (-) strand; PAM type: NRG; PAM sequence: GAG
gagtagaatgatggttagca

SEQ ID NO: 84456 - DNA, 20 bp, Artificial Sequence
  Description of Artificial Sequence: Synthetic oligonucleotide
  Target: ATXN1; (-) strand; PAM type: NRG; PAM sequence: CAG
gagagtagaatgatggttag

SEQ ID NO: 84457 - DNA, 20 bp, Artificial Sequence
  Description of Artificial Sequence: Synthetic oligonucleotide
  Target: ATXN1; (-) strand; PAM type: NRG; PAM sequence: TAG
acagagagtagaatgatggt

SEQ ID NO: 84458 - DNA, 20 bp, Artificial Sequence
  Description of Artificial Sequence: Synthetic oligonucleotide
  Target: ATXN1; (-) strand; PAM type: NRG; PAM sequence: TGG
ggagacagagagtagaatga

SEQ ID NO: 84459 - DNA, 20 bp, Artificial Sequence
  Description of Artificial Sequence: Synthetic oligonucleotide
  Target: ATXN1; (-) strand; PAM type: NRG; PAM sequence: TAG
gacgtcatggagacagagag

SEQ ID NO: 84460 - DNA, 20 bp, Artificial Sequence
  Description of Artificial Sequence: Synthetic oligonucleotide
  Target: ATXN1; (-) strand; PAM type: NRG; PAM sequence: GAG
catgacgtcatggagacaga

SEQ ID NO: 84461 - DNA, 20 bp, Artificial Sequence
  Description of Artificial Sequence: Synthetic oligonucleotide
  Target: ATXN1; (-) strand; PAM type: NRG; PAM sequence: GAG
aacatgacgtcatggagaca

SEQ ID NO: 84462 - DNA, 20 bp, Artificial Sequence
  Description of Artificial Sequence: Synthetic oligonucleotide
  Target: ATXN1; (-) strand; PAM type: NRG; PAM sequence: CAG
gaaacatgacgtcatggaga

SEQ ID NO: 84463 - DNA, 20 bp, Artificial Sequence
  Description of Artificial Sequence: Synthetic oligonucleotide
  Target: ATXN1; (-) strand; PAM type: NRG; PAM sequence: GAG
ctaagaaacatgacgtcatg

SEQ ID NO: 84464 - DNA, 20 bp, Artificial Sequence
  Description of Artificial Sequence: Synthetic oligonucleotide
  Target: ATXN1; (-) strand; PAM type: NRG; PAM sequence: TGG
agctaagaaacatgacgtca

SEQ ID NO: 84465 - DNA, 20 bp, Artificial Sequence
  Description of Artificial Sequence: Synthetic oligonucleotide
  Target: ATXN1; (-) strand; PAM type: NRG; PAM sequence: AAG
ctcactcatatgagggagct

SEQ ID NO: 84466 - DNA, 20 bp, Artificial Sequence
  Description of Artificial Sequence: Synthetic oligonucleotide
  Target: ATXN1; (-) strand; PAM type: NRG; PAM sequence: GAG
atattctcactcatatgagg

SEQ ID NO: 84467 - DNA, 20 bp, Artificial Sequence
  Description of Artificial Sequence: Synthetic oligonucleotide
  Target: ATXN1; (-) strand; PAM type: NRG; PAM sequence: GGG
acatattctcactcatatga

SEQ ID NO: 84468 - DNA, 20 bp, Artificial Sequence
  Description of Artificial Sequence: Synthetic oligonucleotide
  Target: ATXN1; (-) strand; PAM type: NRG; PAM sequence: AGG
cacatattctcactcatatg

SEQ ID NO: 84469 - DNA, 20 bp, Artificial Sequence
  Description of Artificial Sequence: Synthetic oligonucleotide
  Target: ATXN1; (-) strand; PAM type: NRG; PAM sequence: GAG
tcacatattctcactcatat

SEQ ID NO: 84470 - DNA, 20 bp, Artificial Sequence
  Description of Artificial Sequence: Synthetic oligonucleotide
  Target: ATXN1; (-) strand; PAM type: NRG; PAM sequence: AAG
taaaataagccaggcacaga

SEQ ID NO: 84471 - DNA, 20 bp, Artificial Sequence
  Description of Artificial Sequence: Synthetic oligonucleotide
  Target: ATXN1; (-) strand; PAM type: NRG; PAM sequence: CAG
taagtaaaataagccaggca

SEQ ID NO: 84472 - DNA, 20 bp, Artificial Sequence
  Description of Artificial Sequence: Synthetic oligonucleotide
  Target: ATXN1; (-) strand; PAM type: NRG; PAM sequence: AGG
tatgttaagtaaaataagcc

SEQ ID NO: 84473 - DNA, 20 bp, Artificial Sequence
  Description of Artificial Sequence: Synthetic oligonucleotide
  Target: ATXN1; (-) strand; PAM type: NRG; PAM sequence: CAG
ttatgttaagtaaaataagc

SEQ ID NO: 84474 - DNA, 20 bp, Artificial Sequence
  Description of Artificial Sequence: Synthetic oligonucleotide
  Target: ATXN1; (-) strand; PAM type: NRG; PAM sequence: AAG
gacgttatgttaagtaaaat

SEQ ID NO: 84475 - DNA, 20 bp, Artificial Sequence
  Description of Artificial Sequence: Synthetic oligonucleotide
  Target: ATXN1; (-) strand; PAM type: NRG; PAM sequence: AAG
gaactggaagacgttatgtt

SEQ ID NO: 84476 - DNA, 20 bp, Artificial Sequence
  Description of Artificial Sequence: Synthetic oligonucleotide
  Target: ATXN1; (-) strand; PAM type: NRG; PAM sequence: AAG
aacaacatggctggaactgg

SEQ ID NO: 84477 - DNA, 20 bp, Artificial Sequence
  Description of Artificial Sequence: Synthetic oligonucleotide
  Target: ATXN1; (-) strand; PAM type: NRG; PAM sequence: TGG
tgtaacaacatggctggaac

SEQ ID NO: 84478 - DNA, 20 bp, Artificial Sequence
  Description of Artificial Sequence: Synthetic oligonucleotide
  Target: ATXN1; (-) strand; PAM type: NRG; PAM sequence: TGG
gtcatttgtaacaacatggc

SEQ ID NO: 84479 - DNA, 20 bp, Artificial Sequence
  Description of Artificial Sequence: Synthetic oligonucleotide
  Target: ATXN1; (-) strand; PAM type: NRG; PAM sequence: TGG
ttctgtcatttgtaacaaca

SEQ ID NO: 84480 - DNA, 20 bp, Artificial Sequence
  Description of Artificial Sequence: Synthetic oligonucleotide
  Target: ATXN1; (-) strand; PAM type: NRG; PAM sequence: AAG
aatattattcagccatacaa

SEQ ID NO: 84481 - DNA, 20 bp, Artificial Sequence
  Description of Artificial Sequence: Synthetic oligonucleotide
  Target: ATXN1; (-) strand; PAM type: NRG; PAM sequence: CAG
atacacagtggaatattatt

SEQ ID NO: 84482 - DNA, 20 bp, Artificial Sequence
  Description of Artificial Sequence: Synthetic oligonucleotide
  Target: ATXN1; (-) strand; PAM type: NRG; PAM sequence: TGG
aataaggtacatatacacag

SEQ ID NO: 84483 - DNA, 20 bp, Artificial Sequence
  Description of Artificial Sequence: Synthetic oligonucleotide
  Target: ATXN1; (-) strand; PAM type: NRG; PAM sequence: CAG
gaaaataaggtacatataca

SEQ ID NO: 84484 - DNA, 20 bp, Artificial Sequence
  Description of Artificial Sequence: Synthetic oligonucleotide
  Target: ATXN1; (-) strand; PAM type: NRG; PAM sequence: AGG
aggaatggataaagaaaata

SEQ ID NO: 84485 - DNA, 20 bp, Artificial Sequence
  Description of Artificial Sequence: Synthetic oligonucleotide
  Target: ATXN1; (-) strand; PAM type: NRG; PAM sequence: AAG
aaggaatggataaagaaaat

SEQ ID NO: 84486 - DNA, 20 bp, Artificial Sequence
  Description of Artificial Sequence: Synthetic oligonucleotide
  Target: ATXN1; (-) strand; PAM type: NRG; PAM sequence: AAG
catcaatgaaggaatggata

SEQ ID NO: 84487 - DNA, 20 bp, Artificial Sequence
  Description of Artificial Sequence: Synthetic oligonucleotide
  Target: ATXN1; (-) strand; PAM type: NRG; PAM sequence: TGG
agtctccatcaatgaaggaa

SEQ ID NO: 84488 - DNA, 20 bp, Artificial Sequence
  Description of Artificial Sequence: Synthetic oligonucleotide
  Target: ATXN1; (-) strand; PAM type: NRG; PAM sequence: AGG
atctaagtctccatcaatga

SEQ ID NO: 84489 - DNA, 20 bp, Artificial Sequence
  Description of Artificial Sequence: Synthetic oligonucleotide
  Target: ATXN1; (-) strand; PAM type: NRG; PAM sequence: AAG
aatctaagtctccatcaatg

SEQ ID NO: 84490 - DNA, 20 bp, Artificial Sequence
  Description of Artificial Sequence: Synthetic oligonucleotide
  Target: ATXN1; (-) strand; PAM type: NRG; PAM sequence: AAG
ccaagatatggaatcaatct

SEQ ID NO: 84491 - DNA, 20 bp, Artificial Sequence
  Description of Artificial Sequence: Synthetic oligonucleotide
  Target: ATXN1; (-) strand; PAM type: NRG; PAM sequence: TGG
tattcattatagccaagata

SEQ ID NO: 84492 - DNA, 20 bp, Artificial Sequence
  Description of Artificial Sequence: Synthetic oligonucleotide
  Target: ATXN1; (-) strand; PAM type: NRG; PAM sequence: AAG
tgcagctattcattatagcc

SEQ ID NO: 84493 - DNA, 20 bp, Artificial Sequence
  Description of Artificial Sequence: Synthetic oligonucleotide
  Target: ATXN1; (-) strand; PAM type: NRG; PAM sequence: TAG
tttgttgcagctattcatta

SEQ ID NO: 84494 - DNA, 20 bp, Artificial Sequence
  Description of Artificial Sequence: Synthetic oligonucleotide
  Target: ATXN1; (-) strand; PAM type: NRG; PAM sequence: CAG
ctgcactcccatgtttgttg

SEQ ID NO: 84495 - DNA, 20 bp, Artificial Sequence
  Description of Artificial Sequence: Synthetic oligonucleotide
  Target: ATXN1; (-) strand; PAM type: NRG; PAM sequence: GAG
aaggaaatcagtatattgaa

SEQ ID NO: 84496 - DNA, 20 bp, Artificial Sequence
  Description of Artificial Sequence: Synthetic oligonucleotide
  Target: ATXN1; (-) strand; PAM type: NRG; PAM sequence: AAG
gaaaggaaatcagtatattg

SEQ ID NO: 84497 - DNA, 20 bp, Artificial Sequence
  Description of Artificial Sequence: Synthetic oligonucleotide
  Target: ATXN1; (-) strand; PAM type: NRG; PAM sequence: CAG
atatccagaagaaaggaaat

SEQ ID NO: 84498 - DNA, 20 bp, Artificial Sequence
  Description of Artificial Sequence: Synthetic oligonucleotide
  Target: ATXN1; (-) strand; PAM type: NRG; PAM sequence: AGG
catgtatatatccagaagaa

SEQ ID NO: 84499 - DNA, 20 bp, Artificial Sequence
  Description of Artificial Sequence: Synthetic oligonucleotide
  Target: ATXN1; (-) strand; PAM type: NRG; PAM sequence: AAG
tcatgtatatatccagaaga

SEQ ID NO: 84500 - DNA, 20 bp, Artificial Sequence
  Description of Artificial Sequence: Synthetic oligonucleotide
  Target: ATXN1; (-) strand; PAM type: NRG; PAM sequence: AAG
aaagtcatgtatatatccag

SEQ ID NO: 84501 - DNA, 20 bp, Artificial Sequence
  Description of Artificial Sequence: Synthetic oligonucleotide
  Target: ATXN1; (-) strand; PAM type: NRG; PAM sequence: CAG
agaaaagtcatgtatatatc

SEQ ID NO: 84502 - DNA, 20 bp, Artificial Sequence
  Description of Artificial Sequence: Synthetic oligonucleotide
  Target: ATXN1; (-) strand; PAM type: NRG; PAM sequence: AAG
aaaagaaagaaagaaaagaa

SEQ ID NO: 84503 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaagaaagaaagaa

SEQ ID NO: 84504 - DNA, 20 bp, Artificial Sequence
  Description of Artificial Sequence: Synthetic oligonucleotide
  Target: ATXN1; (-) strand; PAM type: NRG; PAM sequence: AAG
actccaaaaaaaaagaaaga

SEQ ID NO: 84505 - DNA, 20 bp, Artificial Sequence
  Description of Artificial Sequence: Synthetic oligonucleotide
  Target: ATXN1; (-) strand; PAM type: NRG; PAM sequence: AAG
ctagactccaaaaaaaaaga

SEQ ID NO: 84506 - DNA, 20 bp, Artificial Sequence
  Description of Artificial Sequence: Synthetic oligonucleotide
  Target: ATXN1; (-) strand; PAM type: NRG; PAM sequence: AAG
acagctagactccaaaaaaa

SEQ ID NO: 84507 - DNA, 20 bp, Artificial Sequence
  Description of Artificial Sequence: Synthetic oligonucleotide
  Target: ATXN1; (-) strand; PAM type: NRG; PAM sequence: TAG
ctccagcctggtgacacagc

SEQ ID NO: 84508 - DNA, 20 bp, Artificial Sequence
  Description of Artificial Sequence: Synthetic oligonucleotide
  Target: ATXN1; (-) strand; PAM type: NRG; PAM sequence: CAG
tacactccagcctggtgaca

SEQ ID NO: 84509 - DNA, 20 bp, Artificial Sequence
  Description of Artificial Sequence: Synthetic oligonucleotide
  Target: ATXN1; (-) strand; PAM type: NRG; PAM sequence: TGG
cacagtactacactccagcc

SEQ ID NO: 84510 - DNA, 20 bp, Artificial Sequence
  Description of Artificial Sequence: Synthetic oligonucleotide
  Target: ATXN1; (-) strand; PAM type: NRG; PAM sequence: CAG
gagatcacagtactacactc

SEQ ID NO: 84511 - DNA, 20 bp, Artificial Sequence
  Description of Artificial Sequence: Synthetic oligonucleotide
  Target: ATXN1; (-) strand; PAM type: NRG; PAM sequence: CAG
gttgcagtgagctgagatca

SEQ ID NO: 84512 - DNA, 20 bp, Artificial Sequence
  Description of Artificial Sequence: Synthetic oligonucleotide
  Target: ATXN1; (-) strand; PAM type: NRG; PAM sequence: GAG
gtcagaggttgcagtgagct

SEQ ID NO: 84513 - DNA, 20 bp, Artificial Sequence
  Description of Artificial Sequence: Synthetic oligonucleotide
  Target: ATXN1; (-) strand; PAM type: NRG; PAM sequence: GAG
agggagtcagaggttgcagt

SEQ ID NO: 84514 - DNA, 20 bp, Artificial Sequence
  Description of Artificial Sequence: Synthetic oligonucleotide
  Target: ATXN1; (-) strand; PAM type: NRG; PAM sequence: CAG
aaccagggagtcagaggttg

SEQ ID NO: 84515 - DNA, 20 bp, Artificial Sequence
  Description of Artificial Sequence: Synthetic oligonucleotide
  Target: ATXN1; (-) strand; PAM type: NRG; PAM sequence: AGG
cactggaaccagggagtcag

SEQ ID NO: 84516 - DNA, 20 bp, Artificial Sequence
  Description of Artificial Sequence: Synthetic oligonucleotide
  Target: ATXN1; (-) strand; PAM type: NRG; PAM sequence: GAG
tcactggaaccagggagtca

SEQ ID NO: 84517 - DNA, 20 bp, Artificial Sequence
  Description of Artificial Sequence: Synthetic oligonucleotide
  Target: ATXN1; (-) strand; PAM type: NRG; PAM sequence: CAG
aatcactggaaccagggagt

SEQ ID NO: 84518 - DNA, 20 bp, Artificial Sequence
  Description of Artificial Sequence: Synthetic oligonucleotide
  Target: ATXN1; (-) strand; PAM type: NRG; PAM sequence: GAG
ggagaatcactggaaccagg

SEQ ID NO: 84519 - DNA, 20 bp, Artificial Sequence
  Description of Artificial Sequence: Synthetic oligonucleotide
  Target: ATXN1; (-) strand; PAM type: NRG; PAM sequence: GGG
caggagaatcactggaacca

SEQ ID NO: 84520 - DNA, 20 bp, Artificial Sequence
  Description of Artificial Sequence: Synthetic oligonucleotide
  Target: ATXN1; (-) strand; PAM type: NRG; PAM sequence: AGG
gcaggagaatcactggaacc

SEQ ID NO: 84521 - DNA, 20 bp, Artificial Sequence
  Description of Artificial Sequence: Synthetic oligonucleotide
  Target: ATXN1; (-) strand; PAM type: NRG; PAM sequence: CAG
ggcaggagaatcactggaac

SEQ ID NO: 84522 - DNA, 20 bp, Artificial Sequence
  Description of Artificial Sequence: Synthetic oligonucleotide
  Target: ATXN1; (-) strand; PAM type: NRG; PAM sequence: TGG
ggctgaggcaggagaatcac

SEQ ID NO: 84523 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgaggcag

SEQ ID NO: 84524 - DNA, 20 bp, Artificial Sequence
  Description of Artificial Sequence: Synthetic oligonucleotide
  Target: ATXN1; (-) strand; PAM type: NRG; PAM sequence: AGG
gctactcgggaggctgaggc

SEQ ID NO: 84525 - DNA, 20 bp, Artificial Sequence
  Description of Artificial Sequence: Synthetic oligonucleotide
  Target: ATXN1; (-) strand; PAM type: NRG; PAM sequence: CAG
agctactcgggaggctgagg

SEQ ID NO: 84526 - DNA, 20 bp, Artificial Sequence
  Description of Artificial Sequence: Synthetic oligonucleotide
  Target: ATXN1; (-) strand; PAM type: NRG; PAM sequence: AGG
cccagctactcgggaggctg

SEQ ID NO: 84527 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcgggaggct

SEQ ID NO: 84528 - DNA, 20 bp, Artificial Sequence
  Description of Artificial Sequence: Synthetic oligonucleotide
  Target: ATXN1; (-) strand; PAM type: NRG; PAM sequence: AGG
agtaatcccagctactcggg

SEQ ID NO: 84529 - DNA, 20 bp, Artificial Sequence
  Description of Artificial Sequence: Synthetic oligonucleotide
  Target: ATXN1; (-) strand; PAM type: NRG; PAM sequence: GAG
cagtaatcccagctactcgg

SEQ ID NO: 84530 - DNA, 20 bp, Artificial Sequence
  Description of Artificial Sequence: Synthetic oligonucleotide
  Target: ATXN1; (-) strand; PAM type: NRG; PAM sequence: GGG
gccagtaatcccagctactc

SEQ ID NO: 84531 - DNA, 20 bp, Artificial Sequence
  Description of Artificial Sequence: Synthetic oligonucleotide
  Target: ATXN1; (-) strand; PAM type: NRG; PAM sequence: CGG
tgccagtaatcccagctact

SEQ ID NO: 84532 - DNA, 20 bp, Artificial Sequence
  Description of Artificial Sequence: Synthetic oligonucleotide
  Target: ATXN1; (-) strand; PAM type: NRG; PAM sequence: CAG
gtggcatgtgccagtaatcc

SEQ ID NO: 84533 - DNA, 20 bp, Artificial Sequence
  Description of Artificial Sequence: Synthetic oligonucleotide
  Target: ATXN1; (-) strand; PAM type: NRG; PAM sequence: CAG
ctgagtgtggtggcatgtgc

SEQ ID NO: 84534 - DNA, 20 bp, Artificial Sequence
  Description of Artificial Sequence: Synthetic oligonucleotide
  Target: ATXN1; (-) strand; PAM type: NRG; PAM sequence: TGG
caaaaagtaactgagtgtgg

SEQ ID NO: 84535 - DNA, 20 bp, Artificial Sequence
  Description of Artificial Sequence: Synthetic oligonucleotide
  Target: ATXN1; (-) strand; PAM type: NRG; PAM sequence: TGG
atgcaaaaagtaactgagtg

SEQ ID NO: 84536 - DNA, 20 bp, Artificial Sequence
  Description of Artificial Sequence: Synthetic oligonucleotide
  Target: ATXN1; (-) strand; PAM type: NRG; PAM sequence: GAG
tataaatgcaaaaagtaact

SEQ ID NO: 84537 - DNA, 20 bp, Artificial Sequence
  Description of Artificial Sequence: Synthetic oligonucleotide
  Target: ATXN1; (-) strand; PAM type: NRG; PAM sequence: AAG
gtctctactataaatgcaaa

SEQ ID NO: 84538 - DNA, 20 bp, Artificial Sequence
  Description of Artificial Sequence: Synthetic oligonucleotide
  Target: ATXN1; (-) strand; PAM type: NRG; PAM sequence: TGG
caagaccatcctggccaaca

SEQ ID NO: 84539 - DNA, 20 bp, Artificial Sequence
  Description of Artificial Sequence: Synthetic oligonucleotide
  Target: ATXN1; (-) strand; PAM type: NRG; PAM sequence: TGG
tcaggagagcaagaccatcc

SEQ ID NO: 84540 - DNA, 20 bp, Artificial Sequence
  Description of Artificial Sequence: Synthetic oligonucleotide
  Target: ATXN1; (-) strand; PAM type: NRG; PAM sequence: AAG
gatcacaaagtcaggagagc

SEQ ID NO: 84541 - DNA, 20 bp, Artificial Sequence
  Description of Artificial Sequence: Synthetic oligonucleotide
  Target: ATXN1; (-) strand; PAM type: NRG; PAM sequence: GAG
aacggatcacaaagtcagga

SEQ ID NO: 84542 - DNA, 20 bp, Artificial Sequence
  Description of Artificial Sequence: Synthetic oligonucleotide
  Target: ATXN1; (-) strand; PAM type: NRG; PAM sequence: GAG
cgaacggatcacaaagtcag

SEQ ID NO: 84543 - DNA, 20 bp, Artificial Sequence
  Description of Artificial Sequence: Synthetic oligonucleotide
  Target: ATXN1; (-) strand; PAM type: NRG; PAM sequence: AGG
ggcgaacggatcacaaagtc

SEQ ID NO: 84544 - DNA, 20 bp, Artificial Sequence
  Description of Artificial Sequence: Synthetic oligonucleotide
  Target: ATXN1; (-) strand; PAM type: NRG; PAM sequence: CAG
aggcgaacggatcacaaagt

SEQ ID NO: 84545 - DNA, 20 bp, Artificial Sequence
  Description of Artificial Sequence: Synthetic oligonucleotide
  Target: ATXN1; (-) strand; PAM type: NRG; PAM sequence: AAG
accgaggcgaacggatcaca

SEQ ID NO: 84546 - DNA, 20 bp, Artificial Sequence
  Description of Artificial Sequence: Synthetic oligonucleotide
  Target: ATXN1; (-) strand; PAM type: NRG; PAM sequence: CGG
ctttgggagaccgaggcgaa

SEQ ID NO: 84547 - DNA, 20 bp, Artificial Sequence
  Description of Artificial Sequence: Synthetic oligonucleotide
  Target: ATXN1; (-) strand; PAM type: NRG; PAM sequence: AGG
gccagcactttgggagaccg

SEQ ID NO: 84548 - DNA, 20 bp, Artificial Sequence
  Description of Artificial Sequence: Synthetic oligonucleotide
  Target: ATXN1; (-) strand; PAM type: NRG; PAM sequence: GAG
tgccagcactttgggagacc

SEQ ID NO: 84549 - DNA, 20 bp, Artificial Sequence
  Description of Artificial Sequence: Synthetic oligonucleotide
  Target: ATXN1; (-) strand; PAM type: NRG; PAM sequence: GAG
ctgtaatgccagcactttgg

SEQ ID NO: 84550 - DNA, 20 bp, Artificial Sequence
  Description of Artificial Sequence: Synthetic oligonucleotide
  Target: ATXN1; (-) strand; PAM type: NRG; PAM sequence: GGG
acctgtaatgccagcacttt

SEQ ID NO: 84551 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatgccagcactt

SEQ ID NO: 84552 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatgc

SEQ ID NO: 84553 - DNA, 20 bp, Artificial Sequence
  Description of Artificial Sequence: Synthetic oligonucleotide
  Target: ATXN1; (-) strand; PAM type: NRG; PAM sequence: TGG
aaagtcatggctgggtgcag

SEQ ID NO: 84554 - DNA, 20 bp, Artificial Sequence
  Description of Artificial Sequence: Synthetic oligonucleotide
  Target: ATXN1; (-) strand; PAM type: NRG; PAM sequence: CAG
aaaaaagtcatggctgggtg

SEQ ID NO: 84555 - DNA, 20 bp, Artificial Sequence
  Description of Artificial Sequence: Synthetic oligonucleotide
  Target: ATXN1; (-) strand; PAM type: NRG; PAM sequence: GGG
ctaaaaaaaaagtcatggct

SEQ ID NO: 84556 - DNA, 20 bp, Artificial Sequence
  Description of Artificial Sequence: Synthetic oligonucleotide
  Target: ATXN1; (-) strand; PAM type: NRG; PAM sequence: TGG
gctaaaaaaaaagtcatggc

SEQ ID NO: 84557 - DNA, 20 bp, Artificial Sequence
  Description of Artificial Sequence: Synthetic oligonucleotide
  Target: ATXN1; (-) strand; PAM type: NRG; PAM sequence: TGG
gtttgctaaaaaaaaagtca

SEQ ID NO: 84558 - DNA, 20 bp, Artificial Sequence
  Description of Artificial Sequence: Synthetic oligonucleotide
  Target: ATXN1; (-) strand; PAM type: NRG; PAM sequence: AAG
gaaagtgtttgctaaaaaaa

SEQ ID NO: 84559 - DNA, 20 bp, Artificial Sequence
  Description of Artificial Sequence: Synthetic oligonucleotide
  Target: ATXN1; (-) strand; PAM type: NRG; PAM sequence: AAG
ttaaagcctagattggaaga

SEQ ID NO: 84560 - DNA, 20 bp, Artificial Sequence
  Description of Artificial Sequence: Synthetic oligonucleotide
  Target: ATXN1; (-) strand; PAM type: NRG; PAM sequence: AAG
attcttaaagcctagattgg

SEQ ID NO: 84561 - DNA, 20 bp, Artificial Sequence
  Description of Artificial Sequence: Synthetic oligonucleotide
  Target: ATXN1; (-) strand; PAM type: NRG; PAM sequence: TGG
tagattcttaaagcctagat

SEQ ID NO: 84562 - DNA, 20 bp, Artificial Sequence
  Description of Artificial Sequence: Synthetic oligonucleotide
  Target: ATXN1; (-) strand; PAM type: NRG; PAM sequence: TAG
ttaactagattcttaaagcc

SEQ ID NO: 84563 - DNA, 20 bp, Artificial Sequence
  Description of Artificial Sequence: Synthetic oligonucleotide
  Target: ATXN1; (-) strand; PAM type: NRG; PAM sequence: AAG
aaattttaactagattctta

SEQ ID NO: 84564 - DNA, 20 bp, Artificial Sequence
  Description of Artificial Sequence: Synthetic oligonucleotide
  Target: ATXN1; (-) strand; PAM type: NRG; PAM sequence: TAG
tagttaaaagaaattttaac

SEQ ID NO: 84565 - DNA, 20 bp, Artificial Sequence
  Description of Artificial Sequence: Synthetic oligonucleotide
  Target: ATXN1; (-) strand; PAM type: NRG; PAM sequence: AAG
aagtttattcctttagttaa

SEQ ID NO: 84566 - DNA, 20 bp, Artificial Sequence
  Description of Artificial Sequence: Synthetic oligonucleotide
  Target: ATXN1; (-) strand; PAM type: NRG; PAM sequence: TAG
actttaaaagtttattcctt

SEQ ID NO: 84567 - DNA, 20 bp, Artificial Sequence
  Description of Artificial Sequence: Synthetic oligonucleotide
  Target: ATXN1; (-) strand; PAM type: NRG; PAM sequence: AAG
tctctttccatgtactttaa

SEQ ID NO: 84568 - DNA, 20 bp, Artificial Sequence
  Description of Artificial Sequence: Synthetic oligonucleotide
  Target: ATXN1; (-) strand; PAM type: NRG; PAM sequence: AGG
atgaattgatttcatgaaaa

SEQ ID NO: 84569 - DNA, 20 bp, Artificial Sequence
  Description of Artificial Sequence: Synthetic oligonucleotide
  Target: ATXN1; (-) strand; PAM type: NRG; PAM sequence: AAG
catgaattgatttcatgaaa

SEQ ID NO: 84570 - DNA, 20 bp, Artificial Sequence
  Description of Artificial Sequence: Synthetic oligonucleotide
  Target: ATXN1; (-) strand; PAM type: NRG; PAM sequence: TAG
ataatgatttataatttacc

SEQ ID NO: 84571 - DNA, 20 bp, Artificial Sequence
  Description of Artificial Sequence: Synthetic oligonucleotide
  Target: ATXN1; (-) strand; PAM type: NRG; PAM sequence: TAG
ttgcgtattttctttctaaa

SEQ ID NO: 84572 - DNA, 20 bp, Artificial Sequence
  Description of Artificial Sequence: Synthetic oligonucleotide
  Target: ATXN1; (-) strand; PAM type: NRG; PAM sequence: TAG
agataaccagtgttgtttag

SEQ ID NO: 84573 - DNA, 20 bp, Artificial Sequence
  Description of Artificial Sequence: Synthetic oligonucleotide
  Target: ATXN1; (-) strand; PAM type: NRG; PAM sequence: TAG
caaagataaccagtgttgtt

SEQ ID NO: 84574 - DNA, 20 bp, Artificial Sequence
  Description of Artificial Sequence: Synthetic oligonucleotide
  Target: ATXN1; (-) strand; PAM type: NRG; PAM sequence: CAG
cattaacacccaaagataac

SEQ ID NO: 84575 - DNA, 20 bp, Artificial Sequence
  Description of Artificial Sequence: Synthetic oligonucleotide
  Target: ATXN1; (-) strand; PAM type: NRG; PAM sequence: AAG
catgtgtccattaacaccca

SEQ ID NO: 84576 - DNA, 20 bp, Artificial Sequence
  Description of Artificial Sequence: Synthetic oligonucleotide
  Target: ATXN1; (-) strand; PAM type: NRG; PAM sequence: TAG
agggcttaacatgtgaatgt

SEQ ID NO: 84577 - DNA, 20 bp, Artificial Sequence
  Description of Artificial Sequence: Synthetic oligonucleotide
  Target: ATXN1; (-) strand; PAM type: NRG; PAM sequence: GGG
gaggagataatgaaactcaa

SEQ ID NO: 84578 - DNA, 20 bp, Artificial Sequence
  Description of Artificial Sequence: Synthetic oligonucleotide
  Target: ATXN1; (-) strand; PAM type: NRG; PAM sequence: AGG
agaggagataatgaaactca

SEQ ID NO: 84579 - DNA, 20 bp, Artificial Sequence
  Description of Artificial Sequence: Synthetic oligonucleotide
  Target: ATXN1; (-) strand; PAM type: NRG; PAM sequence: AAG
tagaggagataatgaaactc

SEQ ID NO: 84580 - DNA, 20 bp, Artificial Sequence
  Description of Artificial Sequence: Synthetic oligonucleotide
  Target: ATXN1; (-) strand; PAM type: NRG; PAM sequence: GAG
gatggttctagggcttagag

SEQ ID NO: 84581 - DNA, 20 bp, Artificial Sequence
  Description of Artificial Sequence: Synthetic oligonucleotide
  Target: ATXN1; (-) strand; PAM type: NRG; PAM sequence: AGG
aggatggttctagggcttag

SEQ ID NO: 84582 - DNA, 20 bp, Artificial Sequence
  Description of Artificial Sequence: Synthetic oligonucleotide
  Target: ATXN1; (-) strand; PAM type: NRG; PAM sequence: GAG
taggatggttctagggctta

SEQ ID NO: 84583 - DNA, 20 bp, Artificial Sequence
  Description of Artificial Sequence: Synthetic oligonucleotide
  Target: ATXN1; (-) strand; PAM type: NRG; PAM sequence: TAG
cctaggatggttctagggct

SEQ ID NO: 84584 - DNA, 20 bp, Artificial Sequence
  Description of Artificial Sequence: Synthetic oligonucleotide
  Target: ATXN1; (-) strand; PAM type: NRG; PAM sequence: GGG
cactgcctaggatggttcta

SEQ ID NO: 84585 - DNA, 20 bp, Artificial Sequence
  Description of Artificial Sequence: Synthetic oligonucleotide
  Target: ATXN1; (-) strand; PAM type: NRG; PAM sequence: AGG
ccactgcctaggatggttct

SEQ ID NO: 84586 - DNA, 20 bp, Artificial Sequence
  Description of Artificial Sequence: Synthetic oligonucleotide
  Target: ATXN1; (-) strand; PAM type: NRG; PAM sequence: TAG
tccactgcctaggatggttc

SEQ ID NO: 84587 - DNA, 20 bp, Artificial Sequence
  Description of Artificial Sequence: Synthetic oligonucleotide
  Target: ATXN1; (-) strand; PAM type: NRG; PAM sequence: TGG
aaagtgtccactgcctagga

SEQ ID NO: 84588 - DNA, 20 bp, Artificial Sequence
  Description of Artificial Sequence: Synthetic oligonucleotide
  Target: ATXN1; (-) strand; PAM type: NRG; PAM sequence: AGG
aataaaagtgtccactgcct

SEQ ID NO: 84589 - DNA, 20 bp, Artificial Sequence
  Description of Artificial Sequence: Synthetic oligonucleotide
  Target: ATXN1; (-) strand; PAM type: NRG; PAM sequence: TAG
taataaaagtgtccactgcc

SEQ ID NO: 84590 - DNA, 20 bp, Artificial Sequence
  Description of Artificial Sequence: Synthetic oligonucleotide
  Target: ATXN1; (-) strand; PAM type: NRG; PAM sequence: AAG
tattagaaggcgggtaataa

SEQ ID NO: 84591 - DNA, 20 bp, Artificial Sequence
  Description of Artificial Sequence: Synthetic oligonucleotide
  Target: ATXN1; (-) strand; PAM type: NRG; PAM sequence: GGG
ttctttatttattagaaggc

SEQ ID NO: 84592 - DNA, 20 bp, Artificial Sequence
  Description of Artificial Sequence: Synthetic oligonucleotide
  Target: ATXN1; (-) strand; PAM type: NRG; PAM sequence: CGG
tttctttatttattagaagg

SEQ ID NO: 84593 - DNA, 20 bp, Artificial Sequence
  Description of Artificial Sequence: Synthetic oligonucleotide
  Target: ATXN1; (-) strand; PAM type: NRG; PAM sequence: AGG
ccatttctttatttattaga

SEQ ID NO: 84594 - DNA, 20 bp, Artificial Sequence
  Description of Artificial Sequence: Synthetic oligonucleotide
  Target: ATXN1; (-) strand; PAM type: NRG; PAM sequence: AAG
tccatttctttatttattag

SEQ ID NO: 84595 - DNA, 20 bp, Artificial Sequence
  Description of Artificial Sequence: Synthetic oligonucleotide
  Target: ATXN1; (-) strand; PAM type: NRG; PAM sequence: TAG
acctccatttctttatttat

SEQ ID NO: 84596 - DNA, 20 bp, Artificial Sequence
  Description of Artificial Sequence: Synthetic oligonucleotide
  Target: ATXN1; (-) strand; PAM type: NRG; PAM sequence: TAG
tcacttgtgggtacattatg

SEQ ID NO: 84597 - DNA, 20 bp, Artificial Sequence
  Description of Artificial Sequence: Synthetic oligonucleotide
  Target: ATXN1; (-) strand; PAM type: NRG; PAM sequence: GGG
gtcctcaatctgtcacttgt

SEQ ID NO: 84598 - DNA, 20 bp, Artificial Sequence
  Description of Artificial Sequence: Synthetic oligonucleotide
  Target: ATXN1; (-) strand; PAM type: NRG; PAM sequence: TGG
agtcctcaatctgtcacttg

SEQ ID NO: 84599 - DNA, 20 bp, Artificial Sequence
  Description of Artificial Sequence: Synthetic oligonucleotide
  Target: ATXN1; (-) strand; PAM type: NRG; PAM sequence: GAG
tctcaggtggatggaggttg

SEQ ID NO: 84600 - DNA, 20 bp, Artificial Sequence
  Description of Artificial Sequence: Synthetic oligonucleotide
  Target: ATXN1; (-) strand; PAM type: NRG; PAM sequence: TGG
gctctcaggtggatggaggt

SEQ ID NO: 84601 - DNA, 20 bp, Artificial Sequence
  Description of Artificial Sequence: Synthetic oligonucleotide
  Target: ATXN1; (-) strand; PAM type: NRG; PAM sequence: AGG
ctttgctctcaggtggatgg

SEQ ID NO: 84602 - DNA, 20 bp, Artificial Sequence
  Description of Artificial Sequence: Synthetic oligonucleotide
  Target: ATXN1; (-) strand; PAM type: NRG; PAM sequence: GAG
tctttgctctcaggtggatg

SEQ ID NO: 84603 - DNA, 20 bp, Artificial Sequence
  Description of Artificial Sequence: Synthetic oligonucleotide
  Target: ATXN1; (-) strand; PAM type: NRG; PAM sequence: TGG
aatctttgctctcaggtgga

SEQ ID NO: 84604 - DNA, 20 bp, Artificial Sequence
  Description of Artificial Sequence: Synthetic oligonucleotide
  Target: ATXN1; (-) strand; PAM type: NRG; PAM sequence: TGG
agagaatctttgctctcagg

SEQ ID NO: 84605 - DNA, 20 bp, Artificial Sequence
  Description of Artificial Sequence: Synthetic oligonucleotide
  Target: ATXN1; (-) strand; PAM type: NRG; PAM sequence: AGG
gatagagaatctttgctctc

SEQ ID NO: 84606 - DNA, 20 bp, Artificial Sequence
  Description of Artificial Sequence: Synthetic oligonucleotide
  Target: ATXN1; (-) strand; PAM type: NRG; PAM sequence: CAG
agatagagaatctttgctct

SEQ ID NO: 84607 - DNA, 20 bp, Artificial Sequence
  Description of Artificial Sequence: Synthetic oligonucleotide
  Target: ATXN1; (-) strand; PAM type: NRG; PAM sequence: GAG
ggcagcagactgaggagata

SEQ ID NO: 84608 - DNA, 20 bp, Artificial Sequence
  Description of Artificial Sequence: Synthetic oligonucleotide
  Target: ATXN1; (-) strand; PAM type: NRG; PAM sequence: TAG
gaggcagcagactgaggaga

SEQ ID NO: 84609 - DNA, 20 bp, Artificial Sequence
  Description of Artificial Sequence: Synthetic oligonucleotide
  Target: ATXN1; (-) strand; PAM type: NRG; PAM sequence: GAG
aaaggaggcagcagactgag

SEQ ID NO: 84610 - DNA, 20 bp, Artificial Sequence
  Description of Artificial Sequence: Synthetic oligonucleotide
  Target: ATXN1; (-) strand; PAM type: NRG; PAM sequence: AGG
ggaaaggaggcagcagactg

SEQ ID NO: 84611 - DNA, 20 bp, Artificial Sequence
  Description of Artificial Sequence: Synthetic oligonucleotide
  Target: ATXN1; (-) strand; PAM type: NRG; PAM sequence: GAG
tggaaaggaggcagcagact

SEQ ID NO: 84612 - DNA, 20 bp, Artificial Sequence
  Description of Artificial Sequence: Synthetic oligonucleotide
  Target: ATXN1; (-) strand; PAM type: NRG; PAM sequence: CAG
attaattggaaaggaggcag

SEQ ID NO: 84613 - DNA, 20 bp, Artificial Sequence
  Description of Artificial Sequence: Synthetic oligonucleotide
  Target: ATXN1; (-) strand; PAM type: NRG; PAM sequence: CAG
actattaattggaaaggagg

SEQ ID NO: 84614 - DNA, 20 bp, Artificial Sequence
  Description of Artificial Sequence: Synthetic oligonucleotide
  Target: ATXN1; (-) strand; PAM type: NRG; PAM sequence: AGG
tcaactattaattggaaagg

SEQ ID NO: 84615 - DNA, 20 bp, Artificial Sequence
  Description of Artificial Sequence: Synthetic oligonucleotide
  Target: ATXN1; (-) strand; PAM type: NRG; PAM sequence: GAG
gtcaactattaattggaaag

SEQ ID NO: 84616 - DNA, 20 bp, Artificial Sequence
  Description of Artificial Sequence: Synthetic oligonucleotide
  Target: ATXN1; (-) strand; PAM type: NRG; PAM sequence: AGG
cagtcaactattaattggaa

SEQ ID NO: 84617 - DNA, 20 bp, Artificial Sequence
  Description of Artificial Sequence: Synthetic oligonucleotide
  Target: ATXN1; (-) strand; PAM type: NRG; PAM sequence: AAG
tcagtcaactattaattgga

SEQ ID NO: 84618 - DNA, 20 bp, Artificial Sequence
  Description of Artificial Sequence: Synthetic oligonucleotide
  Target: ATXN1; (-) strand; PAM type: NRG; PAM sequence: TGG
aagttcagtcaactattaat

SEQ ID NO: 84619 - DNA, 20 bp, Artificial Sequence
  Description of Artificial Sequence: Synthetic oligonucleotide
  Target: ATXN1; (-) strand; PAM type: NRG; PAM sequence: CAG
aggaagaatctaccgaagtt

SEQ ID NO: 84620 - DNA, 20 bp, Artificial Sequence
  Description of Artificial Sequence: Synthetic oligonucleotide
  Target: ATXN1; (-) strand; PAM type: NRG; PAM sequence: AAG
gccagaggaagaatctaccg

SEQ ID NO: 84621 - DNA, 20 bp, Artificial Sequence
  Description of Artificial Sequence: Synthetic oligonucleotide
  Target: ATXN1; (-) strand; PAM type: NRG; PAM sequence: AAG
tgtggaatacctgccagagg

SEQ ID NO: 84622 - DNA, 20 bp, Artificial Sequence
  Description of Artificial Sequence: Synthetic oligonucleotide
  Target: ATXN1; (-) strand; PAM type: NRG; PAM sequence: AGG
gattgtggaatacctgccag

SEQ ID NO: 84623 - DNA, 20 bp, Artificial Sequence
  Description of Artificial Sequence: Synthetic oligonucleotide
  Target: ATXN1; (-) strand; PAM type: NRG; PAM sequence: GAG
tgattgtggaatacctgcca

SEQ ID NO: 84624 - DNA, 20 bp, Artificial Sequence
  Description of Artificial Sequence: Synthetic oligonucleotide
  Target: ATXN1; (-) strand; PAM type: NRG; PAM sequence: CAG
catgattgtggaatacctgc

SEQ ID NO: 84625 - DNA, 20 bp, Artificial Sequence
  Description of Artificial Sequence: Synthetic oligonucleotide
  Target: ATXN1; (-) strand; PAM type: NRG; PAM sequence: TGG
aagaggatgtttcatgattg

SEQ ID NO: 84626 - DNA, 20 bp, Artificial Sequence
  Description of Artificial Sequence: Synthetic oligonucleotide
  Target: ATXN1; (-) strand; PAM type: NRG; PAM sequence: AGG
tttgaaacaagaaagtgaag

SEQ ID NO: 84627 - DNA, 20 bp, Artificial Sequence
  Description of Artificial Sequence: Synthetic oligonucleotide
  Target: ATXN1; (-) strand; PAM type: NRG; PAM sequence: GAG
ctttgaaacaagaaagtgaa

SEQ ID NO: 84628 - DNA, 20 bp, Artificial Sequence
  Description of Artificial Sequence: Synthetic oligonucleotide
  Target: ATXN1; (-) strand; PAM type: NRG; PAM sequence: AAG
cactttgaaacaagaaagtg

SEQ ID NO: 84629 - DNA, 20 bp, Artificial Sequence
  Description of Artificial Sequence: Synthetic oligonucleotide
  Target: ATXN1; (-) strand; PAM type: NRG; PAM sequence: AAG
ctcctcactttgaaacaaga

SEQ ID NO: 84630 - DNA, 20 bp, Artificial Sequence
  Description of Artificial Sequence: Synthetic oligonucleotide
  Target: ATXN1; (-) strand; PAM type: NRG; PAM sequence: AAG
ccaactcctcactttgaaac

SEQ ID NO: 84631 - DNA, 20 bp, Artificial Sequence
  Description of Artificial Sequence: Synthetic oligonucleotide
  Target: ATXN1; (-) strand; PAM type: NRG; PAM sequence: AAG
gggctctgagccaattcatc

SEQ ID NO: 84632 - DNA, 20 bp, Artificial Sequence
  Description of Artificial Sequence: Synthetic oligonucleotide
  Target: ATXN1; (-) strand; PAM type: NRG; PAM sequence: GAG
catattttaggatgggctct

SEQ ID NO: 84633 - DNA, 20 bp, Artificial Sequence
  Description of Artificial Sequence: Synthetic oligonucleotide
  Target: ATXN1; (-) strand; PAM type: NRG; PAM sequence: GGG
acacgtacatattttaggat

SEQ ID NO: 84634 - DNA, 20 bp, Artificial Sequence
  Description of Artificial Sequence: Synthetic oligonucleotide
  Target: ATXN1; (-) strand; PAM type: NRG; PAM sequence: TGG
gacacgtacatattttagga

SEQ ID NO: 84635 - DNA, 20 bp, Artificial Sequence
  Description of Artificial Sequence: Synthetic oligonucleotide
  Target: ATXN1; (-) strand; PAM type: NRG; PAM sequence: AGG
taccgacacgtacatatttt

SEQ ID NO: 84636 - DNA, 20 bp, Artificial Sequence
  Description of Artificial Sequence: Synthetic oligonucleotide
  Target: ATXN1; (-) strand; PAM type: NRG; PAM sequence: TAG
ttaccgacacgtacatattt

SEQ ID NO: 84637 - DNA, 20 bp, Artificial Sequence
  Description of Artificial Sequence: Synthetic oligonucleotide
  Target: ATXN1; (-) strand; PAM type: NRG; PAM sequence: AAG
ggtctgctttggggaggcaa

SEQ ID NO: 84638 - DNA, 20 bp, Artificial Sequence
  Description of Artificial Sequence: Synthetic oligonucleotide
  Target: ATXN1; (-) strand; PAM type: NRG; PAM sequence: AGG
ataaccggtctgctttgggg

SEQ ID NO: 84639 - DNA, 20 bp, Artificial Sequence
  Description of Artificial Sequence: Synthetic oligonucleotide
  Target: ATXN1; (-) strand; PAM type: NRG; PAM sequence: GAG
gataaccggtctgctttggg

SEQ ID NO: 84640 - DNA, 20 bp, Artificial Sequence
  Description of Artificial Sequence: Synthetic oligonucleotide
  Target: ATXN1; (-) strand; PAM type: NRG; PAM sequence: GGG
gtgataaccggtctgctttg

SEQ ID NO: 84641 - DNA, 20 bp, Artificial Sequence
  Description of Artificial Sequence: Synthetic oligonucleotide
  Target: ATXN1; (-) strand; PAM type: NRG; PAM sequence: GGG
tgtgataaccggtctgcttt

SEQ ID NO: 84642 - DNA, 20 bp, Artificial Sequence
  Description of Artificial Sequence: Synthetic oligonucleotide
  Target: ATXN1; (-) strand; PAM type: NRG; PAM sequence: TGG
atgtgataaccggtctgctt

SEQ ID NO: 84643 - DNA, 20 bp, Artificial Sequence
  Description of Artificial Sequence: Synthetic oligonucleotide
  Target: ATXN1; (-) strand; PAM type: NRG; PAM sequence: CGG
tcctttttccatgtgataac

SEQ ID NO: 84644 - DNA, 20 bp, Artificial Sequence
  Description of Artificial Sequence: Synthetic oligonucleotide
  Target: ATXN1; (-) strand; PAM type: NRG; PAM sequence: GAG
ccagcgtgtggcttgtgagt

SEQ ID NO: 84645 - DNA, 20 bp, Artificial Sequence
  Description of Artificial Sequence: Synthetic oligonucleotide
  Target: ATXN1; (-) strand; PAM type: NRG; PAM sequence: GAG
gaatccagcgtgtggcttgt

SEQ ID NO: 84646 - DNA, 20 bp, Artificial Sequence
  Description of Artificial Sequence: Synthetic oligonucleotide
  Target: ATXN1; (-) strand; PAM type: NRG; PAM sequence: TGG
acctcacagaatccagcgtg

SEQ ID NO: 84647 - DNA, 20 bp, Artificial Sequence
  Description of Artificial Sequence: Synthetic oligonucleotide
  Target: ATXN1; (-) strand; PAM type: NRG; PAM sequence: CAG
agttttaacctcacagaatc

SEQ ID NO: 84648 - DNA, 20 bp, Artificial Sequence
  Description of Artificial Sequence: Synthetic oligonucleotide
  Target: ATXN1; (-) strand; PAM type: NRG; PAM sequence: CAG
aatcaaaagttttaacctca

SEQ ID NO: 84649 - DNA, 20 bp, Artificial Sequence
  Description of Artificial Sequence: Synthetic oligonucleotide
  Target: ATXN1; (-) strand; PAM type: NRG; PAM sequence: AAG
catgtccttctaagaatcaa

SEQ ID NO: 84650 - DNA, 20 bp, Artificial Sequence
  Description of Artificial Sequence: Synthetic oligonucleotide
  Target: ATXN1; (-) strand; PAM type: NRG; PAM sequence: AAG
ctctatcctcatgtccttct

SEQ ID NO: 84651 - DNA, 20 bp, Artificial Sequence
  Description of Artificial Sequence: Synthetic oligonucleotide
  Target: ATXN1; (-) strand; PAM type: NRG; PAM sequence: CAG
tcattttgtttacagaacat

SEQ ID NO: 84652 - DNA, 20 bp, Artificial Sequence
  Description of Artificial Sequence: Synthetic oligonucleotide
  Target: ATXN1; (-) strand; PAM type: NRG; PAM sequence: CAG
acagaccatcattttgttta

SEQ ID NO: 84653 - DNA, 20 bp, Artificial Sequence
  Description of Artificial Sequence: Synthetic oligonucleotide
  Target: ATXN1; (-) strand; PAM type: NRG; PAM sequence: CAG
gataccttgaattttgttta

SEQ ID NO: 84654 - DNA, 20 bp, Artificial Sequence
  Description of Artificial Sequence: Synthetic oligonucleotide
  Target: ATXN1; (-) strand; PAM type: NRG; PAM sequence: AGG
aggggattcgggctgggctg

SEQ ID NO: 84655 - DNA, 20 bp, Artificial Sequence
  Description of Artificial Sequence: Synthetic oligonucleotide
  Target: ATXN1; (-) strand; PAM type: NRG; PAM sequence: GAG
caggggattcgggctgggct

SEQ ID NO: 84656 - DNA, 20 bp, Artificial Sequence
  Description of Artificial Sequence: Synthetic oligonucleotide
  Target: ATXN1; (-) strand; PAM type: NRG; PAM sequence: GGG
ataaacaggggattcgggct

SEQ ID NO: 84657 - DNA, 20 bp, Artificial Sequence
  Description of Artificial Sequence: Synthetic oligonucleotide
  Target: ATXN1; (-) strand; PAM type: NRG; PAM sequence: TGG
aataaacaggggattcgggc

SEQ ID NO: 84658 - DNA, 20 bp, Artificial Sequence
  Description of Artificial Sequence: Synthetic oligonucleotide
  Target: ATXN1; (-) strand; PAM type: NRG; PAM sequence: GGG
gaggaataaacaggggattc

SEQ ID NO: 84659 - DNA, 20 bp, Artificial Sequence
  Description of Artificial Sequence: Synthetic oligonucleotide
  Target: ATXN1; (-) strand; PAM type: NRG; PAM sequence: CGG
agaggaataaacaggggatt

SEQ ID NO: 84660 - DNA, 20 bp, Artificial Sequence
  Description of Artificial Sequence: Synthetic oligonucleotide
  Target: ATXN1; (-) strand; PAM type: NRG; PAM sequence: GGG
gctttcagaggaataaacag

SEQ ID NO: 84661 - DNA, 20 bp, Artificial Sequence
  Description of Artificial Sequence: Synthetic oligonucleotide
  Target: ATXN1; (-) strand; PAM type: NRG; PAM sequence: GGG
tgctttcagaggaataaaca

SEQ ID NO: 84662 - DNA, 20 bp, Artificial Sequence
  Description of Artificial Sequence: Synthetic oligonucleotide
  Target: ATXN1; (-) strand; PAM type: NRG; PAM sequence: AGG
gtgctttcagaggaataaac

SEQ ID NO: 84663 - DNA, 20 bp, Artificial Sequence
  Description of Artificial Sequence: Synthetic oligonucleotide
  Target: ATXN1; (-) strand; PAM type: NRG; PAM sequence: CAG
tgtgctttcagaggaataaa

SEQ ID NO: 84664 - DNA, 20 bp, Artificial Sequence
  Description of Artificial Sequence: Synthetic oligonucleotide
  Target: ATXN1; (-) strand; PAM type: NRG; PAM sequence: AGG
tttcataaatgtgctttcag

SEQ ID NO: 84665 - DNA, 20 bp, Artificial Sequence
  Description of Artificial Sequence: Synthetic oligonucleotide
  Target: ATXN1; (-) strand; PAM type: NRG; PAM sequence: GAG
gtttcataaatgtgctttca

SEQ ID NO: 84666 - DNA, 20 bp, Artificial Sequence
  Description of Artificial Sequence: Synthetic oligonucleotide
  Target: ATXN1; (-) strand; PAM type: NRG; PAM sequence: CAG
ttgtttcataaatgtgcttt

SEQ ID NO: 84667 - DNA, 20 bp, Artificial Sequence
  Description of Artificial Sequence: Synthetic oligonucleotide
  Target: ATXN1; (-) strand; PAM type: NRG; PAM sequence: GAG
agatgactggcatttttgca

SEQ ID NO: 84668 - DNA, 20 bp, Artificial Sequence
  Description of Artificial Sequence: Synthetic oligonucleotide
  Target: ATXN1; (-) strand; PAM type: NRG; PAM sequence: CAG
agagatgactggcatttttg

SEQ ID NO: 84669 - DNA, 20 bp, Artificial Sequence
  Description of Artificial Sequence: Synthetic oligonucleotide
  Target: ATXN1; (-) strand; PAM type: NRG; PAM sequence: TGG
tgtggtgccttagagatgac

SEQ ID NO: 84670 - DNA, 20 bp, Artificial Sequence
  Description of Artificial Sequence: Synthetic oligonucleotide
  Target: ATXN1; (-) strand; PAM type: NRG; PAM sequence: GAG
tgccttactgtggtgcctta

SEQ ID NO: 84671 - DNA, 20 bp, Artificial Sequence
  Description of Artificial Sequence: Synthetic oligonucleotide
  Target: ATXN1; (-) strand; PAM type: NRG; PAM sequence: TAG
cttgccttactgtggtgcct

SEQ ID NO: 84672 - DNA, 20 bp, Artificial Sequence
  Description of Artificial Sequence: Synthetic oligonucleotide
  Target: ATXN1; (-) strand; PAM type: NRG; PAM sequence: TGG
catagctccttgccttactg

SEQ ID NO: 84673 - DNA, 20 bp, Artificial Sequence
  Description of Artificial Sequence: Synthetic oligonucleotide
  Target: ATXN1; (-) strand; PAM type: NRG; PAM sequence: TAG
ttcaaaaggataacactaca

SEQ ID NO: 84674 - DNA, 20 bp, Artificial Sequence
  Description of Artificial Sequence: Synthetic oligonucleotide
  Target: ATXN1; (-) strand; PAM type: NRG; PAM sequence: AGG
cgtttagaaagcacttcaaa

SEQ ID NO: 84675 - DNA, 20 bp, Artificial Sequence
  Description of Artificial Sequence: Synthetic oligonucleotide
  Target: ATXN1; (-) strand; PAM type: NRG; PAM sequence: AAG
gcgtttagaaagcacttcaa

SEQ ID NO: 84676 - DNA, 20 bp, Artificial Sequence
  Description of Artificial Sequence: Synthetic oligonucleotide
  Target: ATXN1; (-) strand; PAM type: NRG; PAM sequence: AAG
aagggagttaagcgtttaga

SEQ ID NO: 84677 - DNA, 20 bp, Artificial Sequence
  Description of Artificial Sequence: Synthetic oligonucleotide
  Target: ATXN1; (-) strand; PAM type: NRG; PAM sequence: TAG
acccaagggagttaagcgtt

SEQ ID NO: 84678 - DNA, 20 bp, Artificial Sequence
  Description of Artificial Sequence: Synthetic oligonucleotide
  Target: ATXN1; (-) strand; PAM type: NRG; PAM sequence: AAG
tcaactgacccaagggagtt

SEQ ID NO: 84679 - DNA, 20 bp, Artificial Sequence
  Description of Artificial Sequence: Synthetic oligonucleotide
  Target: ATXN1; (-) strand; PAM type: NRG; PAM sequence: GAG
gtgaatcaactgacccaagg

SEQ ID NO: 84680 - DNA, 20 bp, Artificial Sequence
  Description of Artificial Sequence: Synthetic oligonucleotide
  Target: ATXN1; (-) strand; PAM type: NRG; PAM sequence: GGG
tggtgaatcaactgacccaa

SEQ ID NO: 84681 - DNA, 20 bp, Artificial Sequence
  Description of Artificial Sequence: Synthetic oligonucleotide
  Target: ATXN1; (-) strand; PAM type: NRG; PAM sequence: AGG
atggtgaatcaactgaccca

SEQ ID NO: 84682 - DNA, 20 bp, Artificial Sequence
  Description of Artificial Sequence: Synthetic oligonucleotide
  Target: ATXN1; (-) strand; PAM type: NRG; PAM sequence: AAG
gatggtgaatcaactgaccc

SEQ ID NO: 84683 - DNA, 20 bp, Artificial Sequence
  Description of Artificial Sequence: Synthetic oligonucleotide
  Target: ATXN1; (-) strand; PAM type: NRG; PAM sequence: TGG
gcaaaggggacagaggtgga

SEQ ID NO: 84684 - DNA, 20 bp, Artificial Sequence
  Description of Artificial Sequence: Synthetic oligonucleotide
  Target: ATXN1; (-) strand; PAM type: NRG; PAM sequence: TGG
ataagcaaaggggacagagg

SEQ ID NO: 84685 - DNA, 20 bp, Artificial Sequence
  Description of Artificial Sequence: Synthetic oligonucleotide
  Target: ATXN1; (-) strand; PAM type: NRG; PAM sequence: AGG
ataataagcaaaggggacag

SEQ ID NO: 84686 - DNA, 20 bp, Artificial Sequence
  Description of Artificial Sequence: Synthetic oligonucleotide
  Target: ATXN1; (-) strand; PAM type: NRG; PAM sequence: GAG
aataataagcaaaggggaca

SEQ ID NO: 84687 - DNA, 20 bp, Artificial Sequence
  Description of Artificial Sequence: Synthetic oligonucleotide
  Target: ATXN1; (-) strand; PAM type: NRG; PAM sequence: CAG
gaaataataagcaaagggga

SEQ ID NO: 84688 - DNA, 20 bp, Artificial Sequence
  Description of Artificial Sequence: Synthetic oligonucleotide
  Target: ATXN1; (-) strand; PAM type: NRG; PAM sequence: GGG
gagagaaataataagcaaag

SEQ ID NO: 84689 - DNA, 20 bp, Artificial Sequence
  Description of Artificial Sequence: Synthetic oligonucleotide
  Target: ATXN1; (-) strand; PAM type: NRG; PAM sequence: GGG
tgagagaaataataagcaaa

SEQ ID NO: 84690 - DNA, 20 bp, Artificial Sequence
  Description of Artificial Sequence: Synthetic oligonucleotide
  Target: ATXN1; (-) strand; PAM type: NRG; PAM sequence: AGG
gtgagagaaataataagcaa

SEQ ID NO: 84691 - DNA, 20 bp, Artificial Sequence
  Description of Artificial Sequence: Synthetic oligonucleotide
  Target: ATXN1; (-) strand; PAM type: NRG; PAM sequence: AAG
ggtgagagaaataataagca

SEQ ID NO: 84692 - DNA, 20 bp, Artificial Sequence
  Description of Artificial Sequence: Synthetic oligonucleotide
  Target: ATXN1; (-) strand; PAM type: NRG; PAM sequence: AAG
tctgaggtgagagaaataat

SEQ ID NO: 84693 - DNA, 20 bp, Artificial Sequence
  Description of Artificial Sequence: Synthetic oligonucleotide
  Target: ATXN1; (-) strand; PAM type: NRG; PAM sequence: GAG
aggaaagccatctgaggtga

SEQ ID NO: 84694 - DNA, 20 bp, Artificial Sequence
  Description of Artificial Sequence: Synthetic oligonucleotide
  Target: ATXN1; (-) strand; PAM type: NRG; PAM sequence: GAG
gaaggaaagccatctgaggt

SEQ ID NO: 84695 - DNA, 20 bp, Artificial Sequence
  Description of Artificial Sequence: Synthetic oligonucleotide
  Target: ATXN1; (-) strand; PAM type: NRG; PAM sequence: AGG
agcagaaggaaagccatctg

SEQ ID NO: 84696 - DNA, 20 bp, Artificial Sequence
  Description of Artificial Sequence: Synthetic oligonucleotide
  Target: ATXN1; (-) strand; PAM type: NRG; PAM sequence: GAG
tagcagaaggaaagccatct

SEQ ID NO: 84697 - DNA, 20 bp, Artificial Sequence
  Description of Artificial Sequence: Synthetic oligonucleotide
  Target: ATXN1; (-) strand; PAM type: NRG; PAM sequence: AAG
attgtgggttagcagaagga

SEQ ID NO: 84698 - DNA, 20 bp, Artificial Sequence
  Description of Artificial Sequence: Synthetic oligonucleotide
  Target: ATXN1; (-) strand; PAM type: NRG; PAM sequence: AGG
aacgattgtgggttagcaga

SEQ ID NO: 84699 - DNA, 20 bp, Artificial Sequence
  Description of Artificial Sequence: Synthetic oligonucleotide
  Target: ATXN1; (-) strand; PAM type: NRG; PAM sequence: AAG
taacgattgtgggttagcag

SEQ ID NO: 84700 - DNA, 20 bp, Artificial Sequence
  Description of Artificial Sequence: Synthetic oligonucleotide
  Target: ATXN1; (-) strand; PAM type: NRG; PAM sequence: CAG
ttttaacgattgtgggttag

SEQ ID NO: 84701 - DNA, 20 bp, Artificial Sequence
  Description of Artificial Sequence: Synthetic oligonucleotide
  Target: ATXN1; (-) strand; PAM type: NRG; PAM sequence: TAG
tgtttttaacgattgtgggt

SEQ ID NO: 84702 - DNA, 20 bp, Artificial Sequence
  Description of Artificial Sequence: Synthetic oligonucleotide
  Target: ATXN1; (-) strand; PAM type: NRG; PAM sequence: GGG
agtatgtttttaacgattgt

SEQ ID NO: 84703 - DNA, 20 bp, Artificial Sequence
  Description of Artificial Sequence: Synthetic oligonucleotide
  Target: ATXN1; (-) strand; PAM type: NRG; PAM sequence: TGG
cagtatgtttttaacgattg

SEQ ID NO: 84704 - DNA, 20 bp, Artificial Sequence
  Description of Artificial Sequence: Synthetic oligonucleotide
  Target: ATXN1; (-) strand; PAM type: NRG; PAM sequence: CAG
agaataatctagaaagtgtt

SEQ ID NO: 84705 - DNA, 20 bp, Artificial Sequence
  Description of Artificial Sequence: Synthetic oligonucleotide
  Target: ATXN1; (-) strand; PAM type: NRG; PAM sequence: AAG
atgactaagaataatctaga

SEQ ID NO: 84706 - DNA, 20 bp, Artificial Sequence
  Description of Artificial Sequence: Synthetic oligonucleotide
  Target: ATXN1; (-) strand; PAM type: NRG; PAM sequence: TAG
aaaaatgactaagaataatc

SEQ ID NO: 84707 - DNA, 20 bp, Artificial Sequence
  Description of Artificial Sequence: Synthetic oligonucleotide
  Target: ATXN1; (-) strand; PAM type: NRG; PAM sequence: AAG
ccgggcattgaaaaatgact

SEQ ID NO: 84708 - DNA, 20 bp, Artificial Sequence
  Description of Artificial Sequence: Synthetic oligonucleotide
  Target: ATXN1; (-) strand; PAM type: NRG; PAM sequence: GGG
aaagacaaatgtcttgagcc

SEQ ID NO: 84709 - DNA, 20 bp, Artificial Sequence
  Description of Artificial Sequence: Synthetic oligonucleotide
  Target: ATXN1; (-) strand; PAM type: NRG; PAM sequence: CGG
gaaagacaaatgtcttgagc

SEQ ID NO: 84710 - DNA, 20 bp, Artificial Sequence
  Description of Artificial Sequence: Synthetic oligonucleotide
  Target: ATXN1; (-) strand; PAM type: NRG; PAM sequence: GAG
tatagaaagacaaatgtctt

SEQ ID NO: 84711 - DNA, 20 bp, Artificial Sequence
  Description of Artificial Sequence: Synthetic oligonucleotide
  Target: ATXN1; (-) strand; PAM type: NRG; PAM sequence: AAG
tgagctgcagtggttataga

SEQ ID NO: 84712 - DNA, 20 bp, Artificial Sequence
  Description of Artificial Sequence: Synthetic oligonucleotide
  Target: ATXN1; (-) strand; PAM type: NRG; PAM sequence: TAG
agagtgagctgcagtggtta

SEQ ID NO: 84713 - DNA, 20 bp, Artificial Sequence
  Description of Artificial Sequence: Synthetic oligonucleotide
  Target: ATXN1; (-) strand; PAM type: NRG; PAM sequence: TGG
ggggaaagagtgagctgcag

SEQ ID NO: 84714 - DNA, 20 bp, Artificial Sequence
  Description of Artificial Sequence: Synthetic oligonucleotide
  Target: ATXN1; (-) strand; PAM type: NRG; PAM sequence: CAG
tttggggaaagagtgagctg

SEQ ID NO: 84715 - DNA, 20 bp, Artificial Sequence
  Description of Artificial Sequence: Synthetic oligonucleotide
  Target: ATXN1; (-) strand; PAM type: NRG; PAM sequence: GAG
aggcactttggggaaagagt

SEQ ID NO: 84716 - DNA, 20 bp, Artificial Sequence
  Description of Artificial Sequence: Synthetic oligonucleotide
  Target: ATXN1; (-) strand; PAM type: NRG; PAM sequence: GAG
cccgaggcactttggggaaa

SEQ ID NO: 84717 - DNA, 20 bp, Artificial Sequence
  Description of Artificial Sequence: Synthetic oligonucleotide
  Target: ATXN1; (-) strand; PAM type: NRG; PAM sequence: AAG
ggcccgaggcactttgggga

SEQ ID NO: 84718 - DNA, 20 bp, Artificial Sequence
  Description of Artificial Sequence: Synthetic oligonucleotide
  Target: ATXN1; (-) strand; PAM type: NRG; PAM sequence: GGG
tcctggcccgaggcactttg

SEQ ID NO: 84719 - DNA, 20 bp, Artificial Sequence
  Description of Artificial Sequence: Synthetic oligonucleotide
  Target: ATXN1; (-) strand; PAM type: NRG; PAM sequence: GGG
gtcctggcccgaggcacttt

SEQ ID NO: 84720 - DNA, 20 bp, Artificial Sequence
  Description of Artificial Sequence: Synthetic oligonucleotide
  Target: ATXN1; (-) strand; PAM type: NRG; PAM sequence: TGG
agtcctggcccgaggcactt

SEQ ID NO: 84721 - DNA, 20 bp, Artificial Sequence
  Description of Artificial Sequence: Synthetic oligonucleotide
  Target: ATXN1; (-) strand; PAM type: NRG; PAM sequence: AGG
ttgatgggagtcctggcccg

SEQ ID NO: 84722 - DNA, 20 bp, Artificial Sequence
  Description of Artificial Sequence: Synthetic oligonucleotide
  Target: ATXN1; (-) strand; PAM type: NRG; PAM sequence: GAG
cttgatgggagtcctggccc

SEQ ID NO: 84723 - DNA, 20 bp, Artificial Sequence
  Description of Artificial Sequence: Synthetic oligonucleotide
  Target: ATXN1; (-) strand; PAM type: NRG; PAM sequence: TGG
gcccaccttgatgggagtcc

SEQ ID NO: 84724 - DNA, 20 bp, Artificial Sequence
  Description of Artificial Sequence: Synthetic oligonucleotide
  Target: ATXN1; (-) strand; PAM type: NRG; PAM sequence: GAG
aggtaagcccaccttgatgg

SEQ ID NO: 84725 - DNA, 20 bp, Artificial Sequence
  Description of Artificial Sequence: Synthetic oligonucleotide
  Target: ATXN1; (-) strand; PAM type: NRG; PAM sequence: GGG
ataggtaagcccaccttgat

SEQ ID NO: 84726 - DNA, 20 bp, Artificial Sequence
  Description of Artificial Sequence: Synthetic oligonucleotide
  Target: ATXN1; (-) strand; PAM type: NRG; PAM sequence: TGG
cataggtaagcccaccttga

SEQ ID NO: 84727 - DNA, 20 bp, Artificial Sequence
  Description of Artificial Sequence: Synthetic oligonucleotide
  Target: ATXN1; (-) strand; PAM type: NRG; PAM sequence: AAG
gggtcagagagcacataggt

SEQ ID NO: 84728 - DNA, 20 bp, Artificial Sequence
  Description of Artificial Sequence: Synthetic oligonucleotide
  Target: ATXN1; (-) strand; PAM type: NRG; PAM sequence: AGG
cagggggtcagagagcacat

SEQ ID NO: 84729 - DNA, 20 bp, Artificial Sequence
  Description of Artificial Sequence: Synthetic oligonucleotide
  Target: ATXN1; (-) strand; PAM type: NRG; PAM sequence: TAG
acagggggtcagagagcaca

SEQ ID NO: 84730 - DNA, 20 bp, Artificial Sequence
  Description of Artificial Sequence: Synthetic oligonucleotide
  Target: ATXN1; (-) strand; PAM type: NRG; PAM sequence: GAG
caacattacagggggtcaga

SEQ ID NO: 84731 - DNA, 20 bp, Artificial Sequence
  Description of Artificial Sequence: Synthetic oligonucleotide
  Target: ATXN1; (-) strand; PAM type: NRG; PAM sequence: GAG
ggcaacattacagggggtca

SEQ ID NO: 84732 - DNA, 20 bp, Artificial Sequence
  Description of Artificial Sequence: Synthetic oligonucleotide
  Target: ATXN1; (-) strand; PAM type: NRG; PAM sequence: CAG
gaggcaacattacagggggt

SEQ ID NO: 84733 - DNA, 20 bp, Artificial Sequence
  Description of Artificial Sequence: Synthetic oligonucleotide
  Target: ATXN1; (-) strand; PAM type: NRG; PAM sequence: GGG
aaatgaggcaacattacagg

SEQ ID NO: 84734 - DNA, 20 bp, Artificial Sequence
  Description of Artificial Sequence: Synthetic oligonucleotide
  Target: ATXN1; (-) strand; PAM type: NRG; PAM sequence: GGG
caaatgaggcaacattacag

SEQ ID NO: 84735 - DNA, 20 bp, Artificial Sequence
  Description of Artificial Sequence: Synthetic oligonucleotide
  Target: ATXN1; (-) strand; PAM type: NRG; PAM sequence: GGG
acaaatgaggcaacattaca

SEQ ID NO: 84736 - DNA, 20 bp, Artificial Sequence
  Description of Artificial Sequence: Synthetic oligonucleotide
  Target: ATXN1; (-) strand; PAM type: NRG; PAM sequence: AGG
cacaaatgaggcaacattac

SEQ ID NO: 84737 - DNA, 20 bp, Artificial Sequence
  Description of Artificial Sequence: Synthetic oligonucleotide
  Target: ATXN1; (-) strand; PAM type: NRG; PAM sequence: CAG
acacaaatgaggcaacatta

SEQ ID NO: 84738 - DNA, 20 bp, Artificial Sequence
  Description of Artificial Sequence: Synthetic oligonucleotide
  Target: ATXN1; (-) strand; PAM type: NRG; PAM sequence: AGG
agccgagactcacacaaatg

SEQ ID NO: 84739 - DNA, 20 bp, Artificial Sequence
  Description of Artificial Sequence: Synthetic oligonucleotide
  Target: ATXN1; (-) strand; PAM type: NRG; PAM sequence: GAG
aagccgagactcacacaaat

SEQ ID NO: 84740 - DNA, 20 bp, Artificial Sequence
  Description of Artificial Sequence: Synthetic oligonucleotide
  Target: ATXN1; (-) strand; PAM type: NRG; PAM sequence: GAG
tattaatagttacgaaagcc

SEQ ID NO: 84741 - DNA, 20 bp, Artificial Sequence
  Description of Artificial Sequence: Synthetic oligonucleotide
  Target: ATXN1; (-) strand; PAM type: NRG; PAM sequence: AAG
tcatctattaatagttacga

SEQ ID NO: 84742 - DNA, 20 bp, Artificial Sequence
  Description of Artificial Sequence: Synthetic oligonucleotide
  Target: ATXN1; (-) strand; PAM type: NRG; PAM sequence: TAG
gaacatctgtcatctattaa

SEQ ID NO: 84743 - DNA, 20 bp, Artificial Sequence
  Description of Artificial Sequence: Synthetic oligonucleotide
  Target: ATXN1; (-) strand; PAM type: NRG; PAM sequence: AAG
agatttctctagaaggtttt

SEQ ID NO: 84744 - DNA, 20 bp, Artificial Sequence
  Description of Artificial Sequence: Synthetic oligonucleotide
  Target: ATXN1; (-) strand; PAM type: NRG; PAM sequence: AGG
ccttgagagatttctctaga

SEQ ID NO: 84745 - DNA, 20 bp, Artificial Sequence
  Description of Artificial Sequence: Synthetic oligonucleotide
  Target: ATXN1; (-) strand; PAM type: NRG; PAM sequence: AAG
gccttgagagatttctctag

SEQ ID NO: 84746 - DNA, 20 bp, Artificial Sequence
  Description of Artificial Sequence: Synthetic oligonucleotide
  Target: ATXN1; (-) strand; PAM type: NRG; PAM sequence: TAG
actgccttgagagatttctc

SEQ ID NO: 84747 - DNA, 20 bp, Artificial Sequence
  Description of Artificial Sequence: Synthetic oligonucleotide
  Target: ATXN1; (-) strand; PAM type: NRG; PAM sequence: GAG
cactatgtgcactgccttga

SEQ ID NO: 84748 - DNA, 20 bp, Artificial Sequence
  Description of Artificial Sequence: Synthetic oligonucleotide
  Target: ATXN1; (-) strand; PAM type: NRG; PAM sequence: GAG
ggcactatgtgcactgcctt

SEQ ID NO: 84749 - DNA, 20 bp, Artificial Sequence
  Description of Artificial Sequence: Synthetic oligonucleotide
  Target: ATXN1; (-) strand; PAM type: NRG; PAM sequence: TGG
caagcatgatattttgtatc

SEQ ID NO: 84750 - DNA, 20 bp, Artificial Sequence
  Description of Artificial Sequence: Synthetic oligonucleotide
  Target: ATXN1; (-) strand; PAM type: NRG; PAM sequence: AAG
aattagagaaaaatgagagc

SEQ ID NO: 84751 - DNA, 20 bp, Artificial Sequence
  Description of Artificial Sequence: Synthetic oligonucleotide
  Target: ATXN1; (-) strand; PAM type: NRG; PAM sequence: GAG
actcaattagagaaaaatga

SEQ ID NO: 84752 - DNA, 20 bp, Artificial Sequence
  Description of Artificial Sequence: Synthetic oligonucleotide
  Target: ATXN1; (-) strand; PAM type: NRG; PAM sequence: GAG
tcactcaattagagaaaaat

SEQ ID NO: 84753 - DNA, 20 bp, Artificial Sequence
  Description of Artificial Sequence: Synthetic oligonucleotide
  Target: ATXN1; (-) strand; PAM type: NRG; PAM sequence: GAG
ctttagtcctcactcaatta

SEQ ID NO: 84754 - DNA, 20 bp, Artificial Sequence
  Description of Artificial Sequence: Synthetic oligonucleotide
  Target: ATXN1; (-) strand; PAM type: NRG; PAM sequence: TAG
ttctttagtcctcactcaat

SEQ ID NO: 84755 - DNA, 20 bp, Artificial Sequence
  Description of Artificial Sequence: Synthetic oligonucleotide
  Target: ATXN1; (-) strand; PAM type: NRG; PAM sequence: TAG
aaaaacatgccagtgttctt

SEQ ID NO: 84756 - DNA, 20 bp, Artificial Sequence
  Description of Artificial Sequence: Synthetic oligonucleotide
  Target: ATXN1; (-) strand; PAM type: NRG; PAM sequence: CAG
caaaaacaaaaaaaacatgc

SEQ ID NO: 84757 - DNA, 20 bp, Artificial Sequence
  Description of Artificial Sequence: Synthetic oligonucleotide
  Target: ATXN1; (-) strand; PAM type: NRG; PAM sequence: AAG
agtaataaaaacaaaaaaat

SEQ ID NO: 84758 - DNA, 20 bp, Artificial Sequence
  Description of Artificial Sequence: Synthetic oligonucleotide
  Target: ATXN1; (-) strand; PAM type: NRG; PAM sequence: TAG
gcacatgtaccctaaaactt

SEQ ID NO: 84759 - DNA, 20 bp, Artificial Sequence
  Description of Artificial Sequence: Synthetic oligonucleotide
  Target: ATXN1; (-) strand; PAM type: NRG; PAM sequence: TGG
atggttgcagcacaccaaca

SEQ ID NO: 84760 - DNA, 20 bp, Artificial Sequence
  Description of Artificial Sequence: Synthetic oligonucleotide
  Target: ATXN1; (-) strand; PAM type: NRG; PAM sequence: CAG
aaatgacgagttaatggttg

SEQ ID NO: 84761 - DNA, 20 bp, Artificial Sequence
  Description of Artificial Sequence: Synthetic oligonucleotide
  Target: ATXN1; (-) strand; PAM type: NRG; PAM sequence: TGG
aatgctaaatgacgagttaa

SEQ ID NO: 84762 - DNA, 20 bp, Artificial Sequence
  Description of Artificial Sequence: Synthetic oligonucleotide
  Target: ATXN1; (-) strand; PAM type: NRG; PAM sequence: GAG
tatacctaatgctaaatgac

SEQ ID NO: 84763 - DNA, 20 bp, Artificial Sequence
  Description of Artificial Sequence: Synthetic oligonucleotide
  Target: ATXN1; (-) strand; PAM type: NRG; PAM sequence: GAG
ggggggagggatagcattag

SEQ ID NO: 84764 - DNA, 20 bp, Artificial Sequence
  Description of Artificial Sequence: Synthetic oligonucleotide
  Target: ATXN1; (-) strand; PAM type: NRG; PAM sequence: AGG
gaggggggagggatagcatt

SEQ ID NO: 84765 - DNA, 20 bp, Artificial Sequence
  Description of Artificial Sequence: Synthetic oligonucleotide
  Target: ATXN1; (-) strand; PAM type: NRG; PAM sequence: TAG
ggaggggggagggatagcat

SEQ ID NO: 84766 - DNA, 20 bp, Artificial Sequence
  Description of Artificial Sequence: Synthetic oligonucleotide
  Target: ATXN1; (-) strand; PAM type: NRG; PAM sequence: TAG
gttgggggaggggggaggga

SEQ ID NO: 84767 - DNA, 20 bp, Artificial Sequence
  Description of Artificial Sequence: Synthetic oligonucleotide
  Target: ATXN1; (-) strand; PAM type: NRG; PAM sequence: GGG
tggggttgggggagggggga

SEQ ID NO: 84768 - DNA, 20 bp, Artificial Sequence
  Description of Artificial Sequence: Synthetic oligonucleotide
  Target: ATXN1; (-) strand; PAM type: NRG; PAM sequence: AGG
gtggggttgggggagggggg

SEQ ID NO: 84769 - DNA, 20 bp, Artificial Sequence
  Description of Artificial Sequence: Synthetic oligonucleotide
  Target: ATXN1; (-) strand; PAM type: NRG; PAM sequence: GAG
tgtggggttgggggaggggg

SEQ ID NO: 84770 - DNA, 20 bp, Artificial Sequence
  Description of Artificial Sequence: Synthetic oligonucleotide
  Target: ATXN1; (-) strand; PAM type: NRG; PAM sequence: GGG
gttgtggggttgggggaggg

SEQ ID NO: 84771 - DNA, 20 bp, Artificial Sequence
  Description of Artificial Sequence: Synthetic oligonucleotide
  Target: ATXN1; (-) strand; PAM type: NRG; PAM sequence: GGG
tgttgtggggttgggggagg

SEQ ID NO: 84772 - DNA, 20 bp, Artificial Sequence
  Description of Artificial Sequence: Synthetic oligonucleotide
  Target: ATXN1; (-) strand; PAM type: NRG; PAM sequence: GGG
ctgttgtggggttgggggag

SEQ ID NO: 84773 - DNA, 20 bp, Artificial Sequence
  Description of Artificial Sequence: Synthetic oligonucleotide
  Target: ATXN1; (-) strand; PAM type: NRG; PAM sequence: GGG
cctgttgtggggttggggga

SEQ ID NO: 84774 - DNA, 20 bp, Artificial Sequence
  Description of Artificial Sequence: Synthetic oligonucleotide
  Target: ATXN1; (-) strand; PAM type: NRG; PAM sequence: AGG
gcctgttgtggggttggggg

SEQ ID NO: 84775 - DNA, 20 bp, Artificial Sequence
  Description of Artificial Sequence: Synthetic oligonucleotide
  Target: ATXN1; (-) strand; PAM type: NRG; PAM sequence: GAG
ggcctgttgtggggttgggg

SEQ ID NO: 84776 - DNA, 20 bp, Artificial Sequence
  Description of Artificial Sequence: Synthetic oligonucleotide
  Target: ATXN1; (-) strand; PAM type: NRG; PAM sequence: GGG
ggggcctgttgtggggttgg

SEQ ID NO: 84777 - DNA, 20 bp, Artificial Sequence
  Description of Artificial Sequence: Synthetic oligonucleotide
  Target: ATXN1; (-) strand; PAM type: NRG; PAM sequence: GGG
tggggcctgttgtggggttg

SEQ ID NO: 84778 - DNA, 20 bp, Artificial Sequence
  Description of Artificial Sequence: Synthetic oligonucleotide
  Target: ATXN1; (-) strand; PAM type: NRG; PAM sequence: GGG
ctggggcctgttgtggggtt

SEQ ID NO: 84779 - DNA, 20 bp, Artificial Sequence
  Description of Artificial Sequence: Synthetic oligonucleotide
  Target: ATXN1; (-) strand; PAM type: NRG; PAM sequence: TGG
actggggcctgttgtggggt

SEQ ID NO: 84780 - DNA, 20 bp, Artificial Sequence
  Description of Artificial Sequence: Synthetic oligonucleotide
  Target: ATXN1; (-) strand; PAM type: NRG; PAM sequence: GGG
acacactggggcctgttgtg

SEQ ID NO: 84781 - DNA, 20 bp, Artificial Sequence
  Description of Artificial Sequence: Synthetic oligonucleotide
  Target: ATXN1; (-) strand; PAM type: NRG; PAM sequence: GGG
cacacactggggcctgttgt

SEQ ID NO: 84782 - DNA, 20 bp, Artificial Sequence
  Description of Artificial Sequence: Synthetic oligonucleotide
  Target: ATXN1; (-) strand; PAM type: NRG; PAM sequence: TGG
tcacacactggggcctgttg

SEQ ID NO: 84783 - DNA, 20 bp, Artificial Sequence
  Description of Artificial Sequence: Synthetic oligonucleotide
  Target: ATXN1; (-) strand; PAM type: NRG; PAM sequence: GGG
aaggggaacatcacacactg

SEQ ID NO: 84784 - DNA, 20 bp, Artificial Sequence
  Description of Artificial Sequence: Synthetic oligonucleotide
  Target: ATXN1; (-) strand; PAM type: NRG; PAM sequence: GGG
gaaggggaacatcacacact

SEQ ID NO: 84785 - DNA, 20 bp, Artificial Sequence
  Description of Artificial Sequence: Synthetic oligonucleotide
  Target: ATXN1; (-) strand; PAM type: NRG; PAM sequence: TGG
ggaaggggaacatcacacac

SEQ ID NO: 84786 - DNA, 20 bp, Artificial Sequence
  Description of Artificial Sequence: Synthetic oligonucleotide
  Target: ATXN1; (-) strand; PAM type: NRG; PAM sequence: GGG
tgttccatggacacaggaag

SEQ ID NO: 84787 - DNA, 20 bp, Artificial Sequence
  Description of Artificial Sequence: Synthetic oligonucleotide
  Target: ATXN1; (-) strand; PAM type: NRG; PAM sequence: GGG
gtgttccatggacacaggaa

SEQ ID NO: 84788 - DNA, 20 bp, Artificial Sequence
  Description of Artificial Sequence: Synthetic oligonucleotide
  Target: ATXN1; (-) strand; PAM type: NRG; PAM sequence: AGG
tgtgttccatggacacagga

SEQ ID NO: 84789 - DNA, 20 bp, Artificial Sequence
  Description of Artificial Sequence: Synthetic oligonucleotide
  Target: ATXN1; (-) strand; PAM type: NRG; PAM sequence: AAG
ctgtgttccatggacacagg

SEQ ID NO: 84790 - DNA, 20 bp, Artificial Sequence
  Description of Artificial Sequence: Synthetic oligonucleotide
  Target: ATXN1; (-) strand; PAM type: NRG; PAM sequence: AGG
tgcctgtgttccatggacac

SEQ ID NO: 84791 - DNA, 20 bp, Artificial Sequence
  Description of Artificial Sequence: Synthetic oligonucleotide
  Target: ATXN1; (-) strand; PAM type: NRG; PAM sequence: CAG
atgcctgtgttccatggaca

SEQ ID NO: 84792 - DNA, 20 bp, Artificial Sequence
  Description of Artificial Sequence: Synthetic oligonucleotide
  Target: ATXN1; (-) strand; PAM type: NRG; PAM sequence: TGG
aaaaacatgcctgtgttcca

SEQ ID NO: 84793 - DNA, 20 bp, Artificial Sequence
  Description of Artificial Sequence: Synthetic oligonucleotide
  Target: ATXN1; (-) strand; PAM type: NRG; PAM sequence: AAG
gactctcaagaccaaaaggc

SEQ ID NO: 84794 - DNA, 20 bp, Artificial Sequence
  Description of Artificial Sequence: Synthetic oligonucleotide
  Target: ATXN1; (-) strand; PAM type: NRG; PAM sequence: AGG
tcttgactctcaagaccaaa

SEQ ID NO: 84795 - DNA, 20 bp, Artificial Sequence
  Description of Artificial Sequence: Synthetic oligonucleotide
  Target: ATXN1; (-) strand; PAM type: NRG; PAM sequence: AAG
atcttgactctcaagaccaa

SEQ ID NO: 84796 - DNA, 20 bp, Artificial Sequence
  Description of Artificial Sequence: Synthetic oligonucleotide
  Target: ATXN1; (-) strand; PAM type: NRG; PAM sequence: AAG
tggctaatatcttgactctc

SEQ ID NO: 84797 - DNA, 20 bp, Artificial Sequence
  Description of Artificial Sequence: Synthetic oligonucleotide
  Target: ATXN1; (-) strand; PAM type: NRG; PAM sequence: TGG
aagcttctggttcaattaca

SEQ ID NO: 84798 - DNA, 20 bp, Artificial Sequence
  Description of Artificial Sequence: Synthetic oligonucleotide
  Target: ATXN1; (-) strand; PAM type: NRG; PAM sequence: TGG
ttaataatatctaaagcttc

SEQ ID NO: 84799 - DNA, 20 bp, Artificial Sequence
  Description of Artificial Sequence: Synthetic oligonucleotide
  Target: ATXN1; (-) strand; PAM type: NRG; PAM sequence: AAG
gttctctttaataatatcta

SEQ ID NO: 84800 - DNA, 20 bp, Artificial Sequence
  Description of Artificial Sequence: Synthetic oligonucleotide
  Target: ATXN1; (-) strand; PAM type: NRG; PAM sequence: TAG
gcacccttggctgaactcta

SEQ ID NO: 84801 - DNA, 20 bp, Artificial Sequence
  Description of Artificial Sequence: Synthetic oligonucleotide
  Target: ATXN1; (-) strand; PAM type: NRG; PAM sequence: TGG
agcttctcagtgggcaccct

SEQ ID NO: 84802 - DNA, 20 bp, Artificial Sequence
  Description of Artificial Sequence: Synthetic oligonucleotide
  Target: ATXN1; (-) strand; PAM type: NRG; PAM sequence: GGG
ctagcatggagcttctcagt

SEQ ID NO: 84803 - DNA, 20 bp, Artificial Sequence
  Description of Artificial Sequence: Synthetic oligonucleotide
  Target: ATXN1; (-) strand; PAM type: NRG; PAM sequence: TGG
actagcatggagcttctcag

SEQ ID NO: 84804 - DNA, 20 bp, Artificial Sequence
  Description of Artificial Sequence: Synthetic oligonucleotide
  Target: ATXN1; (-) strand; PAM type: NRG; PAM sequence: CAG
taaactagcatggagcttct

SEQ ID NO: 84805 - DNA, 20 bp, Artificial Sequence
  Description of Artificial Sequence: Synthetic oligonucleotide
  Target: ATXN1; (-) strand; PAM type: NRG; PAM sequence: GAG
gtcacaaataaactagcatg

SEQ ID NO: 84806 - DNA, 20 bp, Artificial Sequence
  Description of Artificial Sequence: Synthetic oligonucleotide
  Target: ATXN1; (-) strand; PAM type: NRG; PAM sequence: TGG
aagtcacaaataaactagca

SEQ ID NO: 84807 - DNA, 20 bp, Artificial Sequence
  Description of Artificial Sequence: Synthetic oligonucleotide
  Target: ATXN1; (-) strand; PAM type: NRG; PAM sequence: TAG
tgagaaagtcacaaataaac

SEQ ID NO: 84808 - DNA, 20 bp, Artificial Sequence
  Description of Artificial Sequence: Synthetic oligonucleotide
  Target: ATXN1; (-) strand; PAM type: NRG; PAM sequence: AAG
cctaattctcttccctgaga

SEQ ID NO: 84809 - DNA, 20 bp, Artificial Sequence
  Description of Artificial Sequence: Synthetic oligonucleotide
  Target: ATXN1; (-) strand; PAM type: NRG; PAM sequence: GAG
cagacctaattctcttccct

SEQ ID NO: 84810 - DNA, 20 bp, Artificial Sequence
  Description of Artificial Sequence: Synthetic oligonucleotide
  Target: ATXN1; (-) strand; PAM type: NRG; PAM sequence: CAG
tatttcagtttgcagtagga

SEQ ID NO: 84811 - DNA, 20 bp, Artificial Sequence
  Description of Artificial Sequence: Synthetic oligonucleotide
  Target: ATXN1; (-) strand; PAM type: NRG; PAM sequence: AGG
attctatttcagtttgcagt

SEQ ID NO: 84812 - DNA, 20 bp, Artificial Sequence
  Description of Artificial Sequence: Synthetic oligonucleotide
  Target: ATXN1; (-) strand; PAM type: NRG; PAM sequence: TAG
tattctatttcagtttgcag

SEQ ID NO: 84813 - DNA, 20 bp, Artificial Sequence
  Description of Artificial Sequence: Synthetic oligonucleotide
  Target: ATXN1; (-) strand; PAM type: NRG; PAM sequence: CAG
ctttattctatttcagtttg

SEQ ID NO: 84814 - DNA, 20 bp, Artificial Sequence
  Description of Artificial Sequence: Synthetic oligonucleotide
  Target: ATXN1; (-) strand; PAM type: NRG; PAM sequence: CAG
tatcctactttattctattt

SEQ ID NO: 84815 - DNA, 20 bp, Artificial Sequence
  Description of Artificial Sequence: Synthetic oligonucleotide
  Target: ATXN1; (-) strand; PAM type: NRG; PAM sequence: TAG
gagaattttttgccaagagt

SEQ ID NO: 84816 - DNA, 20 bp, Artificial Sequence
  Description of Artificial Sequence: Synthetic oligonucleotide
  Target: ATXN1; (-) strand; PAM type: NRG; PAM sequence: GAG
ggctgagaattttttgccaa

SEQ ID NO: 84817 - DNA, 20 bp, Artificial Sequence
  Description of Artificial Sequence: Synthetic oligonucleotide
  Target: ATXN1; (-) strand; PAM type: NRG; PAM sequence: AAG
atggctgagaattttttgcc

SEQ ID NO: 84818 - DNA, 20 bp, Artificial Sequence
  Description of Artificial Sequence: Synthetic oligonucleotide
  Target: ATXN1; (-) strand; PAM type: NRG; PAM sequence: GAG
ggatgtcattaagaatggct

SEQ ID NO: 84819 - DNA, 20 bp, Artificial Sequence
  Description of Artificial Sequence: Synthetic oligonucleotide
  Target: ATXN1; (-) strand; PAM type: NRG; PAM sequence: TGG
ggtatggatgtcattaagaa

SEQ ID NO: 84820 - DNA, 20 bp, Artificial Sequence
  Description of Artificial Sequence: Synthetic oligonucleotide
  Target: ATXN1; (-) strand; PAM type: NRG; PAM sequence: AAG
ctggaggtatggatgtcatt

SEQ ID NO: 84821 - DNA, 20 bp, Artificial Sequence
  Description of Artificial Sequence: Synthetic oligonucleotide
  Target: ATXN1; (-) strand; PAM type: NRG; PAM sequence: TGG
agggcatggaactggaggta

SEQ ID NO: 84822 - DNA, 20 bp, Artificial Sequence
  Description of Artificial Sequence: Synthetic oligonucleotide
  Target: ATXN1; (-) strand; PAM type: NRG; PAM sequence: AGG
tgaacagggcatggaactgg

SEQ ID NO: 84823 - DNA, 20 bp, Artificial Sequence
  Description of Artificial Sequence: Synthetic oligonucleotide
  Target: ATXN1; (-) strand; PAM type: NRG; PAM sequence: GAG
ttgaacagggcatggaactg

SEQ ID NO: 84824 - DNA, 20 bp, Artificial Sequence
  Description of Artificial Sequence: Synthetic oligonucleotide
  Target: ATXN1; (-) strand; PAM type: NRG; PAM sequence: TGG
gcttgaacagggcatggaac

SEQ ID NO: 84825 - DNA, 20 bp, Artificial Sequence
  Description of Artificial Sequence: Synthetic oligonucleotide
  Target: ATXN1; (-) strand; PAM type: NRG; PAM sequence: TGG
cgaaatgcttgaacagggca

SEQ ID NO: 84826 - DNA, 20 bp, Artificial Sequence
  Description of Artificial Sequence: Synthetic oligonucleotide
  Target: ATXN1; (-) strand; PAM type: NRG; PAM sequence: GGG
gtatacgaaatgcttgaaca

SEQ ID NO: 84827 - DNA, 20 bp, Artificial Sequence
  Description of Artificial Sequence: Synthetic oligonucleotide
  Target: ATXN1; (-) strand; PAM type: NRG; PAM sequence: AGG
ggtatacgaaatgcttgaac

SEQ ID NO: 84828 - DNA, 20 bp, Artificial Sequence
  Description of Artificial Sequence: Synthetic oligonucleotide
  Target: ATXN1; (-) strand; PAM type: NRG; PAM sequence: CAG
aggtatacgaaatgcttgaa

SEQ ID NO: 84829 - DNA, 20 bp, Artificial Sequence
  Description of Artificial Sequence: Synthetic oligonucleotide
  Target: ATXN1; (-) strand; PAM type: NRG; PAM sequence: AGG
ggcattcctactgaaaacag

SEQ ID NO: 84830 - DNA, 20 bp, Artificial Sequence
  Description of Artificial Sequence: Synthetic oligonucleotide
  Target: ATXN1; (-) strand; PAM type: NRG; PAM sequence: GAG
tggcattcctactgaaaaca

SEQ ID NO: 84831 - DNA, 20 bp, Artificial Sequence
  Description of Artificial Sequence: Synthetic oligonucleotide
  Target: ATXN1; (-) strand; PAM type: NRG; PAM sequence: CAG
tgtggcattcctactgaaaa

SEQ ID NO: 84832 - DNA, 20 bp, Artificial Sequence
  Description of Artificial Sequence: Synthetic oligonucleotide
  Target: ATXN1; (-) strand; PAM type: NRG; PAM sequence: TGG
aaaagctccataccagtttg

SEQ ID NO: 84833 - DNA, 20 bp, Artificial Sequence
  Description of Artificial Sequence: Synthetic oligonucleotide
  Target: ATXN1; (-) strand; PAM type: NRG; PAM sequence: CAG
aaataataaaagctccatac

SEQ ID NO: 84834 - DNA, 20 bp, Artificial Sequence
  Description of Artificial Sequence: Synthetic oligonucleotide
  Target: ATXN1; (-) strand; PAM type: NRG; PAM sequence: AAG
aaaataaaataaaataataa

SEQ ID NO: 84835 - DNA, 20 bp, Artificial Sequence
  Description of Artificial Sequence: Synthetic oligonucleotide
  Target: ATXN1; (-) strand; PAM type: NRG; PAM sequence: AAG
ccctatctcaaaataaaata

SEQ ID NO: 84836 - DNA, 20 bp, Artificial Sequence
  Description of Artificial Sequence: Synthetic oligonucleotide
  Target: ATXN1; (-) strand; PAM type: NRG; PAM sequence: TAG
caagaccagactgggcaaca

SEQ ID NO: 84837 - DNA, 20 bp, Artificial Sequence
  Description of Artificial Sequence: Synthetic oligonucleotide
  Target: ATXN1; (-) strand; PAM type: NRG; PAM sequence: GGG
caggagttcaagaccagact

SEQ ID NO: 84838 - DNA, 20 bp, Artificial Sequence
  Description of Artificial Sequence: Synthetic oligonucleotide
  Target: ATXN1; (-) strand; PAM type: NRG; PAM sequence: TGG
ccaggagttcaagaccagac

SEQ ID NO: 84839 - DNA, 20 bp, Artificial Sequence
  Description of Artificial Sequence: Synthetic oligonucleotide
  Target: ATXN1; (-) strand; PAM type: NRG; PAM sequence: CAG
tgaggccaggagttcaagac

SEQ ID NO: 84840 - DNA, 20 bp, Artificial Sequence
  Description of Artificial Sequence: Synthetic oligonucleotide
  Target: ATXN1; (-) strand; PAM type: NRG; PAM sequence: AAG
ttgcttgaggccaggagttc

SEQ ID NO: 84841 - DNA, 20 bp, Artificial Sequence
  Description of Artificial Sequence: Synthetic oligonucleotide
  Target: ATXN1; (-) strand; PAM type: NRG; PAM sequence: GAG
ggaggattgcttgaggccag

SEQ ID NO: 84842 - DNA, 20 bp, Artificial Sequence
  Description of Artificial Sequence: Synthetic oligonucleotide
  Target: ATXN1; (-) strand; PAM type: NRG; PAM sequence: AGG
tgggaggattgcttgaggcc

SEQ ID NO: 84843 - DNA, 20 bp, Artificial Sequence
  Description of Artificial Sequence: Synthetic oligonucleotide
  Target: ATXN1; (-) strand; PAM type: NRG; PAM sequence: CAG
gtgggaggattgcttgaggc

SEQ ID NO: 84844 - DNA, 20 bp, Artificial Sequence
  Description of Artificial Sequence: Synthetic oligonucleotide
  Target: ATXN1; (-) strand; PAM type: NRG; PAM sequence: AGG
caaggtgggaggattgcttg

SEQ ID NO: 84845 - DNA, 20 bp, Artificial Sequence
  Description of Artificial Sequence: Synthetic oligonucleotide
  Target: ATXN1; (-) strand; PAM type: NRG; PAM sequence: GAG
ccaaggtgggaggattgctt

SEQ ID NO: 84846 - DNA, 20 bp, Artificial Sequence
  Description of Artificial Sequence: Synthetic oligonucleotide
  Target: ATXN1; (-) strand; PAM type: NRG; PAM sequence: AGG
acccaggaggccaaggtggg

SEQ ID NO: 84847 - DNA, 20 bp, Artificial Sequence
  Description of Artificial Sequence: Synthetic oligonucleotide
  Target: ATXN1; (-) strand; PAM type: NRG; PAM sequence: GAG
tacccaggaggccaaggtgg

SEQ ID NO: 84848 - DNA, 20 bp, Artificial Sequence
  Description of Artificial Sequence: Synthetic oligonucleotide
  Target: ATXN1; (-) strand; PAM type: NRG; PAM sequence: GGG
cttacccaggaggccaaggt

SEQ ID NO: 84849 - DNA, 20 bp, Artificial Sequence
  Description of Artificial Sequence: Synthetic oligonucleotide
  Target: ATXN1; (-) strand; PAM type: NRG; PAM sequence: TGG
ccttacccaggaggccaagg

SEQ ID NO: 84850 - DNA, 20 bp, Artificial Sequence
  Description of Artificial Sequence: Synthetic oligonucleotide
  Target: ATXN1; (-) strand; PAM type: NRG; PAM sequence: AGG
gatccttacccaggaggcca

SEQ ID NO: 84851 - DNA, 20 bp, Artificial Sequence
  Description of Artificial Sequence: Synthetic oligonucleotide
  Target: ATXN1; (-) strand; PAM type: NRG; PAM sequence: AAG
agatccttacccaggaggcc

SEQ ID NO: 84852 - DNA, 20 bp, Artificial Sequence
  Description of Artificial Sequence: Synthetic oligonucleotide
  Target: ATXN1; (-) strand; PAM type: NRG; PAM sequence: AGG
tacaaagatccttacccagg

SEQ ID NO: 84853 - DNA, 20 bp, Artificial Sequence
  Description of Artificial Sequence: Synthetic oligonucleotide
  Target: ATXN1; (-) strand; PAM type: NRG; PAM sequence: GAG
ttacaaagatccttacccag

SEQ ID NO: 84854 - DNA, 20 bp, Artificial Sequence
  Description of Artificial Sequence: Synthetic oligonucleotide
  Target: ATXN1; (-) strand; PAM type: NRG; PAM sequence: AGG
cattacaaagatccttaccc

SEQ ID NO: 84855 - DNA, 20 bp, Artificial Sequence
  Description of Artificial Sequence: Synthetic oligonucleotide
  Target: ATXN1; (-) strand; PAM type: NRG; PAM sequence: CAG
tcattacaaagatccttacc

SEQ ID NO: 84856 - DNA, 20 bp, Artificial Sequence
  Description of Artificial Sequence: Synthetic oligonucleotide
  Target: ATXN1; (-) strand; PAM type: NRG; PAM sequence: AAG
aaataataatattcattaca

SEQ ID NO: 84857 - DNA, 20 bp, Artificial Sequence
  Description of Artificial Sequence: Synthetic oligonucleotide
  Target: ATXN1; (-) strand; PAM type: NRG; PAM sequence: CAG
ggtggattctgggcttcctg

SEQ ID NO: 84858 - DNA, 20 bp, Artificial Sequence
  Description of Artificial Sequence: Synthetic oligonucleotide
  Target: ATXN1; (-) strand; PAM type: NRG; PAM sequence: GGG
aagaaaatggggtggattct

SEQ ID NO: 84859 - DNA, 20 bp, Artificial Sequence
  Description of Artificial Sequence: Synthetic oligonucleotide
  Target: ATXN1; (-) strand; PAM type: NRG; PAM sequence: TGG
caagaaaatggggtggattc

SEQ ID NO: 84860 - DNA, 20 bp, Artificial Sequence
  Description of Artificial Sequence: Synthetic oligonucleotide
  Target: ATXN1; (-) strand; PAM type: NRG; PAM sequence: TGG
atgatgccaagaaaatgggg

SEQ ID NO: 84861 - DNA, 20 bp, Artificial Sequence
  Description of Artificial Sequence: Synthetic oligonucleotide
  Target: ATXN1; (-) strand; PAM type: NRG; PAM sequence: GGG
attatgatgccaagaaaatg

SEQ ID NO: 84862 - DNA, 20 bp, Artificial Sequence
  Description of Artificial Sequence: Synthetic oligonucleotide
  Target: ATXN1; (-) strand; PAM type: NRG; PAM sequence: GGG
aattatgatgccaagaaaat

SEQ ID NO: 84863 - DNA, 20 bp, Artificial Sequence
  Description of Artificial Sequence: Synthetic oligonucleotide
  Target: ATXN1; (-) strand; PAM type: NRG; PAM sequence: TGG
taattatgatgccaagaaaa

SEQ ID NO: 84864 - DNA, 20 bp, Artificial Sequence
  Description of Artificial Sequence: Synthetic oligonucleotide
  Target: ATXN1; (-) strand; PAM type: NRG; PAM sequence: AAG
caaagagtaattatgatgcc

SEQ ID NO: 84865 - DNA, 20 bp, Artificial Sequence
  Description of Artificial Sequence: Synthetic oligonucleotide
  Target: ATXN1; (-) strand; PAM type: NRG; PAM sequence: GAG
gtacagcacaatttctcaaa

SEQ ID NO: 84866 - DNA, 20 bp, Artificial Sequence
  Description of Artificial Sequence: Synthetic oligonucleotide
  Target: ATXN1; (-) strand; PAM type: NRG; PAM sequence: AAG
gtgtacagcacaatttctca

SEQ ID NO: 84867 - DNA, 20 bp, Artificial Sequence
  Description of Artificial Sequence: Synthetic oligonucleotide
  Target: ATXN1; (-) strand; PAM type: NRG; PAM sequence: CAG
ctcattttatacaaagtgta

SEQ ID NO: 84868 - DNA, 20 bp, Artificial Sequence
  Description of Artificial Sequence: Synthetic oligonucleotide
  Target: ATXN1; (-) strand; PAM type: NRG; PAM sequence: AAG
acatgctctcattttataca

SEQ ID NO: 84869 - DNA, 20 bp, Artificial Sequence
  Description of Artificial Sequence: Synthetic oligonucleotide
  Target: ATXN1; (-) strand; PAM type: NRG; PAM sequence: AGG
tgagtttgacatactatggg

SEQ ID NO: 84870 - DNA, 20 bp, Artificial Sequence
  Description of Artificial Sequence: Synthetic oligonucleotide
  Target: ATXN1; (-) strand; PAM type: NRG; PAM sequence: GAG
gtgagtttgacatactatgg

SEQ ID NO: 84871 - DNA, 20 bp, Artificial Sequence
  Description of Artificial Sequence: Synthetic oligonucleotide
  Target: ATXN1; (-) strand; PAM type: NRG; PAM sequence: GGG
tcgtgagtttgacatactat

SEQ ID NO: 84872 - DNA, 20 bp, Artificial Sequence
  Description of Artificial Sequence: Synthetic oligonucleotide
  Target: ATXN1; (-) strand; PAM type: NRG; PAM sequence: TGG
ctcgtgagtttgacatacta

SEQ ID NO: 84873 - DNA, 20 bp, Artificial Sequence
  Description of Artificial Sequence: Synthetic oligonucleotide
  Target: ATXN1; (-) strand; PAM type: NRG; PAM sequence: GAG
aggagaaggaaatgcctcgt

SEQ ID NO: 84874 - DNA, 20 bp, Artificial Sequence
  Description of Artificial Sequence: Synthetic oligonucleotide
  Target: ATXN1; (-) strand; PAM type: NRG; PAM sequence: AGG
aaaggagggtttggaggaga

SEQ ID NO: 84875 - DNA, 20 bp, Artificial Sequence
  Description of Artificial Sequence: Synthetic oligonucleotide
  Target: ATXN1; (-) strand; PAM type: NRG; PAM sequence: AAG
gaaaggagggtttggaggag

SEQ ID NO: 84876 - DNA, 20 bp, Artificial Sequence
  Description of Artificial Sequence: Synthetic oligonucleotide
  Target: ATXN1; (-) strand; PAM type: NRG; PAM sequence: GAG
agagaaaggagggtttggag

SEQ ID NO: 84877 - DNA, 20 bp, Artificial Sequence
  Description of Artificial Sequence: Synthetic oligonucleotide
  Target: ATXN1; (-) strand; PAM type: NRG; PAM sequence: AGG
tgagagaaaggagggtttgg

SEQ ID NO: 84878 - DNA, 20 bp, Artificial Sequence
  Description of Artificial Sequence: Synthetic oligonucleotide
  Target: ATXN1; (-) strand; PAM type: NRG; PAM sequence: GAG
ctgagagaaaggagggtttg

SEQ ID NO: 84879 - DNA, 20 bp, Artificial Sequence
  Description of Artificial Sequence: Synthetic oligonucleotide
  Target: ATXN1; (-) strand; PAM type: NRG; PAM sequence: TGG
gtctgagagaaaggagggtt

SEQ ID NO: 84880 - DNA, 20 bp, Artificial Sequence
  Description of Artificial Sequence: Synthetic oligonucleotide
  Target: ATXN1; (-) strand; PAM type: NRG; PAM sequence: GGG
ggtttgtctgagagaaagga

SEQ ID NO: 84881 - DNA, 20 bp, Artificial Sequence
  Description of Artificial Sequence: Synthetic oligonucleotide
  Target: ATXN1; (-) strand; PAM type: NRG; PAM sequence: AGG
tggtttgtctgagagaaagg

SEQ ID NO: 84882 - DNA, 20 bp, Artificial Sequence
  Description of Artificial Sequence: Synthetic oligonucleotide
  Target: ATXN1; (-) strand; PAM type: NRG; PAM sequence: GAG
ttggtttgtctgagagaaag

SEQ ID NO: 84883 - DNA, 20 bp, Artificial Sequence
  Description of Artificial Sequence: Synthetic oligonucleotide
  Target: ATXN1; (-) strand; PAM type: NRG; PAM sequence: AGG
acttggtttgtctgagagaa

SEQ ID NO: 84884 - DNA, 20 bp, Artificial Sequence
  Description of Artificial Sequence: Synthetic oligonucleotide
  Target: ATXN1; (-) strand; PAM type: NRG; PAM sequence: AAG
tacttggtttgtctgagaga

SEQ ID NO: 84885 - DNA, 20 bp, Artificial Sequence
  Description of Artificial Sequence: Synthetic oligonucleotide
  Target: ATXN1; (-) strand; PAM type: NRG; PAM sequence: GAG
caattacttggtttgtctga

SEQ ID NO: 84886 - DNA, 20 bp, Artificial Sequence
  Description of Artificial Sequence: Synthetic oligonucleotide
  Target: ATXN1; (-) strand; PAM type: NRG; PAM sequence: GAG
ttcaattacttggtttgtct

SEQ ID NO: 84887 - DNA, 20 bp, Artificial Sequence
  Description of Artificial Sequence: Synthetic oligonucleotide
  Target: ATXN1; (-) strand; PAM type: NRG; PAM sequence: TGG
aatacatgtcttcaattact

SEQ ID NO: 84888 - DNA, 20 bp, Artificial Sequence
  Description of Artificial Sequence: Synthetic oligonucleotide
  Target: ATXN1; (-) strand; PAM type: NRG; PAM sequence: TAG
gtaaagaaacagtctgctct

SEQ ID NO: 84889 - DNA, 20 bp, Artificial Sequence
  Description of Artificial Sequence: Synthetic oligonucleotide
  Target: ATXN1; (-) strand; PAM type: NRG; PAM sequence: CAG
agtttgatgtggtaaagaaa

SEQ ID NO: 84890 - DNA, 20 bp, Artificial Sequence
  Description of Artificial Sequence: Synthetic oligonucleotide
  Target: ATXN1; (-) strand; PAM type: NRG; PAM sequence: AAG
cacagaagtttgatgtggta

SEQ ID NO: 84891 - DNA, 20 bp, Artificial Sequence
  Description of Artificial Sequence: Synthetic oligonucleotide
  Target: ATXN1; (-) strand; PAM type: NRG; PAM sequence: TGG
ttctgcacagaagtttgatg

SEQ ID NO: 84892 - DNA, 20 bp, Artificial Sequence
  Description of Artificial Sequence: Synthetic oligonucleotide
  Target: ATXN1; (-) strand; PAM type: NRG; PAM sequence: AAG
ctttcttaacttctgcacag

SEQ ID NO: 84893 - DNA, 20 bp, Artificial Sequence
  Description of Artificial Sequence: Synthetic oligonucleotide
  Target: ATXN1; (-) strand; PAM type: NRG; PAM sequence: CAG
ctcctttcttaacttctgca

SEQ ID NO: 84894 - DNA, 20 bp, Artificial Sequence
  Description of Artificial Sequence: Synthetic oligonucleotide
  Target: ATXN1; (-) strand; PAM type: NRG; PAM sequence: GAG
gtcattaggaataagcatta

SEQ ID NO: 84895 - DNA, 20 bp, Artificial Sequence
  Description of Artificial Sequence: Synthetic oligonucleotide
  Target: ATXN1; (-) strand; PAM type: NRG; PAM sequence: TAG
cagtcattaggaataagcat

SEQ ID NO: 84896 - DNA, 20 bp, Artificial Sequence
  Description of Artificial Sequence: Synthetic oligonucleotide
  Target: ATXN1; (-) strand; PAM type: NRG; PAM sequence: AAG
ctatcacagtcattaggaat

SEQ ID NO: 84897 - DNA, 20 bp, Artificial Sequence
  Description of Artificial Sequence: Synthetic oligonucleotide
  Target: ATXN1; (-) strand; PAM type: NRG; PAM sequence: AGG
gaaagtctatcacagtcatt

SEQ ID NO: 84898 - DNA, 20 bp, Artificial Sequence
  Description of Artificial Sequence: Synthetic oligonucleotide
  Target: ATXN1; (-) strand; PAM type: NRG; PAM sequence: TAG
agaaagtctatcacagtcat

SEQ ID NO: 84899 - DNA, 20 bp, Artificial Sequence
  Description of Artificial Sequence: Synthetic oligonucleotide
  Target: ATXN1; (-) strand; PAM type: NRG; PAM sequence: CAG
tcaaggcagaaagtctatca

SEQ ID NO: 84900 - DNA, 20 bp, Artificial Sequence
  Description of Artificial Sequence: Synthetic oligonucleotide
  Target: ATXN1; (-) strand; PAM type: NRG; PAM sequence: AAG
aatgcaccattcaaggcaga

SEQ ID NO: 84901 - DNA, 20 bp, Artificial Sequence
  Description of Artificial Sequence: Synthetic oligonucleotide
  Target: ATXN1; (-) strand; PAM type: NRG; PAM sequence: CAG
tggaaatgcaccattcaagg

SEQ ID NO: 84902 - DNA, 20 bp, Artificial Sequence
  Description of Artificial Sequence: Synthetic oligonucleotide
  Target: ATXN1; (-) strand; PAM type: NRG; PAM sequence: AGG
aaatggaaatgcaccattca

SEQ ID NO: 84903 - DNA, 20 bp, Artificial Sequence
  Description of Artificial Sequence: Synthetic oligonucleotide
  Target: ATXN1; (-) strand; PAM type: NRG; PAM sequence: AAG
caaatggaaatgcaccattc

SEQ ID NO: 84904 - DNA, 20 bp, Artificial Sequence
  Description of Artificial Sequence: Synthetic oligonucleotide
  Target: ATXN1; (-) strand; PAM type: NRG; PAM sequence: TGG
ctataaatggagcttacaaa

SEQ ID NO: 84905 - DNA, 20 bp, Artificial Sequence
  Description of Artificial Sequence: Synthetic oligonucleotide
  Target: ATXN1; (-) strand; PAM type: NRG; PAM sequence: GAG
cttgtgtgattctataaatg

SEQ ID NO: 84906 - DNA, 20 bp, Artificial Sequence
  Description of Artificial Sequence: Synthetic oligonucleotide
  Target: ATXN1; (-) strand; PAM type: NRG; PAM sequence: TGG
aacttgtgtgattctataaa

SEQ ID NO: 84907 - DNA, 20 bp, Artificial Sequence
  Description of Artificial Sequence: Synthetic oligonucleotide
  Target: ATXN1; (-) strand; PAM type: NRG; PAM sequence: AGG
gggtgttaggtttcagagga

SEQ ID NO: 84908 - DNA, 20 bp, Artificial Sequence
  Description of Artificial Sequence: Synthetic oligonucleotide
  Target: ATXN1; (-) strand; PAM type: NRG; PAM sequence: AAG
agggtgttaggtttcagagg

SEQ ID NO: 84909 - DNA, 20 bp, Artificial Sequence
  Description of Artificial Sequence: Synthetic oligonucleotide
  Target: ATXN1; (-) strand; PAM type: NRG; PAM sequence: AGG
atcagggtgttaggtttcag

SEQ ID NO: 84910 - DNA, 20 bp, Artificial Sequence
  Description of Artificial Sequence: Synthetic oligonucleotide
  Target: ATXN1; (-) strand; PAM type: NRG; PAM sequence: GAG
gatcagggtgttaggtttca

SEQ ID NO: 84911 - DNA, 20 bp, Artificial Sequence
  Description of Artificial Sequence: Synthetic oligonucleotide
  Target: ATXN1; (-) strand; PAM type: NRG; PAM sequence: CAG
aagatcagggtgttaggttt

SEQ ID NO: 84912 - DNA, 20 bp, Artificial Sequence
  Description of Artificial Sequence: Synthetic oligonucleotide
  Target: ATXN1; (-) strand; PAM type: NRG; PAM sequence: AGG
aagggtaagatcagggtgtt

SEQ ID NO: 84913 - DNA, 20 bp, Artificial Sequence
  Description of Artificial Sequence: Synthetic oligonucleotide
  Target: ATXN1; (-) strand; PAM type: NRG; PAM sequence: TAG
aaagggtaagatcagggtgt

SEQ ID NO: 84914 - DNA, 20 bp, Artificial Sequence
  Description of Artificial Sequence: Synthetic oligonucleotide
  Target: ATXN1; (-) strand; PAM type: NRG; PAM sequence: GGG
tacaaaaaagggtaagatca

SEQ ID NO: 84915 - DNA, 20 bp, Artificial Sequence
  Description of Artificial Sequence: Synthetic oligonucleotide
  Target: ATXN1; (-) strand; PAM type: NRG; PAM sequence: AGG
atacaaaaaagggtaagatc

SEQ ID NO: 84916 - DNA, 20 bp, Artificial Sequence
  Description of Artificial Sequence: Synthetic oligonucleotide
  Target: ATXN1; (-) strand; PAM type: NRG; PAM sequence: CAG
tatacaaaaaagggtaagat

SEQ ID NO: 84917 - DNA, 20 bp, Artificial Sequence
  Description of Artificial Sequence: Synthetic oligonucleotide
  Target: ATXN1; (-) strand; PAM type: NRG; PAM sequence: AAG
tgatgtatacaaaaaagggt

SEQ ID NO: 84918 - DNA, 20 bp, Artificial Sequence
  Description of Artificial Sequence: Synthetic oligonucleotide
  Target: ATXN1; (-) strand; PAM type: NRG; PAM sequence: GGG
agagtgatgtatacaaaaaa

SEQ ID NO: 84919 - DNA, 20 bp, Artificial Sequence
  Description of Artificial Sequence: Synthetic oligonucleotide
  Target: ATXN1; (-) strand; PAM type: NRG; PAM sequence: AGG
aagagtgatgtatacaaaaa

SEQ ID NO: 84920 - DNA, 20 bp, Artificial Sequence
  Description of Artificial Sequence: Synthetic oligonucleotide
  Target: ATXN1; (-) strand; PAM type: NRG; PAM sequence: AAG
caagagtgatgtatacaaaa

SEQ ID NO: 84921 - DNA, 20 bp, Artificial Sequence
  Description of Artificial Sequence: Synthetic oligonucleotide
  Target: ATXN1; (-) strand; PAM type: NRG; PAM sequence: GAG
ttgttgaaaatttccaccaa

SEQ ID NO: 84922 - DNA, 20 bp, Artificial Sequence
  Description of Artificial Sequence: Synthetic oligonucleotide
  Target: ATXN1; (-) strand; PAM type: NRG; PAM sequence: AAG
ggttgttgaaaatttccacc

SEQ ID NO: 84923 - DNA, 20 bp, Artificial Sequence
  Description of Artificial Sequence: Synthetic oligonucleotide
  Target: ATXN1; (-) strand; PAM type: NRG; PAM sequence: TGG
cgccctttcccccacctttg

SEQ ID NO: 84924 - DNA, 20 bp, Artificial Sequence
  Description of Artificial Sequence: Synthetic oligonucleotide
  Target: ATXN1; (-) strand; PAM type: NRG; PAM sequence: CAG
aggaaacatgactaaggagt

SEQ ID NO: 84925 - DNA, 20 bp, Artificial Sequence
  Description of Artificial Sequence: Synthetic oligonucleotide
  Target: ATXN1; (-) strand; PAM type: NRG; PAM sequence: GAG
catcaggaaacatgactaag

SEQ ID NO: 84926 - DNA, 20 bp, Artificial Sequence
  Description of Artificial Sequence: Synthetic oligonucleotide
  Target: ATXN1; (-) strand; PAM type: NRG; PAM sequence: AGG
aacatcaggaaacatgacta

SEQ ID NO: 84927 - DNA, 20 bp, Artificial Sequence
  Description of Artificial Sequence: Synthetic oligonucleotide
  Target: ATXN1; (-) strand; PAM type: NRG; PAM sequence: AAG
caacatcaggaaacatgact

SEQ ID NO: 84928 - DNA, 20 bp, Artificial Sequence
  Description of Artificial Sequence: Synthetic oligonucleotide
  Target: ATXN1; (-) strand; PAM type: NRG; PAM sequence: AGG
tacactaaaatggcaacatc

SEQ ID NO: 84929 - DNA, 20 bp, Artificial Sequence
  Description of Artificial Sequence: Synthetic oligonucleotide
  Target: ATXN1; (-) strand; PAM type: NRG; PAM sequence: CAG
atacactaaaatggcaacat

SEQ ID NO: 84930 - DNA, 20 bp, Artificial Sequence
  Description of Artificial Sequence: Synthetic oligonucleotide
  Target: ATXN1; (-) strand; PAM type: NRG; PAM sequence: TGG
atacttaaaatacactaaaa

SEQ ID NO: 84931 - DNA, 20 bp, Artificial Sequence
  Description of Artificial Sequence: Synthetic oligonucleotide
  Target: ATXN1; (-) strand; PAM type: NRG; PAM sequence: AAG
tgaactataattgttgccat

SEQ ID NO: 84932 - DNA, 20 bp, Artificial Sequence
  Description of Artificial Sequence: Synthetic oligonucleotide
  Target: ATXN1; (-) strand; PAM type: NRG; PAM sequence: CAG
tgccggatggaaaaagagaa

SEQ ID NO: 84933 - DNA, 20 bp, Artificial Sequence
  Description of Artificial Sequence: Synthetic oligonucleotide
  Target: ATXN1; (-) strand; PAM type: NRG; PAM sequence: GAG
gggtctgccggatggaaaaa

SEQ ID NO: 84934 - DNA, 20 bp, Artificial Sequence
  Description of Artificial Sequence: Synthetic oligonucleotide
  Target: ATXN1; (-) strand; PAM type: NRG; PAM sequence: AAG
gggggtctgccggatggaaa

SEQ ID NO: 84935 - DNA, 20 bp, Artificial Sequence
  Description of Artificial Sequence: Synthetic oligonucleotide
  Target: ATXN1; (-) strand; PAM type: NRG; PAM sequence: TGG
caccaagggggtctgccgga

SEQ ID NO: 84936 - DNA, 20 bp, Artificial Sequence
  Description of Artificial Sequence: Synthetic oligonucleotide
  Target: ATXN1; (-) strand; PAM type: NRG; PAM sequence: CGG
agcacaccaagggggtctgc

SEQ ID NO: 84937 - DNA, 20 bp, Artificial Sequence
  Description of Artificial Sequence: Synthetic oligonucleotide
  Target: ATXN1; (-) strand; PAM type: NRG; PAM sequence: GGG
tgtagtagagcacaccaagg

SEQ ID NO: 84938 - DNA, 20 bp, Artificial Sequence
  Description of Artificial Sequence: Synthetic oligonucleotide
  Target: ATXN1; (-) strand; PAM type: NRG; PAM sequence: GGG
ttgtagtagagcacaccaag

SEQ ID NO: 84939 - DNA, 20 bp, Artificial Sequence
  Description of Artificial Sequence: Synthetic oligonucleotide
  Target: ATXN1; (-) strand; PAM type: NRG; PAM sequence: GGG
tttgtagtagagcacaccaa

SEQ ID NO: 84940 - DNA, 20 bp, Artificial Sequence
  Description of Artificial Sequence: Synthetic oligonucleotide
  Target: ATXN1; (-) strand; PAM type: NRG; PAM sequence: AGG
ttttgtagtagagcacacca

SEQ ID NO: 84941 - DNA, 20 bp, Artificial Sequence
  Description of Artificial Sequence: Synthetic oligonucleotide
  Target: ATXN1; (-) strand; PAM type: NRG; PAM sequence: AAG
cttttgtagtagagcacacc

SEQ ID NO: 84942 - DNA, 20 bp, Artificial Sequence
  Description of Artificial Sequence: Synthetic oligonucleotide
  Target: ATXN1; (-) strand; PAM type: NRG; PAM sequence: GAG
gaaaactgccttttgtagta

SEQ ID NO: 84943 - DNA, 20 bp, Artificial Sequence
  Description of Artificial Sequence: Synthetic oligonucleotide
  Target: ATXN1; (-) strand; PAM type: NRG; PAM sequence: TAG
cagaaaactgccttttgtag

SEQ ID NO: 84944 - DNA, 20 bp, Artificial Sequence
  Description of Artificial Sequence: Synthetic oligonucleotide
  Target: ATXN1; (-) strand; PAM type: NRG; PAM sequence: TAG
attcagaaaactgccttttg

SEQ ID NO: 84945 - DNA, 20 bp, Artificial Sequence
  Description of Artificial Sequence: Synthetic oligonucleotide
  Target: ATXN1; (-) strand; PAM type: NRG; PAM sequence: CAG
actgattaatagcagtgatt

SEQ ID NO: 84946 - DNA, 20 bp, Artificial Sequence
  Description of Artificial Sequence: Synthetic oligonucleotide
  Target: ATXN1; (-) strand; PAM type: NRG; PAM sequence: CAG
aattctttactgattaatag

SEQ ID NO: 84947 - DNA, 20 bp, Artificial Sequence
  Description of Artificial Sequence: Synthetic oligonucleotide
  Target: ATXN1; (-) strand; PAM type: NRG; PAM sequence: TAG
atcaattctttactgattaa

SEQ ID NO: 84948 - DNA, 20 bp, Artificial Sequence
  Description of Artificial Sequence: Synthetic oligonucleotide
  Target: ATXN1; (-) strand; PAM type: NRG; PAM sequence: GGG
agtttgctattcaccaaata

SEQ ID NO: 84949 - DNA, 20 bp, Artificial Sequence
  Description of Artificial Sequence: Synthetic oligonucleotide
  Target: ATXN1; (-) strand; PAM type: NRG; PAM sequence: AGG
cagtttgctattcaccaaat

SEQ ID NO: 84950 - DNA, 20 bp, Artificial Sequence
  Description of Artificial Sequence: Synthetic oligonucleotide
  Target: ATXN1; (-) strand; PAM type: NRG; PAM sequence: TAG
gcagtttgctattcaccaaa

SEQ ID NO: 84951 - DNA, 20 bp, Artificial Sequence
  Description of Artificial Sequence: Synthetic oligonucleotide
  Target: ATXN1; (-) strand; PAM type: NRG; PAM sequence: CAG
agttcagagagcaataggag

SEQ ID NO: 84952 - DNA, 20 bp, Artificial Sequence
  Description of Artificial Sequence: Synthetic oligonucleotide
  Target: ATXN1; (-) strand; PAM type: NRG; PAM sequence: GAG
ttcagttcagagagcaatag

SEQ ID NO: 84953 - DNA, 20 bp, Artificial Sequence
  Description of Artificial Sequence: Synthetic oligonucleotide
  Target: ATXN1; (-) strand; PAM type: NRG; PAM sequence: AGG
agttcagttcagagagcaat

SEQ ID NO: 84954 - DNA, 20 bp, Artificial Sequence
  Description of Artificial Sequence: Synthetic oligonucleotide
  Target: ATXN1; (-) strand; PAM type: NRG; PAM sequence: TAG
cagttcagttcagagagcaa

SEQ ID NO: 84955 - DNA, 20 bp, Artificial Sequence
  Description of Artificial Sequence: Synthetic oligonucleotide
  Target: ATXN1; (-) strand; PAM type: NRG; PAM sequence: GAG
attgttcagttcagttcaga

SEQ ID NO: 84956 - DNA, 20 bp, Artificial Sequence
  Description of Artificial Sequence: Synthetic oligonucleotide
  Target: ATXN1; (-) strand; PAM type: NRG; PAM sequence: GAG
agattgttcagttcagttca

SEQ ID NO: 84957 - DNA, 20 bp, Artificial Sequence
  Description of Artificial Sequence: Synthetic oligonucleotide
  Target: ATXN1; (-) strand; PAM type: NRG; PAM sequence: CAG
aaagattgttcagttcagtt

SEQ ID NO: 84958 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaagattgttcagtt

SEQ ID NO: 84959 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaagattgtt

SEQ ID NO: 84960 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaaaa

SEQ ID NO: 84961 - DNA, 20 bp, Artificial Sequence
  Description of Artificial Sequence: Synthetic oligonucleotide
  Target: ATXN1; (-) strand; PAM type: NRG; PAM sequence: AAG
cacatttgtcccagaactta

SEQ ID NO: 84962 - DNA, 20 bp, Artificial Sequence
  Description of Artificial Sequence: Synthetic oligonucleotide
  Target: ATXN1; (-) strand; PAM type: NRG; PAM sequence: CAG
cacgttctgcacatttgtcc

SEQ ID NO: 84963 - DNA, 20 bp, Artificial Sequence
  Description of Artificial Sequence: Synthetic oligonucleotide
  Target: ATXN1; (-) strand; PAM type: NRG; PAM sequence: GGG
aacctagatgacgggttgaa

SEQ ID NO: 84964 - DNA, 20 bp, Artificial Sequence
  Description of Artificial Sequence: Synthetic oligonucleotide
  Target: ATXN1; (-) strand; PAM type: NRG; PAM sequence: AGG
aaacctagatgacgggttga

SEQ ID NO: 84965 - DNA, 20 bp, Artificial Sequence
  Description of Artificial Sequence: Synthetic oligonucleotide
  Target: ATXN1; (-) strand; PAM type: NRG; PAM sequence: AAG
aaaacctagatgacgggttg

SEQ ID NO: 84966 - DNA, 20 bp, Artificial Sequence
  Description of Artificial Sequence: Synthetic oligonucleotide
  Target: ATXN1; (-) strand; PAM type: NRG; PAM sequence: GGG
gggcttaaaacctagatgac

SEQ ID NO: 84967 - DNA, 20 bp, Artificial Sequence
  Description of Artificial Sequence: Synthetic oligonucleotide
  Target: ATXN1; (-) strand; PAM type: NRG; PAM sequence: CGG
ggggcttaaaacctagatga

SEQ ID NO: 84968 - DNA, 20 bp, Artificial Sequence
  Description of Artificial Sequence: Synthetic oligonucleotide
  Target: ATXN1; (-) strand; PAM type: NRG; PAM sequence: TAG
tgcatttggggcttaaaacc

SEQ ID NO: 84969 - DNA, 20 bp, Artificial Sequence
  Description of Artificial Sequence: Synthetic oligonucleotide
  Target: ATXN1; (-) strand; PAM type: NRG; PAM sequence: GGG
acaaatacctaatgcatttg

SEQ ID NO: 84970 - DNA, 20 bp, Artificial Sequence
  Description of Artificial Sequence: Synthetic oligonucleotide
  Target: ATXN1; (-) strand; PAM type: NRG; PAM sequence: GGG
gacaaatacctaatgcattt

SEQ ID NO: 84971 - DNA, 20 bp, Artificial Sequence
  Description of Artificial Sequence: Synthetic oligonucleotide
  Target: ATXN1; (-) strand; PAM type: NRG; PAM sequence: TGG
ggacaaatacctaatgcatt

SEQ ID NO: 84972 - DNA, 20 bp, Artificial Sequence
  Description of Artificial Sequence: Synthetic oligonucleotide
  Target: ATXN1; (-) strand; PAM type: NRG; PAM sequence: TGG
gctgactgctgagttccatt

SEQ ID NO: 84973 - DNA, 20 bp, Artificial Sequence
  Description of Artificial Sequence: Synthetic oligonucleotide
  Target: ATXN1; (-) strand; PAM type: NRG; PAM sequence: GAG
aatatattttgctgactgct

SEQ ID NO: 84974 - DNA, 20 bp, Artificial Sequence
  Description of Artificial Sequence: Synthetic oligonucleotide
  Target: ATXN1; (-) strand; PAM type: NRG; PAM sequence: TAG
gtaggcaacaagagttattc

SEQ ID NO: 84975 - DNA, 20 bp, Artificial Sequence
  Description of Artificial Sequence: Synthetic oligonucleotide
  Target: ATXN1; (-) strand; PAM type: NRG; PAM sequence: GAG
aatgtggaggtaggcaacaa

SEQ ID NO: 84976 - DNA, 20 bp, Artificial Sequence
  Description of Artificial Sequence: Synthetic oligonucleotide
  Target: ATXN1; (-) strand; PAM type: NRG; PAM sequence: AAG
tgaatgtggaggtaggcaac

SEQ ID NO: 84977 - DNA, 20 bp, Artificial Sequence
  Description of Artificial Sequence: Synthetic oligonucleotide
  Target: ATXN1; (-) strand; PAM type: NRG; PAM sequence: AGG
accaatgtgaatgtggaggt

SEQ ID NO: 84978 - DNA, 20 bp, Artificial Sequence
  Description of Artificial Sequence: Synthetic oligonucleotide
  Target: ATXN1; (-) strand; PAM type: NRG; PAM sequence: TAG
caccaatgtgaatgtggagg

SEQ ID NO: 84979 - DNA, 20 bp, Artificial Sequence
  Description of Artificial Sequence: Synthetic oligonucleotide
  Target: ATXN1; (-) strand; PAM type: NRG; PAM sequence: AGG
catcaccaatgtgaatgtgg

SEQ ID NO: 84980 - DNA, 20 bp, Artificial Sequence
  Description of Artificial Sequence: Synthetic oligonucleotide
  Target: ATXN1; (-) strand; PAM type: NRG; PAM sequence: GAG
acatcaccaatgtgaatgtg

SEQ ID NO: 84981 - DNA, 20 bp, Artificial Sequence
  Description of Artificial Sequence: Synthetic oligonucleotide
  Target: ATXN1; (-) strand; PAM type: NRG; PAM sequence: TGG
agacatcaccaatgtgaatg

SEQ ID NO: 84982 - DNA, 20 bp, Artificial Sequence
  Description of Artificial Sequence: Synthetic oligonucleotide
  Target: ATXN1; (-) strand; PAM type: NRG; PAM sequence: TAG
tcaggagtgaggacagggag

SEQ ID NO: 84983 - DNA, 20 bp, Artificial Sequence
  Description of Artificial Sequence: Synthetic oligonucleotide
  Target: ATXN1; (-) strand; PAM type: NRG; PAM sequence: GAG
tgctcaggagtgaggacagg

SEQ ID NO: 84984 - DNA, 20 bp, Artificial Sequence
  Description of Artificial Sequence: Synthetic oligonucleotide
  Target: ATXN1; (-) strand; PAM type: NRG; PAM sequence: GGG
ggtgctcaggagtgaggaca

SEQ ID NO: 84985 - DNA, 20 bp, Artificial Sequence
  Description of Artificial Sequence: Synthetic oligonucleotide
  Target: ATXN1; (-) strand; PAM type: NRG; PAM sequence: AGG
aggtgctcaggagtgaggac

SEQ ID NO: 84986 - DNA, 20 bp, Artificial Sequence
  Description of Artificial Sequence: Synthetic oligonucleotide
  Target: ATXN1; (-) strand; PAM type: NRG; PAM sequence: CAG
caggtgctcaggagtgagga

SEQ ID NO: 84987 - DNA, 20 bp, Artificial Sequence
  Description of Artificial Sequence: Synthetic oligonucleotide
  Target: ATXN1; (-) strand; PAM type: NRG; PAM sequence: AGG
gtgacaggtgctcaggagtg

SEQ ID NO: 84988 - DNA, 20 bp, Artificial Sequence
  Description of Artificial Sequence: Synthetic oligonucleotide
  Target: ATXN1; (-) strand; PAM type: NRG; PAM sequence: GAG
ggtgacaggtgctcaggagt

SEQ ID NO: 84989 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgacaggtgctcag

SEQ ID NO: 84990 - DNA, 20 bp, Artificial Sequence
  Description of Artificial Sequence: Synthetic oligonucleotide
  Target: ATXN1; (-) strand; PAM type: NRG; PAM sequence: AGG
gtctgaggtgacaggtgctc

SEQ ID NO: 84991 - DNA, 20 bp, Artificial Sequence
  Description of Artificial Sequence: Synthetic oligonucleotide
  Target: ATXN1; (-) strand; PAM type: NRG; PAM sequence: CAG
ggtctgaggtgacaggtgct

SEQ ID NO: 84992 - DNA, 20 bp, Artificial Sequence
  Description of Artificial Sequence: Synthetic oligonucleotide
  Target: ATXN1; (-) strand; PAM type: NRG; PAM sequence: AGG
gtggtgtggtctgaggtgac

SEQ ID NO: 84993 - DNA, 20 bp, Artificial Sequence
  Description of Artificial Sequence: Synthetic oligonucleotide
  Target: ATXN1; (-) strand; PAM type: NRG; PAM sequence: CAG
agtggtgtggtctgaggtga

SEQ ID NO: 84994 - DNA, 20 bp, Artificial Sequence
  Description of Artificial Sequence: Synthetic oligonucleotide
  Target: ATXN1; (-) strand; PAM type: NRG; PAM sequence: AGG
agcttcagtggtgtggtctg

SEQ ID NO: 84995 - DNA, 20 bp, Artificial Sequence
  Description of Artificial Sequence: Synthetic oligonucleotide
  Target: ATXN1; (-) strand; PAM type: NRG; PAM sequence: GAG
cagcttcagtggtgtggtct

SEQ ID NO: 84996 - DNA, 20 bp, Artificial Sequence
  Description of Artificial Sequence: Synthetic oligonucleotide
  Target: ATXN1; (-) strand; PAM type: NRG; PAM sequence: TGG
ggtggtcagcttcagtggtg

SEQ ID NO: 84997 - DNA, 20 bp, Artificial Sequence
  Description of Artificial Sequence: Synthetic oligonucleotide
  Target: ATXN1; (-) strand; PAM type: NRG; PAM sequence: TGG
catggggtggtcagcttcag

SEQ ID NO: 84998 - DNA, 20 bp, Artificial Sequence
  Description of Artificial Sequence: Synthetic oligonucleotide
  Target: ATXN1; (-) strand; PAM type: NRG; PAM sequence: CAG
ggtcatggggtggtcagctt

SEQ ID NO: 84999 - DNA, 20 bp, Artificial Sequence
  Description of Artificial Sequence: Synthetic oligonucleotide
  Target: ATXN1; (-) strand; PAM type: NRG; PAM sequence: CAG
gttgggggtcatggggtggt

SEQ ID NO: 85000 - DNA, 20 bp, Artificial Sequence
  Description of Artificial Sequence: Synthetic oligonucleotide
  Target: ATXN1; (-) strand; PAM type: NRG; PAM sequence: TGG
cttggttgggggtcatgggg

SEQ ID NO: 85001 - DNA, 20 bp, Artificial Sequence
  Description of Artificial Sequence: Synthetic oligonucleotide
  Target: ATXN1; (-) strand; PAM type: NRG; PAM sequence: GGG
tttcttggttgggggtcatg

SEQ ID NO: 85002 - DNA, 20 bp, Artificial Sequence
  Description of Artificial Sequence: Synthetic oligonucleotide
  Target: ATXN1; (-) strand; PAM type: NRG; PAM sequence: GGG
ctttcttggttgggggtcat

SEQ ID NO: 85003 - DNA, 20 bp, Artificial Sequence
  Description of Artificial Sequence: Synthetic oligonucleotide
  Target: ATXN1; (-) strand; PAM type: NRG; PAM sequence: TGG
cctttcttggttgggggtca

SEQ ID NO: 85004 - DNA, 20 bp, Artificial Sequence
  Description of Artificial Sequence: Synthetic oligonucleotide
  Target: ATXN1; (-) strand; PAM type: NRG; PAM sequence: GGG
gcttaccctttcttggttgg

SEQ ID NO: 85005 - DNA, 20 bp, Artificial Sequence
  Description of Artificial Sequence: Synthetic oligonucleotide
  Target: ATXN1; (-) strand; PAM type: NRG; PAM sequence: GGG
ggcttaccctttcttggttg

SEQ ID NO: 85006 - DNA, 20 bp, Artificial Sequence
  Description of Artificial Sequence: Synthetic oligonucleotide
  Target: ATXN1; (-) strand; PAM type: NRG; PAM sequence: GGG
tggcttaccctttcttggtt

SEQ ID NO: 85007 - DNA, 20 bp, Artificial Sequence
  Description of Artificial Sequence: Synthetic oligonucleotide
  Target: ATXN1; (-) strand; PAM type: NRG; PAM sequence: TGG
ttggcttaccctttcttggt

SEQ ID NO: 85008 - DNA, 20 bp, Artificial Sequence
  Description of Artificial Sequence: Synthetic oligonucleotide
  Target: ATXN1; (-) strand; PAM type: NRG; PAM sequence: TGG
tgtgttggcttaccctttct

SEQ ID NO: 85009 - DNA, 20 bp, Artificial Sequence
  Description of Artificial Sequence: Synthetic oligonucleotide
  Target: ATXN1; (-) strand; PAM type: NRG; PAM sequence: TGG
ccaccctggcttctctgtgt

SEQ ID NO: 85010 - DNA, 20 bp, Artificial Sequence
  Description of Artificial Sequence: Synthetic oligonucleotide
  Target: ATXN1; (-) strand; PAM type: NRG; PAM sequence: TGG
gtctctctgagcgcccaccc

SEQ ID NO: 85011 - DNA, 20 bp, Artificial Sequence
  Description of Artificial Sequence: Synthetic oligonucleotide
  Target: ATXN1; (-) strand; PAM type: NRG; PAM sequence: GAG
ccagacccaggagtctctct

SEQ ID NO: 85012 - DNA, 20 bp, Artificial Sequence
  Description of Artificial Sequence: Synthetic oligonucleotide
  Target: ATXN1; (-) strand; PAM type: NRG; PAM sequence: GAG
acagaagtgaccagacccag

SEQ ID NO: 85013 - DNA, 20 bp, Artificial Sequence
  Description of Artificial Sequence: Synthetic oligonucleotide
  Target: ATXN1; (-) strand; PAM type: NRG; PAM sequence: AGG
ccacagaagtgaccagaccc

SEQ ID NO: 85014 - DNA, 20 bp, Artificial Sequence
  Description of Artificial Sequence: Synthetic oligonucleotide
  Target: ATXN1; (-) strand; PAM type: NRG; PAM sequence: CAG
cccacagaagtgaccagacc

SEQ ID NO: 85015 - DNA, 20 bp, Artificial Sequence
  Description of Artificial Sequence: Synthetic oligonucleotide
  Target: ATXN1; (-) strand; PAM type: NRG; PAM sequence: CAG
agtggacccacagaagtgac

SEQ ID NO: 85016 - DNA, 20 bp, Artificial Sequence
  Description of Artificial Sequence: Synthetic oligonucleotide
  Target: ATXN1; (-) strand; PAM type: NRG; PAM sequence: AAG
caggcttagtggacccacag

SEQ ID NO: 85017 - DNA, 20 bp, Artificial Sequence
  Description of Artificial Sequence: Synthetic oligonucleotide
  Target: ATXN1; (-) strand; PAM type: NRG; PAM sequence: CAG
gaacaggcttagtggaccca

SEQ ID NO: 85018 - DNA, 20 bp, Artificial Sequence
  Description of Artificial Sequence: Synthetic oligonucleotide
  Target: ATXN1; (-) strand; PAM type: NRG; PAM sequence: TGG
ggtaccaggaacaggcttag

SEQ ID NO: 85019 - DNA, 20 bp, Artificial Sequence
  Description of Artificial Sequence: Synthetic oligonucleotide
  Target: ATXN1; (-) strand; PAM type: NRG; PAM sequence: TAG
tggggtaccaggaacaggct

SEQ ID NO: 85020 - DNA, 20 bp, Artificial Sequence
  Description of Artificial Sequence: Synthetic oligonucleotide
  Target: ATXN1; (-) strand; PAM type: NRG; PAM sequence: AGG
gatattggggtaccaggaac

SEQ ID NO: 85021 - DNA, 20 bp, Artificial Sequence
  Description of Artificial Sequence: Synthetic oligonucleotide
  Target: ATXN1; (-) strand; PAM type: NRG; PAM sequence: CAG
tgatattggggtaccaggaa

SEQ ID NO: 85022 - DNA, 20 bp, Artificial Sequence
  Description of Artificial Sequence: Synthetic oligonucleotide
  Target: ATXN1; (-) strand; PAM type: NRG; PAM sequence: AGG
cttagtgatattggggtacc

SEQ ID NO: 85023 - DNA, 20 bp, Artificial Sequence
  Description of Artificial Sequence: Synthetic oligonucleotide
  Target: ATXN1; (-) strand; PAM type: NRG; PAM sequence: CAG
acttagtgatattggggtac

SEQ ID NO: 85024 - DNA, 20 bp, Artificial Sequence
  Description of Artificial Sequence: Synthetic oligonucleotide
  Target: ATXN1; (-) strand; PAM type: NRG; PAM sequence: GGG
tgggccacttagtgatattg

SEQ ID NO: 85025 - DNA, 20 bp, Artificial Sequence
  Description of Artificial Sequence: Synthetic oligonucleotide
  Target: ATXN1; (-) strand; PAM type: NRG; PAM sequence: GGG
ttgggccacttagtgatatt

SEQ ID NO: 85026 - DNA, 20 bp, Artificial Sequence
  Description of Artificial Sequence: Synthetic oligonucleotide
  Target: ATXN1; (-) strand; PAM type: NRG; PAM sequence: TGG
gttgggccacttagtgatat

SEQ ID NO: 85027 - DNA, 20 bp, Artificial Sequence
  Description of Artificial Sequence: Synthetic oligonucleotide
  Target: ATXN1; (-) strand; PAM type: NRG; PAM sequence: TAG
tatttctaagttgggccact

SEQ ID NO: 85028 - DNA, 20 bp, Artificial Sequence
  Description of Artificial Sequence: Synthetic oligonucleotide
  Target: ATXN1; (-) strand; PAM type: NRG; PAM sequence: GGG
gattctagtatttctaagtt

SEQ ID NO: 85029 - DNA, 20 bp, Artificial Sequence
  Description of Artificial Sequence: Synthetic oligonucleotide
  Target: ATXN1; (-) strand; PAM type: NRG; PAM sequence: TGG
tgattctagtatttctaagt

SEQ ID NO: 85030 - DNA, 20 bp, Artificial Sequence
  Description of Artificial Sequence: Synthetic oligonucleotide
  Target: ATXN1; (-) strand; PAM type: NRG; PAM sequence: AAG
gagttgattctagtatttct

SEQ ID NO: 85031 - DNA, 20 bp, Artificial Sequence
  Description of Artificial Sequence: Synthetic oligonucleotide
  Target: ATXN1; (-) strand; PAM type: NRG; PAM sequence: TAG
gaaggcagaggagttgattc

SEQ ID NO: 85032 - DNA, 20 bp, Artificial Sequence
  Description of Artificial Sequence: Synthetic oligonucleotide
  Target: ATXN1; (-) strand; PAM type: NRG; PAM sequence: GAG
gaataagggggaaggcagag

SEQ ID NO: 85033 - DNA, 20 bp, Artificial Sequence
  Description of Artificial Sequence: Synthetic oligonucleotide
  Target: ATXN1; (-) strand; PAM type: NRG; PAM sequence: AGG
tggaataagggggaaggcag

SEQ ID NO: 85034 - DNA, 20 bp, Artificial Sequence
  Description of Artificial Sequence: Synthetic oligonucleotide
  Target: ATXN1; (-) strand; PAM type: NRG; PAM sequence: GAG
gtggaataagggggaaggca

SEQ ID NO: 85035 - DNA, 20 bp, Artificial Sequence
  Description of Artificial Sequence: Synthetic oligonucleotide
  Target: ATXN1; (-) strand; PAM type: NRG; PAM sequence: CAG
ctgtggaataagggggaagg

SEQ ID NO: 85036 - DNA, 20 bp, Artificial Sequence
  Description of Artificial Sequence: Synthetic oligonucleotide
  Target: ATXN1; (-) strand; PAM type: NRG; PAM sequence: AGG
gacctgtggaataaggggga

SEQ ID NO: 85037 - DNA, 20 bp, Artificial Sequence
  Description of Artificial Sequence: Synthetic oligonucleotide
  Target: ATXN1; (-) strand; PAM type: NRG; PAM sequence: AAG
tgacctgtggaataaggggg

SEQ ID NO: 85038 - DNA, 20 bp, Artificial Sequence
  Description of Artificial Sequence: Synthetic oligonucleotide
  Target: ATXN1; (-) strand; PAM type: NRG; PAM sequence: GGG
tgctgacctgtggaataagg

SEQ ID NO: 85039 - DNA, 20 bp, Artificial Sequence
  Description of Artificial Sequence: Synthetic oligonucleotide
  Target: ATXN1; (-) strand; PAM type: NRG; PAM sequence: GGG
ctgctgacctgtggaataag

SEQ ID NO: 85040 - DNA, 20 bp, Artificial Sequence
  Description of Artificial Sequence: Synthetic oligonucleotide
  Target: ATXN1; (-) strand; PAM type: NRG; PAM sequence: GGG
cctgctgacctgtggaataa

SEQ ID NO: 85041 - DNA, 20 bp, Artificial Sequence
  Description of Artificial Sequence: Synthetic oligonucleotide
  Target: ATXN1; (-) strand; PAM type: NRG; PAM sequence: AGG
ccctgctgacctgtggaata

SEQ ID NO: 85042 - DNA, 20 bp, Artificial Sequence
  Description of Artificial Sequence: Synthetic oligonucleotide
  Target: ATXN1; (-) strand; PAM type: NRG; PAM sequence: AAG
tccctgctgacctgtggaat

SEQ ID NO: 85043 - DNA, 20 bp, Artificial Sequence
  Description of Artificial Sequence: Synthetic oligonucleotide
  Target: ATXN1; (-) strand; PAM type: NRG; PAM sequence: TGG
atttggtccctgctgacctg

SEQ ID NO: 85044 - DNA, 20 bp, Artificial Sequence
  Description of Artificial Sequence: Synthetic oligonucleotide
  Target: ATXN1; (-) strand; PAM type: NRG; PAM sequence: TGG
gaaatagaattgataggatt

SEQ ID NO: 85045 - DNA, 20 bp, Artificial Sequence
  Description of Artificial Sequence: Synthetic oligonucleotide
  Target: ATXN1; (-) strand; PAM type: NRG; PAM sequence: AGG
aaccaggaaatagaattgat

SEQ ID NO: 85046 - DNA, 20 bp, Artificial Sequence
  Description of Artificial Sequence: Synthetic oligonucleotide
  Target: ATXN1; (-) strand; PAM type: NRG; PAM sequence: TAG
taaccaggaaatagaattga

SEQ ID NO: 85047 - DNA, 20 bp, Artificial Sequence
  Description of Artificial Sequence: Synthetic oligonucleotide
  Target: ATXN1; (-) strand; PAM type: NRG; PAM sequence: TAG
caagtagcataaccaggaaa

SEQ ID NO: 85048 - DNA, 20 bp, Artificial Sequence
  Description of Artificial Sequence: Synthetic oligonucleotide
  Target: ATXN1; (-) strand; PAM type: NRG; PAM sequence: AGG
aggattcaagtagcataacc

SEQ ID NO: 85049 - DNA, 20 bp, Artificial Sequence
  Description of Artificial Sequence: Synthetic oligonucleotide
  Target: ATXN1; (-) strand; PAM type: NRG; PAM sequence: CAG
aaggattcaagtagcataac

SEQ ID NO: 85050 - DNA, 20 bp, Artificial Sequence
  Description of Artificial Sequence: Synthetic oligonucleotide
  Target: ATXN1; (-) strand; PAM type: NRG; PAM sequence: TAG
cagaaagggaaggattcaag

SEQ ID NO: 85051 - DNA, 20 bp, Artificial Sequence
  Description of Artificial Sequence: Synthetic oligonucleotide
  Target: ATXN1; (-) strand; PAM type: NRG; PAM sequence: AAG
aggcagaaagggaaggattc

SEQ ID NO: 85052 - DNA, 20 bp, Artificial Sequence
  Description of Artificial Sequence: Synthetic oligonucleotide
  Target: ATXN1; (-) strand; PAM type: NRG; PAM sequence: AGG
gctggagaggcagaaaggga

SEQ ID NO: 85053 - DNA, 20 bp, Artificial Sequence
  Description of Artificial Sequence: Synthetic oligonucleotide
  Target: ATXN1; (-) strand; PAM type: NRG; PAM sequence: AAG
tgctggagaggcagaaaggg

SEQ ID NO: 85054 - DNA, 20 bp, Artificial Sequence
  Description of Artificial Sequence: Synthetic oligonucleotide
  Target: ATXN1; (-) strand; PAM type: NRG; PAM sequence: GGG
acttgctggagaggcagaaa

SEQ ID NO: 85055 - DNA, 20 bp, Artificial Sequence
  Description of Artificial Sequence: Synthetic oligonucleotide
  Target: ATXN1; (-) strand; PAM type: NRG; PAM sequence: AGG
gacttgctggagaggcagaa

SEQ ID NO: 85056 - DNA, 20 bp, Artificial Sequence
  Description of Artificial Sequence: Synthetic oligonucleotide
  Target: ATXN1; (-) strand; PAM type: NRG; PAM sequence: AAG
agacttgctggagaggcaga

SEQ ID NO: 85057 - DNA, 20 bp, Artificial Sequence
  Description of Artificial Sequence: Synthetic oligonucleotide
  Target: ATXN1; (-) strand; PAM type: NRG; PAM sequence: CAG
agccagacttgctggagagg

SEQ ID NO: 85058 - DNA, 20 bp, Artificial Sequence
  Description of Artificial Sequence: Synthetic oligonucleotide
  Target: ATXN1; (-) strand; PAM type: NRG; PAM sequence: AGG
cagagccagacttgctggag

SEQ ID NO: 85059 - DNA, 20 bp, Artificial Sequence
  Description of Artificial Sequence: Synthetic oligonucleotide
  Target: ATXN1; (-) strand; PAM type: NRG; PAM sequence: GAG
gcagagccagacttgctgga

SEQ ID NO: 85060 - DNA, 20 bp, Artificial Sequence
  Description of Artificial Sequence: Synthetic oligonucleotide
  Target: ATXN1; (-) strand; PAM type: NRG; PAM sequence: GAG
cggcagagccagacttgctg

SEQ ID NO: 85061 - DNA, 20 bp, Artificial Sequence
  Description of Artificial Sequence: Synthetic oligonucleotide
  Target: ATXN1; (-) strand; PAM type: NRG; PAM sequence: TGG
gacggcagagccagacttgc

SEQ ID NO: 85062 - DNA, 20 bp, Artificial Sequence
  Description of Artificial Sequence: Synthetic oligonucleotide
  Target: ATXN1; (-) strand; PAM type: NRG; PAM sequence: CAG
ggggtgagtgacggcagagc

SEQ ID NO: 85063 - DNA, 20 bp, Artificial Sequence
  Description of Artificial Sequence: Synthetic oligonucleotide
  Target: ATXN1; (-) strand; PAM type: NRG; PAM sequence: GAG
acgaggggtgagtgacggca

SEQ ID NO: 85064 - DNA, 20 bp, Artificial Sequence
  Description of Artificial Sequence: Synthetic oligonucleotide
  Target: ATXN1; (-) strand; PAM type: NRG; PAM sequence: CAG
gcacgaggggtgagtgacgg

SEQ ID NO: 85065 - DNA, 20 bp, Artificial Sequence
  Description of Artificial Sequence: Synthetic oligonucleotide
  Target: ATXN1; (-) strand; PAM type: NRG; PAM sequence: CGG
agggcacgaggggtgagtga

SEQ ID NO: 85066 - DNA, 20 bp, Artificial Sequence
  Description of Artificial Sequence: Synthetic oligonucleotide
  Target: ATXN1; (-) strand; PAM type: NRG; PAM sequence: GAG
ggtgagagggcacgaggggt

SEQ ID NO: 85067 - DNA, 20 bp, Artificial Sequence
  Description of Artificial Sequence: Synthetic oligonucleotide
  Target: ATXN1; (-) strand; PAM type: NRG; PAM sequence: GGG
tctgggtgagagggcacgag

SEQ ID NO: 85068 - DNA, 20 bp, Artificial Sequence
  Description of Artificial Sequence: Synthetic oligonucleotide
  Target: ATXN1; (-) strand; PAM type: NRG; PAM sequence: GGG
atctgggtgagagggcacga

SEQ ID NO: 85069 - DNA, 20 bp, Artificial Sequence
  Description of Artificial Sequence: Synthetic oligonucleotide
  Target: ATXN1; (-) strand; PAM type: NRG; PAM sequence: AGG
catctgggtgagagggcacg

SEQ ID NO: 85070 - DNA, 20 bp, Artificial Sequence
  Description of Artificial Sequence: Synthetic oligonucleotide
  Target: ATXN1; (-) strand; PAM type: NRG; PAM sequence: GAG
acatctgggtgagagggcac

SEQ ID NO: 85071 - DNA, 20 bp, Artificial Sequence
  Description of Artificial Sequence: Synthetic oligonucleotide
  Target: ATXN1; (-) strand; PAM type: NRG; PAM sequence: GGG
aggcagacatctgggtgaga

SEQ ID NO: 85072 - DNA, 20 bp, Artificial Sequence
  Description of Artificial Sequence: Synthetic oligonucleotide
  Target: ATXN1; (-) strand; PAM type: NRG; PAM sequence: AGG
caggcagacatctgggtgag

SEQ ID NO: 85073 - DNA, 20 bp, Artificial Sequence
  Description of Artificial Sequence: Synthetic oligonucleotide
  Target: ATXN1; (-) strand; PAM type: NRG; PAM sequence: GAG
gcaggcagacatctgggtga

SEQ ID NO: 85074 - DNA, 20 bp, Artificial Sequence
  Description of Artificial Sequence: Synthetic oligonucleotide
  Target: ATXN1; (-) strand; PAM type: NRG; PAM sequence: GAG
gagcaggcagacatctgggt

SEQ ID NO: 85075 - DNA, 20 bp, Artificial Sequence
  Description of Artificial Sequence: Synthetic oligonucleotide
  Target: ATXN1; (-) strand; PAM type: NRG; PAM sequence: GGG
atgagagcaggcagacatct

SEQ ID NO: 85076 - DNA, 20 bp, Artificial Sequence
  Description of Artificial Sequence: Synthetic oligonucleotide
  Target: ATXN1; (-) strand; PAM type: NRG; PAM sequence: TGG
catgagagcaggcagacatc

SEQ ID NO: 85077 - DNA, 20 bp, Artificial Sequence
  Description of Artificial Sequence: Synthetic oligonucleotide
  Target: ATXN1; (-) strand; PAM type: NRG; PAM sequence: CAG
tggagaaccatgagagcagg

SEQ ID NO: 85078 - DNA, 20 bp, Artificial Sequence
  Description of Artificial Sequence: Synthetic oligonucleotide
  Target: ATXN1; (-) strand; PAM type: NRG; PAM sequence: AGG
gattggagaaccatgagagc

SEQ ID NO: 85079 - DNA, 20 bp, Artificial Sequence
  Description of Artificial Sequence: Synthetic oligonucleotide
  Target: ATXN1; (-) strand; PAM type: NRG; PAM sequence: CAG
tgattggagaaccatgagag

SEQ ID NO: 85080 - DNA, 20 bp, Artificial Sequence
  Description of Artificial Sequence: Synthetic oligonucleotide
  Target: ATXN1; (-) strand; PAM type: NRG; PAM sequence: GAG
aggtgattggagaaccatga

SEQ ID NO: 85081 - DNA, 20 bp, Artificial Sequence
  Description of Artificial Sequence: Synthetic oligonucleotide
  Target: ATXN1; (-) strand; PAM type: NRG; PAM sequence: GAG
agaggtgattggagaaccat

SEQ ID NO: 85082 - DNA, 20 bp, Artificial Sequence
  Description of Artificial Sequence: Synthetic oligonucleotide
  Target: ATXN1; (-) strand; PAM type: NRG; PAM sequence: GAG
gcattctggagaggtgattg

SEQ ID NO: 85083 - DNA, 20 bp, Artificial Sequence
  Description of Artificial Sequence: Synthetic oligonucleotide
  Target: ATXN1; (-) strand; PAM type: NRG; PAM sequence: TGG
tggcattctggagaggtgat

SEQ ID NO: 85084 - DNA, 20 bp, Artificial Sequence
  Description of Artificial Sequence: Synthetic oligonucleotide
  Target: ATXN1; (-) strand; PAM type: NRG; PAM sequence: AGG
gcttttgtggcattctggag

SEQ ID NO: 85085 - DNA, 20 bp, Artificial Sequence
  Description of Artificial Sequence: Synthetic oligonucleotide
  Target: ATXN1; (-) strand; PAM type: NRG; PAM sequence: GAG
agcttttgtggcattctgga

SEQ ID NO: 85086 - DNA, 20 bp, Artificial Sequence
  Description of Artificial Sequence: Synthetic oligonucleotide
  Target: ATXN1; (-) strand; PAM type: NRG; PAM sequence: GAG
ccagcttttgtggcattctg

SEQ ID NO: 85087 - DNA, 20 bp, Artificial Sequence
  Description of Artificial Sequence: Synthetic oligonucleotide
  Target: ATXN1; (-) strand; PAM type: NRG; PAM sequence: TGG
agccagcttttgtggcattc

SEQ ID NO: 85088 - DNA, 20 bp, Artificial Sequence
  Description of Artificial Sequence: Synthetic oligonucleotide
  Target: ATXN1; (-) strand; PAM type: NRG; PAM sequence: TGG
ttttctagagccagcttttg

SEQ ID NO: 85089 - DNA, 20 bp, Artificial Sequence
  Description of Artificial Sequence: Synthetic oligonucleotide
  Target: ATXN1; (-) strand; PAM type: NRG; PAM sequence: CAG
agatctgtattttctagagc

SEQ ID NO: 85090 - DNA, 20 bp, Artificial Sequence
  Description of Artificial Sequence: Synthetic oligonucleotide
  Target: ATXN1; (-) strand; PAM type: NRG; PAM sequence: GAG
gatcagatctgtattttcta

SEQ ID NO: 85091 - DNA, 20 bp, Artificial Sequence
  Description of Artificial Sequence: Synthetic oligonucleotide
  Target: ATXN1; (-) strand; PAM type: NRG; PAM sequence: TAG
aggatcagatctgtattttc

SEQ ID NO: 85092 - DNA, 20 bp, Artificial Sequence
  Description of Artificial Sequence: Synthetic oligonucleotide
  Target: ATXN1; (-) strand; PAM type: NRG; PAM sequence: CAG
agtttggagagtacaaggat

SEQ ID NO: 85093 - DNA, 20 bp, Artificial Sequence
  Description of Artificial Sequence: Synthetic oligonucleotide
  Target: ATXN1; (-) strand; PAM type: NRG; PAM sequence: AGG
ttttcagtttggagagtaca

SEQ ID NO: 85094 - DNA, 20 bp, Artificial Sequence
  Description of Artificial Sequence: Synthetic oligonucleotide
  Target: ATXN1; (-) strand; PAM type: NRG; PAM sequence: AAG
gttttcagtttggagagtac

SEQ ID NO: 85095 - DNA, 20 bp, Artificial Sequence
  Description of Artificial Sequence: Synthetic oligonucleotide
  Target: ATXN1; (-) strand; PAM type: NRG; PAM sequence: GAG
accatggttttcagtttgga

SEQ ID NO: 85096 - DNA, 20 bp, Artificial Sequence
  Description of Artificial Sequence: Synthetic oligonucleotide
  Target: ATXN1; (-) strand; PAM type: NRG; PAM sequence: GAG
tcaccatggttttcagtttg

SEQ ID NO: 85097 - DNA, 20 bp, Artificial Sequence
  Description of Artificial Sequence: Synthetic oligonucleotide
  Target: ATXN1; (-) strand; PAM type: NRG; PAM sequence: TGG
agtcaccatggttttcagtt

SEQ ID NO: 85098 - DNA, 20 bp, Artificial Sequence
  Description of Artificial Sequence: Synthetic oligonucleotide
  Target: ATXN1; (-) strand; PAM type: NRG; PAM sequence: CAG
actgcagtcaccatggtttt

SEQ ID NO: 85099 - DNA, 20 bp, Artificial Sequence
  Description of Artificial Sequence: Synthetic oligonucleotide
  Target: ATXN1; (-) strand; PAM type: NRG; PAM sequence: TGG
agagtatactgcagtcacca

SEQ ID NO: 85100 - DNA, 20 bp, Artificial Sequence
  Description of Artificial Sequence: Synthetic oligonucleotide
  Target: ATXN1; (-) strand; PAM type: NRG; PAM sequence: CAG
atagtttggagagtatactg

SEQ ID NO: 85101 - DNA, 20 bp, Artificial Sequence
  Description of Artificial Sequence: Synthetic oligonucleotide
  Target: ATXN1; (-) strand; PAM type: NRG; PAM sequence: GAG
ctctttagtgatagtttgga

SEQ ID NO: 85102 - DNA, 20 bp, Artificial Sequence
  Description of Artificial Sequence: Synthetic oligonucleotide
  Target: ATXN1; (-) strand; PAM type: NRG; PAM sequence: GAG
tcctctttagtgatagtttg

SEQ ID NO: 85103 - DNA, 20 bp, Artificial Sequence
  Description of Artificial Sequence: Synthetic oligonucleotide
  Target: ATXN1; (-) strand; PAM type: NRG; PAM sequence: TGG
cttcctctttagtgatagtt

SEQ ID NO: 85104 - DNA, 20 bp, Artificial Sequence
  Description of Artificial Sequence: Synthetic oligonucleotide
  Target: ATXN1; (-) strand; PAM type: NRG; PAM sequence: TAG
tcccccttcctctttagtga

SEQ ID NO: 85105 - DNA, 20 bp, Artificial Sequence
  Description of Artificial Sequence: Synthetic oligonucleotide
  Target: ATXN1; (-) strand; PAM type: NRG; PAM sequence: TAG
ttcacatcccccttcctctt

SEQ ID NO: 85106 - DNA, 20 bp, Artificial Sequence
  Description of Artificial Sequence: Synthetic oligonucleotide
  Target: ATXN1; (-) strand; PAM type: NRG; PAM sequence: GAG
gcacagaggaagatcgcaga

SEQ ID NO: 85107 - DNA, 20 bp, Artificial Sequence
  Description of Artificial Sequence: Synthetic oligonucleotide
  Target: ATXN1; (-) strand; PAM type: NRG; PAM sequence: GAG
tagcacagaggaagatcgca

SEQ ID NO: 85108 - DNA, 20 bp, Artificial Sequence
  Description of Artificial Sequence: Synthetic oligonucleotide
  Target: ATXN1; (-) strand; PAM type: NRG; PAM sequence: CAG
gatagcacagaggaagatcg

SEQ ID NO: 85109 - DNA, 20 bp, Artificial Sequence
  Description of Artificial Sequence: Synthetic oligonucleotide
  Target: ATXN1; (-) strand; PAM type: NRG; PAM sequence: AAG
gcttgttgatagcacagagg

SEQ ID NO: 85110 - DNA, 20 bp, Artificial Sequence
  Description of Artificial Sequence: Synthetic oligonucleotide
  Target: ATXN1; (-) strand; PAM type: NRG; PAM sequence: AGG
cttgcttgttgatagcacag

SEQ ID NO: 85111 - DNA, 20 bp, Artificial Sequence
  Description of Artificial Sequence: Synthetic oligonucleotide
  Target: ATXN1; (-) strand; PAM type: NRG; PAM sequence: GAG
tcttgcttgttgatagcaca

SEQ ID NO: 85112 - DNA, 20 bp, Artificial Sequence
  Description of Artificial Sequence: Synthetic oligonucleotide
  Target: ATXN1; (-) strand; PAM type: NRG; PAM sequence: CAG
tttcttgcttgttgatagca

SEQ ID NO: 85113 - DNA, 20 bp, Artificial Sequence
  Description of Artificial Sequence: Synthetic oligonucleotide
  Target: ATXN1; (-) strand; PAM type: NRG; PAM sequence: TAG
tcttttttcttgcttgttga

SEQ ID NO: 85114 - DNA, 20 bp, Artificial Sequence
  Description of Artificial Sequence: Synthetic oligonucleotide
  Target: ATXN1; (-) strand; PAM type: NRG; PAM sequence: CAG
tcctccacatctgttttctc

SEQ ID NO: 85115 - DNA, 20 bp, Artificial Sequence
  Description of Artificial Sequence: Synthetic oligonucleotide
  Target: ATXN1; (-) strand; PAM type: NRG; PAM sequence: TGG
ctgaataaaatcttggttct

SEQ ID NO: 85116 - DNA, 20 bp, Artificial Sequence
  Description of Artificial Sequence: Synthetic oligonucleotide
  Target: ATXN1; (-) strand; PAM type: NRG; PAM sequence: TGG
aggaaatctgaataaaatct

SEQ ID NO: 85117 - DNA, 20 bp, Artificial Sequence
  Description of Artificial Sequence: Synthetic oligonucleotide
  Target: ATXN1; (-) strand; PAM type: NRG; PAM sequence: AGG
atgagccaagtaaaaacgga

SEQ ID NO: 85118 - DNA, 20 bp, Artificial Sequence
  Description of Artificial Sequence: Synthetic oligonucleotide
  Target: ATXN1; (-) strand; PAM type: NRG; PAM sequence: AAG
gatgagccaagtaaaaacgg

SEQ ID NO: 85119 - DNA, 20 bp, Artificial Sequence
  Description of Artificial Sequence: Synthetic oligonucleotide
  Target: ATXN1; (-) strand; PAM type: NRG; PAM sequence: CGG
atagatgagccaagtaaaaa

SEQ ID NO: 85120 - DNA, 20 bp, Artificial Sequence
  Description of Artificial Sequence: Synthetic oligonucleotide
  Target: ATXN1; (-) strand; PAM type: NRG; PAM sequence: AAG
acccaaaatatagatgagcc

SEQ ID NO: 85121 - DNA, 20 bp, Artificial Sequence
  Description of Artificial Sequence: Synthetic oligonucleotide
  Target: ATXN1; (-) strand; PAM type: NRG; PAM sequence: GAG
aactgacccaaaatatagat

SEQ ID NO: 85122 - DNA, 20 bp, Artificial Sequence
  Description of Artificial Sequence: Synthetic oligonucleotide
  Target: ATXN1; (-) strand; PAM type: NRG; PAM sequence: TAG
taaaaaactgacccaaaata

SEQ ID NO: 85123 - DNA, 20 bp, Artificial Sequence
  Description of Artificial Sequence: Synthetic oligonucleotide
  Target: ATXN1; (-) strand; PAM type: NRG; PAM sequence: GAG
taatgattaaaagtcaaatt

SEQ ID NO: 85124 - DNA, 20 bp, Artificial Sequence
  Description of Artificial Sequence: Synthetic oligonucleotide
  Target: ATXN1; (-) strand; PAM type: NRG; PAM sequence: AAG
ggatcatttttaatgattaa

SEQ ID NO: 85125 - DNA, 20 bp, Artificial Sequence
  Description of Artificial Sequence: Synthetic oligonucleotide
  Target: ATXN1; (-) strand; PAM type: NRG; PAM sequence: AGG
gcctcacaggacatgcttct

SEQ ID NO: 85126 - DNA, 20 bp, Artificial Sequence
  Description of Artificial Sequence: Synthetic oligonucleotide
  Target: ATXN1; (-) strand; PAM type: NRG; PAM sequence: TAG
tgcctcacaggacatgcttc

SEQ ID NO: 85127 - DNA, 20 bp, Artificial Sequence
  Description of Artificial Sequence: Synthetic oligonucleotide
  Target: ATXN1; (-) strand; PAM type: NRG; PAM sequence: AGG
gcgacttggcagtgcctcac

SEQ ID NO: 85128 - DNA, 20 bp, Artificial Sequence
  Description of Artificial Sequence: Synthetic oligonucleotide
  Target: ATXN1; (-) strand; PAM type: NRG; PAM sequence: CAG
tgcgacttggcagtgcctca

SEQ ID NO: 85129 - DNA, 20 bp, Artificial Sequence
  Description of Artificial Sequence: Synthetic oligonucleotide
  Target: ATXN1; (-) strand; PAM type: NRG; PAM sequence: CAG
aatgcatcaatgcgacttgg

SEQ ID NO: 85130 - DNA, 20 bp, Artificial Sequence
  Description of Artificial Sequence: Synthetic oligonucleotide
  Target: ATXN1; (-) strand; PAM type: NRG; PAM sequence: TGG
tgaaatgcatcaatgcgact

SEQ ID NO: 85131 - DNA, 20 bp, Artificial Sequence
  Description of Artificial Sequence: Synthetic oligonucleotide
  Target: ATXN1; (-) strand; PAM type: NRG; PAM sequence: CAG
tgaatatgtggcctttcaag

SEQ ID NO: 85132 - DNA, 20 bp, Artificial Sequence
  Description of Artificial Sequence: Synthetic oligonucleotide
  Target: ATXN1; (-) strand; PAM type: NRG; PAM sequence: AAG
ttttgaatatgtggcctttc

SEQ ID NO: 85133 - DNA, 20 bp, Artificial Sequence
  Description of Artificial Sequence: Synthetic oligonucleotide
  Target: ATXN1; (-) strand; PAM type: NRG; PAM sequence: TGG
ctagtagtgttttgaatatg

SEQ ID NO: 85134 - DNA, 20 bp, Artificial Sequence
  Description of Artificial Sequence: Synthetic oligonucleotide
  Target: ATXN1; (-) strand; PAM type: NRG; PAM sequence: TAG
ttctttagcctgacttctag

SEQ ID NO: 85135 - DNA, 20 bp, Artificial Sequence
  Description of Artificial Sequence: Synthetic oligonucleotide
  Target: ATXN1; (-) strand; PAM type: NRG; PAM sequence: TAG
attttctttagcctgacttc

SEQ ID NO: 85136 - DNA, 20 bp, Artificial Sequence
  Description of Artificial Sequence: Synthetic oligonucleotide
  Target: ATXN1; (-) strand; PAM type: NRG; PAM sequence: TAG
caaaatcattttattttctt

SEQ ID NO: 85137 - DNA, 20 bp, Artificial Sequence
  Description of Artificial Sequence: Synthetic oligonucleotide
  Target: ATXN1; (-) strand; PAM type: NRG; PAM sequence: TAG
aataacatttgtttctgttt

SEQ ID NO: 85138 - DNA, 20 bp, Artificial Sequence
  Description of Artificial Sequence: Synthetic oligonucleotide
  Target: ATXN1; (-) strand; PAM type: NRG; PAM sequence: GAG
tgtcagtttacagtgagcca

SEQ ID NO: 85139 - DNA, 20 bp, Artificial Sequence
  Description of Artificial Sequence: Synthetic oligonucleotide
  Target: ATXN1; (-) strand; PAM type: NRG; PAM sequence: CAG
cttgtcagtttacagtgagc

SEQ ID NO: 85140 - DNA, 20 bp, Artificial Sequence
  Description of Artificial Sequence: Synthetic oligonucleotide
  Target: ATXN1; (-) strand; PAM type: NRG; PAM sequence: GAG
atatcttgtcagtttacagt

SEQ ID NO: 85141 - DNA, 20 bp, Artificial Sequence
  Description of Artificial Sequence: Synthetic oligonucleotide
  Target: ATXN1; (-) strand; PAM type: NRG; PAM sequence: CAG
attcatatcttgtcagttta

SEQ ID NO: 85142 - DNA, 20 bp, Artificial Sequence
  Description of Artificial Sequence: Synthetic oligonucleotide
  Target: ATXN1; (-) strand; PAM type: NRG; PAM sequence: CAG
aattcatattcatatcttgt

SEQ ID NO: 85143 - DNA, 20 bp, Artificial Sequence
  Description of Artificial Sequence: Synthetic oligonucleotide
  Target: ATXN1; (-) strand; PAM type: NRG; PAM sequence: TGG
agcagttattatacattact

SEQ ID NO: 85144 - DNA, 20 bp, Artificial Sequence
  Description of Artificial Sequence: Synthetic oligonucleotide
  Target: ATXN1; (-) strand; PAM type: NRG; PAM sequence: CAG
gtggttgtggtgagcagaag

SEQ ID NO: 85145 - DNA, 20 bp, Artificial Sequence
  Description of Artificial Sequence: Synthetic oligonucleotide
  Target: ATXN1; (-) strand; PAM type: NRG; PAM sequence: AAG
catgtggttgtggtgagcag

SEQ ID NO: 85146 - DNA, 20 bp, Artificial Sequence
  Description of Artificial Sequence: Synthetic oligonucleotide
  Target: ATXN1; (-) strand; PAM type: NRG; PAM sequence: CAG
tggcatgtggttgtggtgag

SEQ ID NO: 85147 - DNA, 20 bp, Artificial Sequence
  Description of Artificial Sequence: Synthetic oligonucleotide
  Target: ATXN1; (-) strand; PAM type: NRG; PAM sequence: GAG
tgttggcatgtggttgtggt

SEQ ID NO: 85148 - DNA, 20 bp, Artificial Sequence
  Description of Artificial Sequence: Synthetic oligonucleotide
  Target: ATXN1; (-) strand; PAM type: NRG; PAM sequence: TGG
gagttgttggcatgtggttg

SEQ ID NO: 85149 - DNA, 20 bp, Artificial Sequence
  Description of Artificial Sequence: Synthetic oligonucleotide
  Target: ATXN1; (-) strand; PAM type: NRG; PAM sequence: TGG
aaaattgagttgttggcatg

SEQ ID NO: 85150 - DNA, 20 bp, Artificial Sequence
  Description of Artificial Sequence: Synthetic oligonucleotide
  Target: ATXN1; (-) strand; PAM type: NRG; PAM sequence: TGG
gaaatataaaattgagttgt

SEQ ID NO: 85151 - DNA, 20 bp, Artificial Sequence
  Description of Artificial Sequence: Synthetic oligonucleotide
  Target: ATXN1; (-) strand; PAM type: NRG; PAM sequence: GAG
tcgaaatgaaatataaaatt

SEQ ID NO: 85152 - DNA, 20 bp, Artificial Sequence
  Description of Artificial Sequence: Synthetic oligonucleotide
  Target: ATXN1; (-) strand; PAM type: NRG; PAM sequence: TAG
aatgaggatggtttgtaatc

SEQ ID NO: 85153 - DNA, 20 bp, Artificial Sequence
  Description of Artificial Sequence: Synthetic oligonucleotide
  Target: ATXN1; (-) strand; PAM type: NRG; PAM sequence: TGG
taaatggactgtaatgagga

SEQ ID NO: 85154 - DNA, 20 bp, Artificial Sequence
  Description of Artificial Sequence: Synthetic oligonucleotide
  Target: ATXN1; (-) strand; PAM type: NRG; PAM sequence: AGG
agagtaaatggactgtaatg

SEQ ID NO: 85155 - DNA, 20 bp, Artificial Sequence
  Description of Artificial Sequence: Synthetic oligonucleotide
  Target: ATXN1; (-) strand; PAM type: NRG; PAM sequence: GAG
tagagtaaatggactgtaat

SEQ ID NO: 85156 - DNA, 20 bp, Artificial Sequence
  Description of Artificial Sequence: Synthetic oligonucleotide
  Target: ATXN1; (-) strand; PAM type: NRG; PAM sequence: TGG
caaaaattagctagagtaaa

SEQ ID NO: 85157 - DNA, 20 bp, Artificial Sequence
  Description of Artificial Sequence: Synthetic oligonucleotide
  Target: ATXN1; (-) strand; PAM type: NRG; PAM sequence: GAG
atgctatcaaaaattagcta

SEQ ID NO: 85158 - DNA, 20 bp, Artificial Sequence
  Description of Artificial Sequence: Synthetic oligonucleotide
  Target: ATXN1; (-) strand; PAM type: NRG; PAM sequence: TAG
tcatgctatcaaaaattagc

SEQ ID NO: 85159 - DNA, 20 bp, Artificial Sequence
  Description of Artificial Sequence: Synthetic oligonucleotide
  Target: ATXN1; (-) strand; PAM type: NRG; PAM sequence: TAG
gatgtcatgctatcaaaaat

SEQ ID NO: 85160 - DNA, 20 bp, Artificial Sequence
  Description of Artificial Sequence: Synthetic oligonucleotide
  Target: ATXN1; (-) strand; PAM type: NRG; PAM sequence: AAG
tttcagaatagttattcact

SEQ ID NO: 85161 - DNA, 20 bp, Artificial Sequence
  Description of Artificial Sequence: Synthetic oligonucleotide
  Target: ATXN1; (-) strand; PAM type: NRG; PAM sequence: TAG
tataaaagcaaatttcagaa

SEQ ID NO: 85162 - DNA, 20 bp, Artificial Sequence
  Description of Artificial Sequence: Synthetic oligonucleotide
  Target: ATXN1; (-) strand; PAM type: NRG; PAM sequence: CAG
acttttataaaagcaaattt

SEQ ID NO: 85163 - DNA, 20 bp, Artificial Sequence
  Description of Artificial Sequence: Synthetic oligonucleotide
  Target: ATXN1; (-) strand; PAM type: NRG; PAM sequence: AAG
ctttgcaaggacttttataa

SEQ ID NO: 85164 - DNA, 20 bp, Artificial Sequence
  Description of Artificial Sequence: Synthetic oligonucleotide
  Target: ATXN1; (-) strand; PAM type: NRG; PAM sequence: AGG
tagaaatgtaaaactttgca

SEQ ID NO: 85165 - DNA, 20 bp, Artificial Sequence
  Description of Artificial Sequence: Synthetic oligonucleotide
  Target: ATXN1; (-) strand; PAM type: NRG; PAM sequence: AAG
ttagaaatgtaaaactttgc

SEQ ID NO: 85166 - DNA, 20 bp, Artificial Sequence
  Description of Artificial Sequence: Synthetic oligonucleotide
  Target: ATXN1; (-) strand; PAM type: NRG; PAM sequence: TAG
gctattggttttcacttgtt

SEQ ID NO: 85167 - DNA, 20 bp, Artificial Sequence
  Description of Artificial Sequence: Synthetic oligonucleotide
  Target: ATXN1; (-) strand; PAM type: NRG; PAM sequence: TGG
tcttacaatttttcagctat

SEQ ID NO: 85168 - DNA, 20 bp, Artificial Sequence
  Description of Artificial Sequence: Synthetic oligonucleotide
  Target: ATXN1; (-) strand; PAM type: NRG; PAM sequence: CAG
ggcatcatcttacaattttt

SEQ ID NO: 85169 - DNA, 20 bp, Artificial Sequence
  Description of Artificial Sequence: Synthetic oligonucleotide
  Target: ATXN1; (-) strand; PAM type: NRG; PAM sequence: TGG
gagcaacatttggacaatta

SEQ ID NO: 85170 - DNA, 20 bp, Artificial Sequence
  Description of Artificial Sequence: Synthetic oligonucleotide
  Target: ATXN1; (-) strand; PAM type: NRG; PAM sequence: TGG
ttggtgaactgagcaacatt

SEQ ID NO: 85171 - DNA, 20 bp, Artificial Sequence
  Description of Artificial Sequence: Synthetic oligonucleotide
  Target: ATXN1; (-) strand; PAM type: NRG; PAM sequence: GAG
agtaagcctgttggtgaact

SEQ ID NO: 85172 - DNA, 20 bp, Artificial Sequence
  Description of Artificial Sequence: Synthetic oligonucleotide
  Target: ATXN1; (-) strand; PAM type: NRG; PAM sequence: TGG
aacctactcagtaagcctgt

SEQ ID NO: 85173 - DNA, 20 bp, Artificial Sequence
  Description of Artificial Sequence: Synthetic oligonucleotide
  Target: ATXN1; (-) strand; PAM type: NRG; PAM sequence: AAG
ttctaaagaacctactcagt

SEQ ID NO: 85174 - DNA, 20 bp, Artificial Sequence
  Description of Artificial Sequence: Synthetic oligonucleotide
  Target: ATXN1; (-) strand; PAM type: NRG; PAM sequence: CAG
ttctttctaaagaacctact

SEQ ID NO: 85175 - DNA, 20 bp, Artificial Sequence
  Description of Artificial Sequence: Synthetic oligonucleotide
  Target: ATXN1; (-) strand; PAM type: NRG; PAM sequence: AAG
cctggcagaatttctttcta

SEQ ID NO: 85176 - DNA, 20 bp, Artificial Sequence
  Description of Artificial Sequence: Synthetic oligonucleotide
  Target: ATXN1; (-) strand; PAM type: NRG; PAM sequence: CAG
tcttattacaaactacctgg

SEQ ID NO: 85177 - DNA, 20 bp, Artificial Sequence
  Description of Artificial Sequence: Synthetic oligonucleotide
  Target: ATXN1; (-) strand; PAM type: NRG; PAM sequence: TGG
acttcttattacaaactacc

SEQ ID NO: 85178 - DNA, 20 bp, Artificial Sequence
  Description of Artificial Sequence: Synthetic oligonucleotide
  Target: ATXN1; (-) strand; PAM type: NRG; PAM sequence: CAG
tgtaaaggcatgatccatag

SEQ ID NO: 85179 - DNA, 20 bp, Artificial Sequence
  Description of Artificial Sequence: Synthetic oligonucleotide
  Target: ATXN1; (-) strand; PAM type: NRG; PAM sequence: TAG
ctttgtaaaggcatgatcca

SEQ ID NO: 85180 - DNA, 20 bp, Artificial Sequence
  Description of Artificial Sequence: Synthetic oligonucleotide
  Target: ATXN1; (-) strand; PAM type: NRG; PAM sequence: AGG
ctggaatgtaaactttgtaa

SEQ ID NO: 85181 - DNA, 20 bp, Artificial Sequence
  Description of Artificial Sequence: Synthetic oligonucleotide
  Target: ATXN1; (-) strand; PAM type: NRG; PAM sequence: AAG
gctggaatgtaaactttgta

SEQ ID NO: 85182 - DNA, 20 bp, Artificial Sequence
  Description of Artificial Sequence: Synthetic oligonucleotide
  Target: ATXN1; (-) strand; PAM type: NRG; PAM sequence: TGG
gtacatgctttcctccctgc

SEQ ID NO: 85183 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaagaaagaaaagaa

SEQ ID NO: 85184 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaagaaagaa

SEQ ID NO: 85185 - DNA, 20 bp, Artificial Sequence
  Description of Artificial Sequence: Synthetic oligonucleotide
  Target: ATXN1; (-) strand; PAM type: NRG; PAM sequence: AAG
tgcaaaaaaaaaaaaaaaga

SEQ ID NO: 85186 - DNA, 20 bp, Artificial Sequence
  Description of Artificial Sequence: Synthetic oligonucleotide
  Target: ATXN1; (-) strand; PAM type: NRG; PAM sequence: AAG
ttactgcaaaaaaaaaaaaa

SEQ ID NO: 85187 - DNA, 20 bp, Artificial Sequence
  Description of Artificial Sequence: Synthetic oligonucleotide
  Target: ATXN1; (-) strand; PAM type: NRG; PAM sequence: TAG
gttcctcttttgagactttg

SEQ ID NO: 85188 - DNA, 20 bp, Artificial Sequence
  Description of Artificial Sequence: Synthetic oligonucleotide
  Target: ATXN1; (-) strand; PAM type: NRG; PAM sequence: GAG
cataaaatggttcctctttt

SEQ ID NO: 85189 - DNA, 20 bp, Artificial Sequence
  Description of Artificial Sequence: Synthetic oligonucleotide
  Target: ATXN1; (-) strand; PAM type: NRG; PAM sequence: TGG
ataccctctcctgcataaaa

SEQ ID NO: 85190 - DNA, 20 bp, Artificial Sequence
  Description of Artificial Sequence: Synthetic oligonucleotide
  Target: ATXN1; (-) strand; PAM type: NRG; PAM sequence: CAG
cctgaggcccactttcttac

SEQ ID NO: 85191 - DNA, 20 bp, Artificial Sequence
  Description of Artificial Sequence: Synthetic oligonucleotide
  Target: ATXN1; (-) strand; PAM type: NRG; PAM sequence: AGG
tcccatctgcctagctcctg

SEQ ID NO: 85192 - DNA, 20 bp, Artificial Sequence
  Description of Artificial Sequence: Synthetic oligonucleotide
  Target: ATXN1; (-) strand; PAM type: NRG; PAM sequence: GAG
ttcccatctgcctagctcct

SEQ ID NO: 85193 - DNA, 20 bp, Artificial Sequence
  Description of Artificial Sequence: Synthetic oligonucleotide
  Target: ATXN1; (-) strand; PAM type: NRG; PAM sequence: TAG
gttcaaaattcccatctgcc

SEQ ID NO: 85194 - DNA, 20 bp, Artificial Sequence
  Description of Artificial Sequence: Synthetic oligonucleotide
  Target: ATXN1; (-) strand; PAM type: NRG; PAM sequence: GAG
acttcagaaatagacactta

SEQ ID NO: 85195 - DNA, 20 bp, Artificial Sequence
  Description of Artificial Sequence: Synthetic oligonucleotide
  Target: ATXN1; (-) strand; PAM type: NRG; PAM sequence: TAG
tcacttcagaaatagacact

SEQ ID NO: 85196 - DNA, 20 bp, Artificial Sequence
  Description of Artificial Sequence: Synthetic oligonucleotide
  Target: ATXN1; (-) strand; PAM type: NRG; PAM sequence: TAG
gattagtttcacttcagaaa

SEQ ID NO: 85197 - DNA, 20 bp, Artificial Sequence
  Description of Artificial Sequence: Synthetic oligonucleotide
  Target: ATXN1; (-) strand; PAM type: NRG; PAM sequence: CAG
cacattgattagtttcactt

SEQ ID NO: 85198 - DNA, 20 bp, Artificial Sequence
  Description of Artificial Sequence: Synthetic oligonucleotide
  Target: ATXN1; (-) strand; PAM type: NRG; PAM sequence: TAG
aactgtagaaacacattgat

SEQ ID NO: 85199 - DNA, 20 bp, Artificial Sequence
  Description of Artificial Sequence: Synthetic oligonucleotide
  Target: ATXN1; (-) strand; PAM type: NRG; PAM sequence: TAG
tgctcaataaatgttaactg

SEQ ID NO: 85200 - DNA, 20 bp, Artificial Sequence
  Description of Artificial Sequence: Synthetic oligonucleotide
  Target: ATXN1; (-) strand; PAM type: NRG; PAM sequence: TAG
atgaactttgtgacacatag

SEQ ID NO: 85201 - DNA, 20 bp, Artificial Sequence
  Description of Artificial Sequence: Synthetic oligonucleotide
  Target: ATXN1; (-) strand; PAM type: NRG; PAM sequence: TAG
tttatgaactttgtgacaca

SEQ ID NO: 85202 - DNA, 20 bp, Artificial Sequence
  Description of Artificial Sequence: Synthetic oligonucleotide
  Target: ATXN1; (-) strand; PAM type: NRG; PAM sequence: GAG
catgtttgtttggaagctta

SEQ ID NO: 85203 - DNA, 20 bp, Artificial Sequence
  Description of Artificial Sequence: Synthetic oligonucleotide
  Target: ATXN1; (-) strand; PAM type: NRG; PAM sequence: TAG
tccatgtttgtttggaagct

SEQ ID NO: 85204 - DNA, 20 bp, Artificial Sequence
  Description of Artificial Sequence: Synthetic oligonucleotide
  Target: ATXN1; (-) strand; PAM type: NRG; PAM sequence: AAG
gtcattccatgtttgtttgg

SEQ ID NO: 85205 - DNA, 20 bp, Artificial Sequence
  Description of Artificial Sequence: Synthetic oligonucleotide
  Target: ATXN1; (-) strand; PAM type: NRG; PAM sequence: TGG
gctgtcattccatgtttgtt

SEQ ID NO: 85206 - DNA, 20 bp, Artificial Sequence
  Description of Artificial Sequence: Synthetic oligonucleotide
  Target: ATXN1; (-) strand; PAM type: NRG; PAM sequence: AGG
ctttttaatcatttgtaacc

SEQ ID NO: 85207 - DNA, 20 bp, Artificial Sequence
  Description of Artificial Sequence: Synthetic oligonucleotide
  Target: ATXN1; (-) strand; PAM type: NRG; PAM sequence: CAG
cctttttaatcatttgtaac

SEQ ID NO: 85208 - DNA, 20 bp, Artificial Sequence
  Description of Artificial Sequence: Synthetic oligonucleotide
  Target: ATXN1; (-) strand; PAM type: NRG; PAM sequence: GAG
ggaatgttaatagactctgt

SEQ ID NO: 85209 - DNA, 20 bp, Artificial Sequence
  Description of Artificial Sequence: Synthetic oligonucleotide
  Target: ATXN1; (-) strand; PAM type: NRG; PAM sequence: TAG
atgactcttgggaatgttaa

SEQ ID NO: 85210 - DNA, 20 bp, Artificial Sequence
  Description of Artificial Sequence: Synthetic oligonucleotide
  Target: ATXN1; (-) strand; PAM type: NRG; PAM sequence: GGG
agtaagaactaatgactctt

SEQ ID NO: 85211 - DNA, 20 bp, Artificial Sequence
  Description of Artificial Sequence: Synthetic oligonucleotide
  Target: ATXN1; (-) strand; PAM type: NRG; PAM sequence: TGG
cagtaagaactaatgactct

SEQ ID NO: 85212 - DNA, 20 bp, Artificial Sequence
  Description of Artificial Sequence: Synthetic oligonucleotide
  Target: ATXN1; (-) strand; PAM type: NRG; PAM sequence: AAG
ttggcttactaatgttcagt

SEQ ID NO: 85213 - DNA, 20 bp, Artificial Sequence
  Description of Artificial Sequence: Synthetic oligonucleotide
  Target: ATXN1; (-) strand; PAM type: NRG; PAM sequence: CAG
gcctttggcttactaatgtt

SEQ ID NO: 85214 - DNA, 20 bp, Artificial Sequence
  Description of Artificial Sequence: Synthetic oligonucleotide
  Target: ATXN1; (-) strand; PAM type: NRG; PAM sequence: TGG
tgttgatataaatatgcctt

SEQ ID NO: 85215 - DNA, 20 bp, Artificial Sequence
  Description of Artificial Sequence: Synthetic oligonucleotide
  Target: ATXN1; (-) strand; PAM type: NRG; PAM sequence: AAG
gacccttgattgttcgaatt

SEQ ID NO: 85216 - DNA, 20 bp, Artificial Sequence
  Description of Artificial Sequence: Synthetic oligonucleotide
  Target: ATXN1; (-) strand; PAM type: NRG; PAM sequence: GGG
gtcatttcagttacatgtca

SEQ ID NO: 85217 - DNA, 20 bp, Artificial Sequence
  Description of Artificial Sequence: Synthetic oligonucleotide
  Target: ATXN1; (-) strand; PAM type: NRG; PAM sequence: AGG
tgtcatttcagttacatgtc

SEQ ID NO: 85218 - DNA, 20 bp, Artificial Sequence
  Description of Artificial Sequence: Synthetic oligonucleotide
  Target: ATXN1; (-) strand; PAM type: NRG; PAM sequence: CAG
ttgtcatttcagttacatgt

SEQ ID NO: 85219 - DNA, 20 bp, Artificial Sequence
  Description of Artificial Sequence: Synthetic oligonucleotide
  Target: ATXN1; (-) strand; PAM type: NRG; PAM sequence: CAG
tcttgatattcttgtcattt

SEQ ID NO: 85220 - DNA, 20 bp, Artificial Sequence
  Description of Artificial Sequence: Synthetic oligonucleotide
  Target: ATXN1; (-) strand; PAM type: NRG; PAM sequence: AAG
gttagaataaacatgtactt

SEQ ID NO: 85221 - DNA, 20 bp, Artificial Sequence
  Description of Artificial Sequence: Synthetic oligonucleotide
  Target: ATXN1; (-) strand; PAM type: NRG; PAM sequence: TAG
ataatactgatgttagaggt

SEQ ID NO: 85222 - DNA, 20 bp, Artificial Sequence
  Description of Artificial Sequence: Synthetic oligonucleotide
  Target: ATXN1; (-) strand; PAM type: NRG; PAM sequence: AGG
ttgcataatactgatgttag

SEQ ID NO: 85223 - DNA, 20 bp, Artificial Sequence
  Description of Artificial Sequence: Synthetic oligonucleotide
  Target: ATXN1; (-) strand; PAM type: NRG; PAM sequence: GAG
attgcataatactgatgtta

SEQ ID NO: 85224 - DNA, 20 bp, Artificial Sequence
  Description of Artificial Sequence: Synthetic oligonucleotide
  Target: ATXN1; (-) strand; PAM type: NRG; PAM sequence: TAG
tcattgcataatactgatgt

SEQ ID NO: 85225 - DNA, 20 bp, Artificial Sequence
  Description of Artificial Sequence: Synthetic oligonucleotide
  Target: ATXN1; (-) strand; PAM type: NRG; PAM sequence: TAG
aaaggtacattttaatcatt

SEQ ID NO: 85226 - DNA, 20 bp, Artificial Sequence
  Description of Artificial Sequence: Synthetic oligonucleotide
  Target: ATXN1; (-) strand; PAM type: NRG; PAM sequence: AGG
aaatacctattttaaaacaa

SEQ ID NO: 85227 - DNA, 20 bp, Artificial Sequence
  Description of Artificial Sequence: Synthetic oligonucleotide
  Target: ATXN1; (-) strand; PAM type: NRG; PAM sequence: AAG
caaatacctattttaaaaca

SEQ ID NO: 85228 - DNA, 20 bp, Artificial Sequence
  Description of Artificial Sequence: Synthetic oligonucleotide
  Target: ATXN1; (-) strand; PAM type: NRG; PAM sequence: TAG
cacttggagaaacactgctg

SEQ ID NO: 85229 - DNA, 20 bp, Artificial Sequence
  Description of Artificial Sequence: Synthetic oligonucleotide
  Target: ATXN1; (-) strand; PAM type: NRG; PAM sequence: GAG
aggtccttggctcacacttg

SEQ ID NO: 85230 - DNA, 20 bp, Artificial Sequence
  Description of Artificial Sequence: Synthetic oligonucleotide
  Target: ATXN1; (-) strand; PAM type: NRG; PAM sequence: TGG
aaaggtccttggctcacact

SEQ ID NO: 85231 - DNA, 20 bp, Artificial Sequence
  Description of Artificial Sequence: Synthetic oligonucleotide
  Target: ATXN1; (-) strand; PAM type: NRG; PAM sequence: TGG
catttaacataaaaggtcct

SEQ ID NO: 85232 - DNA, 20 bp, Artificial Sequence
  Description of Artificial Sequence: Synthetic oligonucleotide
  Target: ATXN1; (-) strand; PAM type: NRG; PAM sequence: AGG
tgtgattcatttaacataaa

SEQ ID NO: 85233 - DNA, 20 bp, Artificial Sequence
  Description of Artificial Sequence: Synthetic oligonucleotide
  Target: ATXN1; (-) strand; PAM type: NRG; PAM sequence: AAG
ctgtgattcatttaacataa

SEQ ID NO: 85234 - DNA, 20 bp, Artificial Sequence
  Description of Artificial Sequence: Synthetic oligonucleotide
  Target: ATXN1; (-) strand; PAM type: NRG; PAM sequence: GAG
ccaggagttgtacttttaac

SEQ ID NO: 85235 - DNA, 20 bp, Artificial Sequence
  Description of Artificial Sequence: Synthetic oligonucleotide
  Target: ATXN1; (-) strand; PAM type: NRG; PAM sequence: GAG
aggtcaggggtggggcccag

SEQ ID NO: 85236 - DNA, 20 bp, Artificial Sequence
  Description of Artificial Sequence: Synthetic oligonucleotide
  Target: ATXN1; (-) strand; PAM type: NRG; PAM sequence: AGG
ataggtcaggggtggggccc

SEQ ID NO: 85237 - DNA, 20 bp, Artificial Sequence
  Description of Artificial Sequence: Synthetic oligonucleotide
  Target: ATXN1; (-) strand; PAM type: NRG; PAM sequence: CAG
aataggtcaggggtggggcc

SEQ ID NO: 85238 - DNA, 20 bp, Artificial Sequence
  Description of Artificial Sequence: Synthetic oligonucleotide
  Target: ATXN1; (-) strand; PAM type: NRG; PAM sequence: GGG
tgttaaataggtcaggggtg

SEQ ID NO: 85239 - DNA, 20 bp, Artificial Sequence
  Description of Artificial Sequence: Synthetic oligonucleotide
  Target: ATXN1; (-) strand; PAM type: NRG; PAM sequence: GGG
atgttaaataggtcaggggt

SEQ ID NO: 85240 - DNA, 20 bp, Artificial Sequence
  Description of Artificial Sequence: Synthetic oligonucleotide
  Target: ATXN1; (-) strand; PAM type: NRG; PAM sequence: TGG
tatgttaaataggtcagggg

SEQ ID NO: 85241 - DNA, 20 bp, Artificial Sequence
  Description of Artificial Sequence: Synthetic oligonucleotide
  Target: ATXN1; (-) strand; PAM type: NRG; PAM sequence: GGG
aagtatgttaaataggtcag

SEQ ID NO: 85242 - DNA, 20 bp, Artificial Sequence
  Description of Artificial Sequence: Synthetic oligonucleotide
  Target: ATXN1; (-) strand; PAM type: NRG; PAM sequence: GGG
aaagtatgttaaataggtca

SEQ ID NO: 85243 - DNA, 20 bp, Artificial Sequence
  Description of Artificial Sequence: Synthetic oligonucleotide
  Target: ATXN1; (-) strand; PAM type: NRG; PAM sequence: AGG
taaagtatgttaaataggtc

SEQ ID NO: 85244 - DNA, 20 bp, Artificial Sequence
  Description of Artificial Sequence: Synthetic oligonucleotide
  Target: ATXN1; (-) strand; PAM type: NRG; PAM sequence: CAG
ttaaagtatgttaaataggt

SEQ ID NO: 85245 - DNA, 20 bp, Artificial Sequence
  Description of Artificial Sequence: Synthetic oligonucleotide
  Target: ATXN1; (-) strand; PAM type: NRG; PAM sequence: AGG
ggccttaaagtatgttaaat

SEQ ID NO: 85246 - DNA, 20 bp, Artificial Sequence
  Description of Artificial Sequence: Synthetic oligonucleotide
  Target: ATXN1; (-) strand; PAM type: NRG; PAM sequence: TAG
gggccttaaagtatgttaaa

SEQ ID NO: 85247 - DNA, 20 bp, Artificial Sequence
  Description of Artificial Sequence: Synthetic oligonucleotide
  Target: ATXN1; (-) strand; PAM type: NRG; PAM sequence: AAG
attcagattcctgggcctta

SEQ ID NO: 85248 - DNA, 20 bp, Artificial Sequence
  Description of Artificial Sequence: Synthetic oligonucleotide
  Target: ATXN1; (-) strand; PAM type: NRG; PAM sequence: GGG
tgttgaaaattcagattcct

SEQ ID NO: 85249 - DNA, 20 bp, Artificial Sequence
  Description of Artificial Sequence: Synthetic oligonucleotide
  Target: ATXN1; (-) strand; PAM type: NRG; PAM sequence: TGG
ctgttgaaaattcagattcc

SEQ ID NO: 85250 - DNA, 20 bp, Artificial Sequence
  Description of Artificial Sequence: Synthetic oligonucleotide
  Target: ATXN1; (-) strand; PAM type: NRG; PAM sequence: CAG
acttagtcctgttgaaaatt

SEQ ID NO: 85251 - DNA, 20 bp, Artificial Sequence
  Description of Artificial Sequence: Synthetic oligonucleotide
  Target: ATXN1; (-) strand; PAM type: NRG; PAM sequence: TAG
taggacttgaatatacaact

SEQ ID NO: 85252 - DNA, 20 bp, Artificial Sequence
  Description of Artificial Sequence: Synthetic oligonucleotide
  Target: ATXN1; (-) strand; PAM type: NRG; PAM sequence: AGG
aactctagaccagaggccct

SEQ ID NO: 85253 - DNA, 20 bp, Artificial Sequence
  Description of Artificial Sequence: Synthetic oligonucleotide
  Target: ATXN1; (-) strand; PAM type: NRG; PAM sequence: TAG
aaactctagaccagaggccc

SEQ ID NO: 85254 - DNA, 20 bp, Artificial Sequence
  Description of Artificial Sequence: Synthetic oligonucleotide
  Target: ATXN1; (-) strand; PAM type: NRG; PAM sequence: AGG
gggaggaaactctagaccag

SEQ ID NO: 85255 - DNA, 20 bp, Artificial Sequence
  Description of Artificial Sequence: Synthetic oligonucleotide
  Target: ATXN1; (-) strand; PAM type: NRG; PAM sequence: GAG
ggggaggaaactctagacca

SEQ ID NO: 85256 - DNA, 20 bp, Artificial Sequence
  Description of Artificial Sequence: Synthetic oligonucleotide
  Target: ATXN1; (-) strand; PAM type: NRG; PAM sequence: CAG
gtggggaggaaactctagac

SEQ ID NO: 85257 - DNA, 20 bp, Artificial Sequence
  Description of Artificial Sequence: Synthetic oligonucleotide
  Target: ATXN1; (-) strand; PAM type: NRG; PAM sequence: TAG
aaggtgtggggaggaaactc

SEQ ID NO: 85258 - DNA, 20 bp, Artificial Sequence
  Description of Artificial Sequence: Synthetic oligonucleotide
  Target: ATXN1; (-) strand; PAM type: NRG; PAM sequence: AGG
ttggggggaaaggtgtgggg

SEQ ID NO: 85259 - DNA, 20 bp, Artificial Sequence
  Description of Artificial Sequence: Synthetic oligonucleotide
  Target: ATXN1; (-) strand; PAM type: NRG; PAM sequence: GAG
gttggggggaaaggtgtggg

SEQ ID NO: 85260 - DNA, 20 bp, Artificial Sequence
  Description of Artificial Sequence: Synthetic oligonucleotide
  Target: ATXN1; (-) strand; PAM type: NRG; PAM sequence: GGG
gtgttggggggaaaggtgtg

SEQ ID NO: 85261 - DNA, 20 bp, Artificial Sequence
  Description of Artificial Sequence: Synthetic oligonucleotide
  Target: ATXN1; (-) strand; PAM type: NRG; PAM sequence: GGG
cgtgttggggggaaaggtgt

SEQ ID NO: 85262 - DNA, 20 bp, Artificial Sequence
  Description of Artificial Sequence: Synthetic oligonucleotide
  Target: ATXN1; (-) strand; PAM type: NRG; PAM sequence: TGG
acgtgttggggggaaaggtg

SEQ ID NO: 85263 - DNA, 20 bp, Artificial Sequence
  Description of Artificial Sequence: Synthetic oligonucleotide
  Target: ATXN1; (-) strand; PAM type: NRG; PAM sequence: AGG
gggaaacgtgttggggggaa

SEQ ID NO: 85264 - DNA, 20 bp, Artificial Sequence
  Description of Artificial Sequence: Synthetic oligonucleotide
  Target: ATXN1; (-) strand; PAM type: NRG; PAM sequence: AAG
agggaaacgtgttgggggga

SEQ ID NO: 85265 - DNA, 20 bp, Artificial Sequence
  Description of Artificial Sequence: Synthetic oligonucleotide
  Target: ATXN1; (-) strand; PAM type: NRG; PAM sequence: GGG
caagagggaaacgtgttggg

SEQ ID NO: 85266 - DNA, 20 bp, Artificial Sequence
  Description of Artificial Sequence: Synthetic oligonucleotide
  Target: ATXN1; (-) strand; PAM type: NRG; PAM sequence: GGG
acaagagggaaacgtgttgg

SEQ ID NO: 85267 - DNA, 20 bp, Artificial Sequence
  Description of Artificial Sequence: Synthetic oligonucleotide
  Target: ATXN1; (-) strand; PAM type: NRG; PAM sequence: GGG
aacaagagggaaacgtgttg

SEQ ID NO: 85268 - DNA, 20 bp, Artificial Sequence
  Description of Artificial Sequence: Synthetic oligonucleotide
  Target: ATXN1; (-) strand; PAM type: NRG; PAM sequence: GGG
aaacaagagggaaacgtgtt

SEQ ID NO: 85269 - DNA, 20 bp, Artificial Sequence
  Description of Artificial Sequence: Synthetic oligonucleotide
  Target: ATXN1; (-) strand; PAM type: NRG; PAM sequence: TGG
taaacaagagggaaacgtgt

SEQ ID NO: 85270 - DNA, 20 bp, Artificial Sequence
  Description of Artificial Sequence: Synthetic oligonucleotide
  Target: ATXN1; (-) strand; PAM type: NRG; PAM sequence: GGG
cagtaagggagtaaacaaga

SEQ ID NO: 85271 - DNA, 20 bp, Artificial Sequence
  Description of Artificial Sequence: Synthetic oligonucleotide
  Target: ATXN1; (-) strand; PAM type: NRG; PAM sequence: AGG
tcagtaagggagtaaacaag

SEQ ID NO: 85272 - DNA, 20 bp, Artificial Sequence
  Description of Artificial Sequence: Synthetic oligonucleotide
  Target: ATXN1; (-) strand; PAM type: NRG; PAM sequence: GAG
ttcagtaagggagtaaacaa

SEQ ID NO: 85273 - DNA, 20 bp, Artificial Sequence
  Description of Artificial Sequence: Synthetic oligonucleotide
  Target: ATXN1; (-) strand; PAM type: NRG; PAM sequence: AAG
atttcagtaagggagtaaac

SEQ ID NO: 85274 - DNA, 20 bp, Artificial Sequence
  Description of Artificial Sequence: Synthetic oligonucleotide
  Target: ATXN1; (-) strand; PAM type: NRG; PAM sequence: GAG
aaagacacatttcagtaagg

SEQ ID NO: 85275 - DNA, 20 bp, Artificial Sequence
  Description of Artificial Sequence: Synthetic oligonucleotide
  Target: ATXN1; (-) strand; PAM type: NRG; PAM sequence: GGG
gcaaagacacatttcagtaa

SEQ ID NO: 85276 - DNA, 20 bp, Artificial Sequence
  Description of Artificial Sequence: Synthetic oligonucleotide
  Target: ATXN1; (-) strand; PAM type: NRG; PAM sequence: AGG
ggcaaagacacatttcagta

SEQ ID NO: 85277 - DNA, 20 bp, Artificial Sequence
  Description of Artificial Sequence: Synthetic oligonucleotide
  Target: ATXN1; (-) strand; PAM type: NRG; PAM sequence: AAG
tggcaaagacacatttcagt

SEQ ID NO: 85278 - DNA, 20 bp, Artificial Sequence
  Description of Artificial Sequence: Synthetic oligonucleotide
  Target: ATXN1; (-) strand; PAM type: NRG; PAM sequence: CAG
aaattggcaaagacacattt

SEQ ID NO: 85279 - DNA, 20 bp, Artificial Sequence
  Description of Artificial Sequence: Synthetic oligonucleotide
  Target: ATXN1; (-) strand; PAM type: NRG; PAM sequence: AAG
agtaattgtttaaattggca

SEQ ID NO: 85280 - DNA, 20 bp, Artificial Sequence
  Description of Artificial Sequence: Synthetic oligonucleotide
  Target: ATXN1; (-) strand; PAM type: NRG; PAM sequence: TGG
tgaaaagtaattgtttaaat

SEQ ID NO: 85281 - DNA, 20 bp, Artificial Sequence
  Description of Artificial Sequence: Synthetic oligonucleotide
  Target: ATXN1; (-) strand; PAM type: NRG; PAM sequence: AAG
aacatttggaggatgttgaa

SEQ ID NO: 85282 - DNA, 20 bp, Artificial Sequence
  Description of Artificial Sequence: Synthetic oligonucleotide
  Target: ATXN1; (-) strand; PAM type: NRG; PAM sequence: AGG
atgacacagaaaacatttgg

SEQ ID NO: 85283 - DNA, 20 bp, Artificial Sequence
  Description of Artificial Sequence: Synthetic oligonucleotide
  Target: ATXN1; (-) strand; PAM type: NRG; PAM sequence: GAG
tatgacacagaaaacatttg

SEQ ID NO: 85284 - DNA, 20 bp, Artificial Sequence
  Description of Artificial Sequence: Synthetic oligonucleotide
  Target: ATXN1; (-) strand; PAM type: NRG; PAM sequence: TGG
agtatgacacagaaaacatt

SEQ ID NO: 85285 - DNA, 20 bp, Artificial Sequence
  Description of Artificial Sequence: Synthetic oligonucleotide
  Target: ATXN1; (-) strand; PAM type: NRG; PAM sequence: CAG
tcttttaatgcagtatgaca

SEQ ID NO: 85286 - DNA, 20 bp, Artificial Sequence
  Description of Artificial Sequence: Synthetic oligonucleotide
  Target: ATXN1; (-) strand; PAM type: NRG; PAM sequence: CAG
aagtaatttttcttttaatg

SEQ ID NO: 85287 - DNA, 20 bp, Artificial Sequence
  Description of Artificial Sequence: Synthetic oligonucleotide
  Target: ATXN1; (-) strand; PAM type: NRG; PAM sequence: AAG
ggtataattttagtgtttag

SEQ ID NO: 85288 - DNA, 20 bp, Artificial Sequence
  Description of Artificial Sequence: Synthetic oligonucleotide
  Target: ATXN1; (-) strand; PAM type: NRG; PAM sequence: TAG
tgtggtataattttagtgtt

SEQ ID NO: 85289 - DNA, 20 bp, Artificial Sequence
  Description of Artificial Sequence: Synthetic oligonucleotide
  Target: ATXN1; (-) strand; PAM type: NRG; PAM sequence: TAG
tttttcctgtggtataattt

SEQ ID NO: 85290 - DNA, 20 bp, Artificial Sequence
  Description of Artificial Sequence: Synthetic oligonucleotide
  Target: ATXN1; (-) strand; PAM type: NRG; PAM sequence: TGG
aaaagcctttttttttcctg

SEQ ID NO: 85291 - DNA, 20 bp, Artificial Sequence
  Description of Artificial Sequence: Synthetic oligonucleotide
  Target: ATXN1; (-) strand; PAM type: NRG; PAM sequence: AAG
ataaaaatgggtttttaaaa

SEQ ID NO: 85292 - DNA, 20 bp, Artificial Sequence
  Description of Artificial Sequence: Synthetic oligonucleotide
  Target: ATXN1; (-) strand; PAM type: NRG; PAM sequence: GGG
aaaagaagtgttataaaaat

SEQ ID NO: 85293 - DNA, 20 bp, Artificial Sequence
  Description of Artificial Sequence: Synthetic oligonucleotide
  Target: ATXN1; (-) strand; PAM type: NRG; PAM sequence: TGG
caaaagaagtgttataaaaa

SEQ ID NO: 85294 - DNA, 20 bp, Artificial Sequence
  Description of Artificial Sequence: Synthetic oligonucleotide
  Target: ATXN1; (-) strand; PAM type: NRG; PAM sequence: AAG
tgagctagatgtagcaaaag

SEQ ID NO: 85295 - DNA, 20 bp, Artificial Sequence
  Description of Artificial Sequence: Synthetic oligonucleotide
  Target: ATXN1; (-) strand; PAM type: NRG; PAM sequence: AAG
acttgagctagatgtagcaa

SEQ ID NO: 85296 - DNA, 20 bp, Artificial Sequence
  Description of Artificial Sequence: Synthetic oligonucleotide
  Target: ATXN1; (-) strand; PAM type: NRG; PAM sequence: TAG
ttgctgacttgagctagatg

SEQ ID NO: 85297 - DNA, 20 bp, Artificial Sequence
  Description of Artificial Sequence: Synthetic oligonucleotide
  Target: ATXN1; (-) strand; PAM type: NRG; PAM sequence: TAG
cacattttgctgacttgagc

SEQ ID NO: 85298 - DNA, 20 bp, Artificial Sequence
  Description of Artificial Sequence: Synthetic oligonucleotide
  Target: ATXN1; (-) strand; PAM type: NRG; PAM sequence: GAG
gagccacattttgctgactt

SEQ ID NO: 85299 - DNA, 20 bp, Artificial Sequence
  Description of Artificial Sequence: Synthetic oligonucleotide
  Target: ATXN1; (-) strand; PAM type: NRG; PAM sequence: GAG
agactccaaggcatttacta

SEQ ID NO: 85300 - DNA, 20 bp, Artificial Sequence
  Description of Artificial Sequence: Synthetic oligonucleotide
  Target: ATXN1; (-) strand; PAM type: NRG; PAM sequence: TAG
acagactccaaggcatttac

SEQ ID NO: 85301 - DNA, 20 bp, Artificial Sequence
  Description of Artificial Sequence: Synthetic oligonucleotide
  Target: ATXN1; (-) strand; PAM type: NRG; PAM sequence: AGG
tgtgcctaccacagactcca

SEQ ID NO: 85302 - DNA, 20 bp, Artificial Sequence
  Description of Artificial Sequence: Synthetic oligonucleotide
  Target: ATXN1; (-) strand; PAM type: NRG; PAM sequence: AAG
ttgtgcctaccacagactcc

SEQ ID NO: 85303 - DNA, 20 bp, Artificial Sequence
  Description of Artificial Sequence: Synthetic oligonucleotide
  Target: ATXN1; (-) strand; PAM type: NRG; PAM sequence: CAG
gtcccttgttgtgcctacca

SEQ ID NO: 85304 - DNA, 20 bp, Artificial Sequence
  Description of Artificial Sequence: Synthetic oligonucleotide
  Target: ATXN1; (-) strand; PAM type: NRG; PAM sequence: AGG
taggacgtgggtatgtttga

SEQ ID NO: 85305 - DNA, 20 bp, Artificial Sequence
  Description of Artificial Sequence: Synthetic oligonucleotide
  Target: ATXN1; (-) strand; PAM type: NRG; PAM sequence: AAG
ttaggacgtgggtatgtttg

SEQ ID NO: 85306 - DNA, 20 bp, Artificial Sequence
  Description of Artificial Sequence: Synthetic oligonucleotide
  Target: ATXN1; (-) strand; PAM type: NRG; PAM sequence: GGG
gattctggggattaggacgt

SEQ ID NO: 85307 - DNA, 20 bp, Artificial Sequence
  Description of Artificial Sequence: Synthetic oligonucleotide
  Target: ATXN1; (-) strand; PAM type: NRG; PAM sequence: TGG
tgattctggggattaggacg

SEQ ID NO: 85308 - DNA, 20 bp, Artificial Sequence
  Description of Artificial Sequence: Synthetic oligonucleotide
  Target: ATXN1; (-) strand; PAM type: NRG; PAM sequence: AGG
acagactgattctggggatt

SEQ ID NO: 85309 - DNA, 20 bp, Artificial Sequence
  Description of Artificial Sequence: Synthetic oligonucleotide
  Target: ATXN1; (-) strand; PAM type: NRG; PAM sequence: TAG
cacagactgattctggggat

SEQ ID NO: 85310 - DNA, 20 bp, Artificial Sequence
  Description of Artificial Sequence: Synthetic oligonucleotide
  Target: ATXN1; (-) strand; PAM type: NRG; PAM sequence: GGG
gaattcacagactgattctg

SEQ ID NO: 85311 - DNA, 20 bp, Artificial Sequence
  Description of Artificial Sequence: Synthetic oligonucleotide
  Target: ATXN1; (-) strand; PAM type: NRG; PAM sequence: GGG
cgaattcacagactgattct

SEQ ID NO: 85312 - DNA, 20 bp, Artificial Sequence
  Description of Artificial Sequence: Synthetic oligonucleotide
  Target: ATXN1; (-) strand; PAM type: NRG; PAM sequence: TGG
acgaattcacagactgattc

SEQ ID NO: 85313 - DNA, 20 bp, Artificial Sequence
  Description of Artificial Sequence: Synthetic oligonucleotide
  Target: ATXN1; (-) strand; PAM type: NRG; PAM sequence: CAG
tcgcttttaccacgaattca

SEQ ID NO: 85314 - DNA, 20 bp, Artificial Sequence
  Description of Artificial Sequence: Synthetic oligonucleotide
  Target: ATXN1; (-) strand; PAM type: NRG; PAM sequence: CAG
ctgtatcatctccccatctc

SEQ ID NO: 85315 - DNA, 20 bp, Artificial Sequence
  Description of Artificial Sequence: Synthetic oligonucleotide
  Target: ATXN1; (-) strand; PAM type: NRG; PAM sequence: TGG
aaacttccttgcgattacat

SEQ ID NO: 85316 - DNA, 20 bp, Artificial Sequence
  Description of Artificial Sequence: Synthetic oligonucleotide
  Target: ATXN1; (-) strand; PAM type: NRG; PAM sequence: CAG
tgacacttcttcctccttct

SEQ ID NO: 85317 - DNA, 20 bp, Artificial Sequence
  Description of Artificial Sequence: Synthetic oligonucleotide
  Target: ATXN1; (-) strand; PAM type: NRG; PAM sequence: TAG
ctctctgtgctgtgtttcca

SEQ ID NO: 85318 - DNA, 20 bp, Artificial Sequence
  Description of Artificial Sequence: Synthetic oligonucleotide
  Target: ATXN1; (-) strand; PAM type: NRG; PAM sequence: AAG
ggccccttcccctatcttca

SEQ ID NO: 85319 - DNA, 20 bp, Artificial Sequence
  Description of Artificial Sequence: Synthetic oligonucleotide
  Target: ATXN1; (-) strand; PAM type: NRG; PAM sequence: TGG
ccattgtatttcttggctcc

SEQ ID NO: 85320 - DNA, 20 bp, Artificial Sequence
  Description of Artificial Sequence: Synthetic oligonucleotide
  Target: ATXN1; (-) strand; PAM type: NRG; PAM sequence: TGG
ctagatgccattgtatttct

SEQ ID NO: 85321 - DNA, 20 bp, Artificial Sequence
  Description of Artificial Sequence: Synthetic oligonucleotide
  Target: ATXN1; (-) strand; PAM type: NRG; PAM sequence: TAG
gcccacctttttccattgtc

SEQ ID NO: 85322 - DNA, 20 bp, Artificial Sequence
  Description of Artificial Sequence: Synthetic oligonucleotide
  Target: ATXN1; (-) strand; PAM type: NRG; PAM sequence: TGG
caggcatgaaccatcgtgcc

SEQ ID NO: 85323 - DNA, 20 bp, Artificial Sequence
  Description of Artificial Sequence: Synthetic oligonucleotide
  Target: ATXN1; (-) strand; PAM type: NRG; PAM sequence: AGG
tcccagagtgctgggatcac

SEQ ID NO: 85324 - DNA, 20 bp, Artificial Sequence
  Description of Artificial Sequence: Synthetic oligonucleotide
  Target: ATXN1; (-) strand; PAM type: NRG; PAM sequence: CAG
ctcccagagtgctgggatca

SEQ ID NO: 85325 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccagagtgct

SEQ ID NO: 85326 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccagagtgc

SEQ ID NO: 85327 - DNA, 20 bp, Artificial Sequence
  Description of Artificial Sequence: Synthetic oligonucleotide
  Target: ATXN1; (-) strand; PAM type: NRG; PAM sequence: GAG
ccacccgcctcggcctccca

SEQ ID NO: 85328 - DNA, 20 bp, Artificial Sequence
  Description of Artificial Sequence: Synthetic oligonucleotide
  Target: ATXN1; (-) strand; PAM type: NRG; PAM sequence: CAG
atccacccgcctcggcctcc

SEQ ID NO: 85329 - DNA, 20 bp, Artificial Sequence
  Description of Artificial Sequence: Synthetic oligonucleotide
  Target: ATXN1; (-) strand; PAM type: NRG; PAM sequence: CGG
ctcaggcgatccacccgcct

SEQ ID NO: 85330 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactctcgacctc

SEQ ID NO: 85331 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactctcgacct

SEQ ID NO: 85332 - DNA, 20 bp, Artificial Sequence
  Description of Artificial Sequence: Synthetic oligonucleotide
  Target: ATXN1; (-) strand; PAM type: NRG; PAM sequence: TGG
tttctccatgttggccaggc

SEQ ID NO: 85333 - DNA, 20 bp, Artificial Sequence
  Description of Artificial Sequence: Synthetic oligonucleotide
  Target: ATXN1; (-) strand; PAM type: NRG; PAM sequence: AGG
ggggtttctccatgttggcc

SEQ ID NO: 85334 - DNA, 20 bp, Artificial Sequence
  Description of Artificial Sequence: Synthetic oligonucleotide
  Target: ATXN1; (-) strand; PAM type: NRG; PAM sequence: CAG
tggggtttctccatgttggc

SEQ ID NO: 85335 - DNA, 20 bp, Artificial Sequence
  Description of Artificial Sequence: Synthetic oligonucleotide
  Target: ATXN1; (-) strand; PAM type: NRG; PAM sequence: TGG
agagtggggtttctccatgt

SEQ ID NO: 85336 - DNA, 20 bp, Artificial Sequence
  Description of Artificial Sequence: Synthetic oligonucleotide
  Target: ATXN1; (-) strand; PAM type: NRG; PAM sequence: GGG
tttatatttttactagagtg

SEQ ID NO: 85337 - DNA, 20 bp, Artificial Sequence
  Description of Artificial Sequence: Synthetic oligonucleotide
  Target: ATXN1; (-) strand; PAM type: NRG; PAM sequence: GGG
ttttatatttttactagagt

SEQ ID NO: 85338 - DNA, 20 bp, Artificial Sequence
  Description of Artificial Sequence: Synthetic oligonucleotide
  Target: ATXN1; (-) strand; PAM type: NRG; PAM sequence: TGG
attttatatttttactagag

SEQ ID NO: 85339 - DNA, 20 bp, Artificial Sequence
  Description of Artificial Sequence: Synthetic oligonucleotide
  Target: ATXN1; (-) strand; PAM type: NRG; PAM sequence: GAG
taaattttatatttttacta

SEQ ID NO: 85340 - DNA, 20 bp, Artificial Sequence
  Description of Artificial Sequence: Synthetic oligonucleotide
  Target: ATXN1; (-) strand; PAM type: NRG; PAM sequence: TAG
actaaattttatatttttac

SEQ ID NO: 85341 - DNA, 20 bp, Artificial Sequence
  Description of Artificial Sequence: Synthetic oligonucleotide
  Target: ATXN1; (-) strand; PAM type: NRG; PAM sequence: CAG
ccaagtagctgggagtagcc

SEQ ID NO: 85342 - DNA, 20 bp, Artificial Sequence
  Description of Artificial Sequence: Synthetic oligonucleotide
  Target: ATXN1; (-) strand; PAM type: NRG; PAM sequence: TAG
gcctcccaagtagctgggag

SEQ ID NO: 85343 - DNA, 20 bp, Artificial Sequence
  Description of Artificial Sequence: Synthetic oligonucleotide
  Target: ATXN1; (-) strand; PAM type: NRG; PAM sequence: GAG
tcagcctcccaagtagctgg

SEQ ID NO: 85344 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 85345 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 85346 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 85347 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 85348 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgcct

SEQ ID NO: 85349 - DNA, 20 bp, Artificial Sequence
  Description of Artificial Sequence: Synthetic oligonucleotide
  Target: ATXN1; (-) strand; PAM type: NRG; PAM sequence: AAG
cacctccgtctccaaggttc

SEQ ID NO: 85350 - DNA, 20 bp, Artificial Sequence
  Description of Artificial Sequence: Synthetic oligonucleotide
  Target: ATXN1; (-) strand; PAM type: NRG; PAM sequence: AGG
cagtgccacctccgtctcca

SEQ ID NO: 85351 - DNA, 20 bp, Artificial Sequence
  Description of Artificial Sequence: Synthetic oligonucleotide
  Target: ATXN1; (-) strand; PAM type: NRG; PAM sequence: AAG
tcagtgccacctccgtctcc

SEQ ID NO: 85352 - DNA, 20 bp, Artificial Sequence
  Description of Artificial Sequence: Synthetic oligonucleotide
  Target: ATXN1; (-) strand; PAM type: NRG; PAM sequence: CAG
tgcagtggcacatattggct

SEQ ID NO: 85353 - DNA, 20 bp, Artificial Sequence
  Description of Artificial Sequence: Synthetic oligonucleotide
  Target: ATXN1; (-) strand; PAM type: NRG; PAM sequence: TGG
tggagtgcagtggcacatat

SEQ ID NO: 85354 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 85355 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggctggagtg

SEQ ID NO: 85356 - DNA, 20 bp, Artificial Sequence
  Description of Artificial Sequence: Synthetic oligonucleotide
  Target: ATXN1; (-) strand; PAM type: NRG; PAM sequence: GAG
tcattctgtcgcccaggctg

SEQ ID NO: 85357 - DNA, 20 bp, Artificial Sequence
  Description of Artificial Sequence: Synthetic oligonucleotide
  Target: ATXN1; (-) strand; PAM type: NRG; PAM sequence: TGG
tctcattctgtcgcccaggc

SEQ ID NO: 85358 - DNA, 20 bp, Artificial Sequence
  Description of Artificial Sequence: Synthetic oligonucleotide
  Target: ATXN1; (-) strand; PAM type: NRG; PAM sequence: AGG
ggagtctcattctgtcgccc

SEQ ID NO: 85359 - DNA, 20 bp, Artificial Sequence
  Description of Artificial Sequence: Synthetic oligonucleotide
  Target: ATXN1; (-) strand; PAM type: NRG; PAM sequence: CAG
cggagtctcattctgtcgcc

SEQ ID NO: 85360 - DNA, 20 bp, Artificial Sequence
  Description of Artificial Sequence: Synthetic oligonucleotide
  Target: ATXN1; (-) strand; PAM type: NRG; PAM sequence: GAG
ttttttggcgggggggaacg

SEQ ID NO: 85361 - DNA, 20 bp, Artificial Sequence
  Description of Artificial Sequence: Synthetic oligonucleotide
  Target: ATXN1; (-) strand; PAM type: NRG; PAM sequence: CGG
ttttttttggcgggggggaa

SEQ ID NO: 85362 - DNA, 20 bp, Artificial Sequence
  Description of Artificial Sequence: Synthetic oligonucleotide
  Target: ATXN1; (-) strand; PAM type: NRG; PAM sequence: GGG
tttttttttttttggcgggg

SEQ ID NO: 85363 - DNA, 20 bp, Artificial Sequence
  Description of Artificial Sequence: Synthetic oligonucleotide
  Target: ATXN1; (-) strand; PAM type: NRG; PAM sequence: GGG
ttttttttttttttggcggg

SEQ ID NO: 85364 - DNA, 20 bp, Artificial Sequence
  Description of Artificial Sequence: Synthetic oligonucleotide
  Target: ATXN1; (-) strand; PAM type: NRG; PAM sequence: GGG
tttttttttttttttggcgg

SEQ ID NO: 85365 - DNA, 20 bp, Artificial Sequence
  Description of Artificial Sequence: Synthetic oligonucleotide
  Target: ATXN1; (-) strand; PAM type: NRG; PAM sequence: GGG
ttttttttttttttttggcg

SEQ ID NO: 85366 - DNA, 20 bp, Artificial Sequence
  Description of Artificial Sequence: Synthetic oligonucleotide
  Target: ATXN1; (-) strand; PAM type: NRG; PAM sequence: GGG
cttttttttttttttttggc

SEQ ID NO: 85367 - DNA, 20 bp, Artificial Sequence
  Description of Artificial Sequence: Synthetic oligonucleotide
  Target: ATXN1; (-) strand; PAM type: NRG; PAM sequence: CGG
tcttttttttttttttttgg

SEQ ID NO: 85368 - DNA, 20 bp, Artificial Sequence
  Description of Artificial Sequence: Synthetic oligonucleotide
  Target: ATXN1; (-) strand; PAM type: NRG; PAM sequence: TGG
ttttcttttttttttttttt

SEQ ID NO: 85369 - DNA, 20 bp, Artificial Sequence
  Description of Artificial Sequence: Synthetic oligonucleotide
  Target: ATXN1; (-) strand; PAM type: NRG; PAM sequence: GAG
cattctctgtagggactcta

SEQ ID NO: 85370 - DNA, 20 bp, Artificial Sequence
  Description of Artificial Sequence: Synthetic oligonucleotide
  Target: ATXN1; (-) strand; PAM type: NRG; PAM sequence: TAG
ctcattctctgtagggactc

SEQ ID NO: 85371 - DNA, 20 bp, Artificial Sequence
  Description of Artificial Sequence: Synthetic oligonucleotide
  Target: ATXN1; (-) strand; PAM type: NRG; PAM sequence: GGG
agccaggctcattctctgta

SEQ ID NO: 85372 - DNA, 20 bp, Artificial Sequence
  Description of Artificial Sequence: Synthetic oligonucleotide
  Target: ATXN1; (-) strand; PAM type: NRG; PAM sequence: AGG
cagccaggctcattctctgt

SEQ ID NO: 85373 - DNA, 20 bp, Artificial Sequence
  Description of Artificial Sequence: Synthetic oligonucleotide
  Target: ATXN1; (-) strand; PAM type: NRG; PAM sequence: TAG
tcagccaggctcattctctg

SEQ ID NO: 85374 - DNA, 20 bp, Artificial Sequence
  Description of Artificial Sequence: Synthetic oligonucleotide
  Target: ATXN1; (-) strand; PAM type: NRG; PAM sequence: AGG
ctgaaatcaaagtgtcagcc

SEQ ID NO: 85375 - DNA, 20 bp, Artificial Sequence
  Description of Artificial Sequence: Synthetic oligonucleotide
  Target: ATXN1; (-) strand; PAM type: NRG; PAM sequence: CAG
gctgaaatcaaagtgtcagc

SEQ ID NO: 85376 - DNA, 20 bp, Artificial Sequence
  Description of Artificial Sequence: Synthetic oligonucleotide
  Target: ATXN1; (-) strand; PAM type: NRG; PAM sequence: CAG
ccaggctgaaatcaaagtgt

SEQ ID NO: 85377 - DNA, 20 bp, Artificial Sequence
  Description of Artificial Sequence: Synthetic oligonucleotide
  Target: ATXN1; (-) strand; PAM type: NRG; PAM sequence: AAG
gtctcaccaggctgaaatca

SEQ ID NO: 85378 - DNA, 20 bp, Artificial Sequence
  Description of Artificial Sequence: Synthetic oligonucleotide
  Target: ATXN1; (-) strand; PAM type: NRG; PAM sequence: AGG
aatccaatacaggtctcacc

SEQ ID NO: 85379 - DNA, 20 bp, Artificial Sequence
  Description of Artificial Sequence: Synthetic oligonucleotide
  Target: ATXN1; (-) strand; PAM type: NRG; PAM sequence: CAG
aaatccaatacaggtctcac

SEQ ID NO: 85380 - DNA, 20 bp, Artificial Sequence
  Description of Artificial Sequence: Synthetic oligonucleotide
  Target: ATXN1; (-) strand; PAM type: NRG; PAM sequence: AGG
gcaggtcagaaatccaatac

SEQ ID NO: 85381 - DNA, 20 bp, Artificial Sequence
  Description of Artificial Sequence: Synthetic oligonucleotide
  Target: ATXN1; (-) strand; PAM type: NRG; PAM sequence: CAG
tgcaggtcagaaatccaata

SEQ ID NO: 85382 - DNA, 20 bp, Artificial Sequence
  Description of Artificial Sequence: Synthetic oligonucleotide
  Target: ATXN1; (-) strand; PAM type: NRG; PAM sequence: CAG
tatctgacagttctgcaggt

SEQ ID NO: 85383 - DNA, 20 bp, Artificial Sequence
  Description of Artificial Sequence: Synthetic oligonucleotide
  Target: ATXN1; (-) strand; PAM type: NRG; PAM sequence: AGG
tttttatctgacagttctgc

SEQ ID NO: 85384 - DNA, 20 bp, Artificial Sequence
  Description of Artificial Sequence: Synthetic oligonucleotide
  Target: ATXN1; (-) strand; PAM type: NRG; PAM sequence: CAG
gtttttatctgacagttctg

SEQ ID NO: 85385 - DNA, 20 bp, Artificial Sequence
  Description of Artificial Sequence: Synthetic oligonucleotide
  Target: ATXN1; (-) strand; PAM type: NRG; PAM sequence: CAG
aagcaactgtttttatctga

SEQ ID NO: 85386 - DNA, 20 bp, Artificial Sequence
  Description of Artificial Sequence: Synthetic oligonucleotide
  Target: ATXN1; (-) strand; PAM type: NRG; PAM sequence: AAG
atcaggaactttgtggctta

SEQ ID NO: 85387 - DNA, 20 bp, Artificial Sequence
  Description of Artificial Sequence: Synthetic oligonucleotide
  Target: ATXN1; (-) strand; PAM type: NRG; PAM sequence: TGG
acaacttatcaggaactttg

SEQ ID NO: 85388 - DNA, 20 bp, Artificial Sequence
  Description of Artificial Sequence: Synthetic oligonucleotide
  Target: ATXN1; (-) strand; PAM type: NRG; PAM sequence: AGG
tgctgctgtaacaacttatc

SEQ ID NO: 85389 - DNA, 20 bp, Artificial Sequence
  Description of Artificial Sequence: Synthetic oligonucleotide
  Target: ATXN1; (-) strand; PAM type: NRG; PAM sequence: CAG
ttgctgctgtaacaacttat

SEQ ID NO: 85390 - DNA, 20 bp, Artificial Sequence
  Description of Artificial Sequence: Synthetic oligonucleotide
  Target: ATXN1; (-) strand; PAM type: NRG; PAM sequence: TAG
tttcttcaaagcacctgtgt

SEQ ID NO: 85391 - DNA, 20 bp, Artificial Sequence
  Description of Artificial Sequence: Synthetic oligonucleotide
  Target: ATXN1; (-) strand; PAM type: NRG; PAM sequence: AAG
aggtgacctgagtttcttca

SEQ ID NO: 85392 - DNA, 20 bp, Artificial Sequence
  Description of Artificial Sequence: Synthetic oligonucleotide
  Target: ATXN1; (-) strand; PAM type: NRG; PAM sequence: GAG
ctttgtgttagaggtgacct

SEQ ID NO: 85393 - DNA, 20 bp, Artificial Sequence
  Description of Artificial Sequence: Synthetic oligonucleotide
  Target: ATXN1; (-) strand; PAM type: NRG; PAM sequence: AGG
ggccatggcctttgtgttag

SEQ ID NO: 85394 - DNA, 20 bp, Artificial Sequence
  Description of Artificial Sequence: Synthetic oligonucleotide
  Target: ATXN1; (-) strand; PAM type: NRG; PAM sequence: GAG
gggccatggcctttgtgtta

SEQ ID NO: 85395 - DNA, 20 bp, Artificial Sequence
  Description of Artificial Sequence: Synthetic oligonucleotide
  Target: ATXN1; (-) strand; PAM type: NRG; PAM sequence: TAG
ctgggccatggcctttgtgt

SEQ ID NO: 85396 - DNA, 20 bp, Artificial Sequence
  Description of Artificial Sequence: Synthetic oligonucleotide
  Target: ATXN1; (-) strand; PAM type: NRG; PAM sequence: TGG
gtgggtggctggctgggcca

SEQ ID NO: 85397 - DNA, 20 bp, Artificial Sequence
  Description of Artificial Sequence: Synthetic oligonucleotide
  Target: ATXN1; (-) strand; PAM type: NRG; PAM sequence: GGG
aagtatgtgggtggctggct

SEQ ID NO: 85398 - DNA, 20 bp, Artificial Sequence
  Description of Artificial Sequence: Synthetic oligonucleotide
  Target: ATXN1; (-) strand; PAM type: NRG; PAM sequence: TGG
aaagtatgtgggtggctggc

SEQ ID NO: 85399 - DNA, 20 bp, Artificial Sequence
  Description of Artificial Sequence: Synthetic oligonucleotide
  Target: ATXN1; (-) strand; PAM type: NRG; PAM sequence: TGG
ccggaaagtatgtgggtggc

SEQ ID NO: 85400 - DNA, 20 bp, Artificial Sequence
  Description of Artificial Sequence: Synthetic oligonucleotide
  Target: ATXN1; (-) strand; PAM type: NRG; PAM sequence: TGG
aaagccggaaagtatgtggg

SEQ ID NO: 85401 - DNA, 20 bp, Artificial Sequence
  Description of Artificial Sequence: Synthetic oligonucleotide
  Target: ATXN1; (-) strand; PAM type: NRG; PAM sequence: GGG
ggtaaagccggaaagtatgt

SEQ ID NO: 85402 - DNA, 20 bp, Artificial Sequence
  Description of Artificial Sequence: Synthetic oligonucleotide
  Target: ATXN1; (-) strand; PAM type: NRG; PAM sequence: TGG
tggtaaagccggaaagtatg

SEQ ID NO: 85403 - DNA, 20 bp, Artificial Sequence
  Description of Artificial Sequence: Synthetic oligonucleotide
  Target: ATXN1; (-) strand; PAM type: NRG; PAM sequence: AAG
atgtgtttggtaaagccgga

SEQ ID NO: 85404 - DNA, 20 bp, Artificial Sequence
  Description of Artificial Sequence: Synthetic oligonucleotide
  Target: ATXN1; (-) strand; PAM type: NRG; PAM sequence: CGG
ctttatgtgtttggtaaagc

SEQ ID NO: 85405 - DNA, 20 bp, Artificial Sequence
  Description of Artificial Sequence: Synthetic oligonucleotide
  Target: ATXN1; (-) strand; PAM type: NRG; PAM sequence: AAG
ctgtctttatgtgtttggta

SEQ ID NO: 85406 - DNA, 20 bp, Artificial Sequence
  Description of Artificial Sequence: Synthetic oligonucleotide
  Target: ATXN1; (-) strand; PAM type: NRG; PAM sequence: TGG
ggattctgtctttatgtgtt

SEQ ID NO: 85407 - DNA, 20 bp, Artificial Sequence
  Description of Artificial Sequence: Synthetic oligonucleotide
  Target: ATXN1; (-) strand; PAM type: NRG; PAM sequence: GGG
tttgtgccaaattaatattt

SEQ ID NO: 85408 - DNA, 20 bp, Artificial Sequence
  Description of Artificial Sequence: Synthetic oligonucleotide
  Target: ATXN1; (-) strand; PAM type: NRG; PAM sequence: TGG
atttgtgccaaattaatatt

SEQ ID NO: 85409 - DNA, 20 bp, Artificial Sequence
  Description of Artificial Sequence: Synthetic oligonucleotide
  Target: ATXN1; (-) strand; PAM type: NRG; PAM sequence: GGG
tgcatgaaaataaactaccc

SEQ ID NO: 85410 - DNA, 20 bp, Artificial Sequence
  Description of Artificial Sequence: Synthetic oligonucleotide
  Target: ATXN1; (-) strand; PAM type: NRG; PAM sequence: CGG
ttgcatgaaaataaactacc

SEQ ID NO: 85411 - DNA, 20 bp, Artificial Sequence
  Description of Artificial Sequence: Synthetic oligonucleotide
  Target: ATXN1; (-) strand; PAM type: NRG; PAM sequence: CAG
gaaacggagaaaagaggtag

SEQ ID NO: 85412 - DNA, 20 bp, Artificial Sequence
  Description of Artificial Sequence: Synthetic oligonucleotide
  Target: ATXN1; (-) strand; PAM type: NRG; PAM sequence: TAG
aaggaaacggagaaaagagg

SEQ ID NO: 85413 - DNA, 20 bp, Artificial Sequence
  Description of Artificial Sequence: Synthetic oligonucleotide
  Target: ATXN1; (-) strand; PAM type: NRG; PAM sequence: AGG
aggaaggaaacggagaaaag

SEQ ID NO: 85414 - DNA, 20 bp, Artificial Sequence
  Description of Artificial Sequence: Synthetic oligonucleotide
  Target: ATXN1; (-) strand; PAM type: NRG; PAM sequence: GAG
aaggaaggaaacggagaaaa

SEQ ID NO: 85415 - DNA, 20 bp, Artificial Sequence
  Description of Artificial Sequence: Synthetic oligonucleotide
  Target: ATXN1; (-) strand; PAM type: NRG; PAM sequence: AAG
ataaggaaggaaacggagaa

SEQ ID NO: 85416 - DNA, 20 bp, Artificial Sequence
  Description of Artificial Sequence: Synthetic oligonucleotide
  Target: ATXN1; (-) strand; PAM type: NRG; PAM sequence: GAG
gcaggataaggaaggaaacg

SEQ ID NO: 85417 - DNA, 20 bp, Artificial Sequence
  Description of Artificial Sequence: Synthetic oligonucleotide
  Target: ATXN1; (-) strand; PAM type: NRG; PAM sequence: CGG
gagcaggataaggaaggaaa

SEQ ID NO: 85418 - DNA, 20 bp, Artificial Sequence
  Description of Artificial Sequence: Synthetic oligonucleotide
  Target: ATXN1; (-) strand; PAM type: NRG; PAM sequence: AGG
tgggaagagcaggataagga

SEQ ID NO: 85419 - DNA, 20 bp, Artificial Sequence
  Description of Artificial Sequence: Synthetic oligonucleotide
  Target: ATXN1; (-) strand; PAM type: NRG; PAM sequence: AAG
gtgggaagagcaggataagg

SEQ ID NO: 85420 - DNA, 20 bp, Artificial Sequence
  Description of Artificial Sequence: Synthetic oligonucleotide
  Target: ATXN1; (-) strand; PAM type: NRG; PAM sequence: AGG
tgagtgggaagagcaggata

SEQ ID NO: 85421 - DNA, 20 bp, Artificial Sequence
  Description of Artificial Sequence: Synthetic oligonucleotide
  Target: ATXN1; (-) strand; PAM type: NRG; PAM sequence: AAG
gtgagtgggaagagcaggat

SEQ ID NO: 85422 - DNA, 20 bp, Artificial Sequence
  Description of Artificial Sequence: Synthetic oligonucleotide
  Target: ATXN1; (-) strand; PAM type: NRG; PAM sequence: AGG
caggcgtgagtgggaagagc

SEQ ID NO: 85423 - DNA, 20 bp, Artificial Sequence
  Description of Artificial Sequence: Synthetic oligonucleotide
  Target: ATXN1; (-) strand; PAM type: NRG; PAM sequence: CAG
gcaggcgtgagtgggaagag

SEQ ID NO: 85424 - DNA, 20 bp, Artificial Sequence
  Description of Artificial Sequence: Synthetic oligonucleotide
  Target: ATXN1; (-) strand; PAM type: NRG; PAM sequence: GAG
gctgcaggcgtgagtgggaa

SEQ ID NO: 85425 - DNA, 20 bp, Artificial Sequence
  Description of Artificial Sequence: Synthetic oligonucleotide
  Target: ATXN1; (-) strand; PAM type: NRG; PAM sequence: AAG
aagctgcaggcgtgagtggg

SEQ ID NO: 85426 - DNA, 20 bp, Artificial Sequence
  Description of Artificial Sequence: Synthetic oligonucleotide
  Target: ATXN1; (-) strand; PAM type: NRG; PAM sequence: GGG
ggtaagctgcaggcgtgagt

SEQ ID NO: 85427 - DNA, 20 bp, Artificial Sequence
  Description of Artificial Sequence: Synthetic oligonucleotide
  Target: ATXN1; (-) strand; PAM type: NRG; PAM sequence: TGG
aggtaagctgcaggcgtgag

SEQ ID NO: 85428 - DNA, 20 bp, Artificial Sequence
  Description of Artificial Sequence: Synthetic oligonucleotide
  Target: ATXN1; (-) strand; PAM type: NRG; PAM sequence: GAG
aggaggtaagctgcaggcgt

SEQ ID NO: 85429 - DNA, 20 bp, Artificial Sequence
  Description of Artificial Sequence: Synthetic oligonucleotide
  Target: ATXN1; (-) strand; PAM type: NRG; PAM sequence: AGG
aaggtgaggaggtaagctgc

SEQ ID NO: 85430 - DNA, 20 bp, Artificial Sequence
  Description of Artificial Sequence: Synthetic oligonucleotide
  Target: ATXN1; (-) strand; PAM type: NRG; PAM sequence: CAG
aaaggtgaggaggtaagctg

SEQ ID NO: 85431 - DNA, 20 bp, Artificial Sequence
  Description of Artificial Sequence: Synthetic oligonucleotide
  Target: ATXN1; (-) strand; PAM type: NRG; PAM sequence: AAG
cttgacaaaggtgaggaggt

SEQ ID NO: 85432 - DNA, 20 bp, Artificial Sequence
  Description of Artificial Sequence: Synthetic oligonucleotide
  Target: ATXN1; (-) strand; PAM type: NRG; PAM sequence: AGG
ctgccttgacaaaggtgagg

SEQ ID NO: 85433 - DNA, 20 bp, Artificial Sequence
  Description of Artificial Sequence: Synthetic oligonucleotide
  Target: ATXN1; (-) strand; PAM type: NRG; PAM sequence: GAG
cctgccttgacaaaggtgag

SEQ ID NO: 85434 - DNA, 20 bp, Artificial Sequence
  Description of Artificial Sequence: Synthetic oligonucleotide
  Target: ATXN1; (-) strand; PAM type: NRG; PAM sequence: AGG
agcctgccttgacaaaggtg

SEQ ID NO: 85435 - DNA, 20 bp, Artificial Sequence
  Description of Artificial Sequence: Synthetic oligonucleotide
  Target: ATXN1; (-) strand; PAM type: NRG; PAM sequence: GAG
cagcctgccttgacaaaggt

SEQ ID NO: 85436 - DNA, 20 bp, Artificial Sequence
  Description of Artificial Sequence: Synthetic oligonucleotide
  Target: ATXN1; (-) strand; PAM type: NRG; PAM sequence: AGG
aaatcagcctgccttgacaa

SEQ ID NO: 85437 - DNA, 20 bp, Artificial Sequence
  Description of Artificial Sequence: Synthetic oligonucleotide
  Target: ATXN1; (-) strand; PAM type: NRG; PAM sequence: AAG
taaatcagcctgccttgaca

SEQ ID NO: 85438 - DNA, 20 bp, Artificial Sequence
  Description of Artificial Sequence: Synthetic oligonucleotide
  Target: ATXN1; (-) strand; PAM type: NRG; PAM sequence: CAG
tagtttccaagctgataaat

SEQ ID NO: 85439 - DNA, 20 bp, Artificial Sequence
  Description of Artificial Sequence: Synthetic oligonucleotide
  Target: ATXN1; (-) strand; PAM type: NRG; PAM sequence: AAG
ctttccttctcatagtttcc

SEQ ID NO: 85440 - DNA, 20 bp, Artificial Sequence
  Description of Artificial Sequence: Synthetic oligonucleotide
  Target: ATXN1; (-) strand; PAM type: NRG; PAM sequence: TAG
cttagaccctttccttctca

SEQ ID NO: 85441 - DNA, 20 bp, Artificial Sequence
  Description of Artificial Sequence: Synthetic oligonucleotide
  Target: ATXN1; (-) strand; PAM type: NRG; PAM sequence: TAG
ggagttgagaaaccctgcct

SEQ ID NO: 85442 - DNA, 20 bp, Artificial Sequence
  Description of Artificial Sequence: Synthetic oligonucleotide
  Target: ATXN1; (-) strand; PAM type: NRG; PAM sequence: GAG
atgttaatagtgctggagtt

SEQ ID NO: 85443 - DNA, 20 bp, Artificial Sequence
  Description of Artificial Sequence: Synthetic oligonucleotide
  Target: ATXN1; (-) strand; PAM type: NRG; PAM sequence: GAG
ccaaaatgttaatagtgctg

SEQ ID NO: 85444 - DNA, 20 bp, Artificial Sequence
  Description of Artificial Sequence: Synthetic oligonucleotide
  Target: ATXN1; (-) strand; PAM type: NRG; PAM sequence: TGG
gcccaaaatgttaatagtgc

SEQ ID NO: 85445 - DNA, 20 bp, Artificial Sequence
  Description of Artificial Sequence: Synthetic oligonucleotide
  Target: ATXN1; (-) strand; PAM type: NRG; PAM sequence: TAG
catctggcccaaaatgttaa

SEQ ID NO: 85446 - DNA, 20 bp, Artificial Sequence
  Description of Artificial Sequence: Synthetic oligonucleotide
  Target: ATXN1; (-) strand; PAM type: NRG; PAM sequence: TGG
tgcctcaaccaaggatcatc

SEQ ID NO: 85447 - DNA, 20 bp, Artificial Sequence
  Description of Artificial Sequence: Synthetic oligonucleotide
  Target: ATXN1; (-) strand; PAM type: NRG; PAM sequence: AGG
acagtcctctgcctcaacca

SEQ ID NO: 85448 - DNA, 20 bp, Artificial Sequence
  Description of Artificial Sequence: Synthetic oligonucleotide
  Target: ATXN1; (-) strand; PAM type: NRG; PAM sequence: AAG
aacagtcctctgcctcaacc

SEQ ID NO: 85449 - DNA, 20 bp, Artificial Sequence
  Description of Artificial Sequence: Synthetic oligonucleotide
  Target: ATXN1; (-) strand; PAM type: NRG; PAM sequence: CAG
atatcctacaatgcaccaaa

SEQ ID NO: 85450 - DNA, 20 bp, Artificial Sequence
  Description of Artificial Sequence: Synthetic oligonucleotide
  Target: ATXN1; (-) strand; PAM type: NRG; PAM sequence: GGG
agcctgggcagcagagtcag

SEQ ID NO: 85451 - DNA, 20 bp, Artificial Sequence
  Description of Artificial Sequence: Synthetic oligonucleotide
  Target: ATXN1; (-) strand; PAM type: NRG; PAM sequence: GGG
cagcctgggcagcagagtca

SEQ ID NO: 85452 - DNA, 20 bp, Artificial Sequence
  Description of Artificial Sequence: Synthetic oligonucleotide
  Target: ATXN1; (-) strand; PAM type: NRG; PAM sequence: AGG
ccagcctgggcagcagagtc

SEQ ID NO: 85453 - DNA, 20 bp, Artificial Sequence
  Description of Artificial Sequence: Synthetic oligonucleotide
  Target: ATXN1; (-) strand; PAM type: NRG; PAM sequence: CAG
tccagcctgggcagcagagt

SEQ ID NO: 85454 - DNA, 20 bp, Artificial Sequence
  Description of Artificial Sequence: Synthetic oligonucleotide
  Target: ATXN1; (-) strand; PAM type: NRG; PAM sequence: GAG
acactccagcctgggcagca

SEQ ID NO: 85455 - DNA, 20 bp, Artificial Sequence
  Description of Artificial Sequence: Synthetic oligonucleotide
  Target: ATXN1; (-) strand; PAM type: NRG; PAM sequence: CAG
ctacactccagcctgggcag

SEQ ID NO: 85456 - DNA, 20 bp, Artificial Sequence
  Description of Artificial Sequence: Synthetic oligonucleotide
  Target: ATXN1; (-) strand; PAM type: NRG; PAM sequence: CAG
tcactacactccagcctggg

SEQ ID NO: 85457 - DNA, 20 bp, Artificial Sequence
  Description of Artificial Sequence: Synthetic oligonucleotide
  Target: ATXN1; (-) strand; PAM type: NRG; PAM sequence: GGG
gcgtcactacactccagcct

SEQ ID NO: 85458 - DNA, 20 bp, Artificial Sequence
  Description of Artificial Sequence: Synthetic oligonucleotide
  Target: ATXN1; (-) strand; PAM type: NRG; PAM sequence: TGG
ggcgtcactacactccagcc

SEQ ID NO: 85459 - DNA, 20 bp, Artificial Sequence
  Description of Artificial Sequence: Synthetic oligonucleotide
  Target: ATXN1; (-) strand; PAM type: NRG; PAM sequence: CAG
gtgatggcgtcactacactc

SEQ ID NO: 85460 - DNA, 20 bp, Artificial Sequence
  Description of Artificial Sequence: Synthetic oligonucleotide
  Target: ATXN1; (-) strand; PAM type: NRG; PAM sequence: TGG
gaggctgcagtgagctgtga

SEQ ID NO: 85461 - DNA, 20 bp, Artificial Sequence
  Description of Artificial Sequence: Synthetic oligonucleotide
  Target: ATXN1; (-) strand; PAM type: NRG; PAM sequence: GAG
caggagtttgaggctgcagt

SEQ ID NO: 85462 - DNA, 20 bp, Artificial Sequence
  Description of Artificial Sequence: Synthetic oligonucleotide
  Target: ATXN1; (-) strand; PAM type: NRG; PAM sequence: CAG
agctcaggagtttgaggctg

SEQ ID NO: 85463 - DNA, 20 bp, Artificial Sequence
  Description of Artificial Sequence: Synthetic oligonucleotide
  Target: ATXN1; (-) strand; PAM type: NRG; PAM sequence: AGG
cgcctgagctcaggagtttg

SEQ ID NO: 85464 - DNA, 20 bp, Artificial Sequence
  Description of Artificial Sequence: Synthetic oligonucleotide
  Target: ATXN1; (-) strand; PAM type: NRG; PAM sequence: GAG
tcgcctgagctcaggagttt

SEQ ID NO: 85465 - DNA, 20 bp, Artificial Sequence
  Description of Artificial Sequence: Synthetic oligonucleotide
  Target: ATXN1; (-) strand; PAM type: NRG; PAM sequence: GAG
ggaggatcgcctgagctcag

SEQ ID NO: 85466 - DNA, 20 bp, Artificial Sequence
  Description of Artificial Sequence: Synthetic oligonucleotide
  Target: ATXN1; (-) strand; PAM type: NRG; PAM sequence: AGG
caggaggatcgcctgagctc

SEQ ID NO: 85467 - DNA, 20 bp, Artificial Sequence
  Description of Artificial Sequence: Synthetic oligonucleotide
  Target: ATXN1; (-) strand; PAM type: NRG; PAM sequence: CAG
gcaggaggatcgcctgagct

SEQ ID NO: 85468 - DNA, 20 bp, Artificial Sequence
  Description of Artificial Sequence: Synthetic oligonucleotide
  Target: ATXN1; (-) strand; PAM type: NRG; PAM sequence: GAG
tcgaggcaggaggatcgcct

SEQ ID NO: 85469 - DNA, 20 bp, Artificial Sequence
  Description of Artificial Sequence: Synthetic oligonucleotide
  Target: ATXN1; (-) strand; PAM type: NRG; PAM sequence: AGG
ctttaggaggtcgaggcagg

SEQ ID NO: 85470 - DNA, 20 bp, Artificial Sequence
  Description of Artificial Sequence: Synthetic oligonucleotide
  Target: ATXN1; (-) strand; PAM type: NRG; PAM sequence: GAG
actttaggaggtcgaggcag

SEQ ID NO: 85471 - DNA, 20 bp, Artificial Sequence
  Description of Artificial Sequence: Synthetic oligonucleotide
  Target: ATXN1; (-) strand; PAM type: NRG; PAM sequence: AGG
gcactttaggaggtcgaggc

SEQ ID NO: 85472 - DNA, 20 bp, Artificial Sequence
  Description of Artificial Sequence: Synthetic oligonucleotide
  Target: ATXN1; (-) strand; PAM type: NRG; PAM sequence: CAG
agcactttaggaggtcgagg

SEQ ID NO: 85473 - DNA, 20 bp, Artificial Sequence
  Description of Artificial Sequence: Synthetic oligonucleotide
  Target: ATXN1; (-) strand; PAM type: NRG; PAM sequence: AGG
cccagcactttaggaggtcg

SEQ ID NO: 85474 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttaggaggtc

SEQ ID NO: 85475 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttagg

SEQ ID NO: 85476 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttag

SEQ ID NO: 85477 - DNA, 20 bp, Artificial Sequence
  Description of Artificial Sequence: Synthetic oligonucleotide
  Target: ATXN1; (-) strand; PAM type: NRG; PAM sequence: AGG
acctgtaatcccagcacttt

SEQ ID NO: 85478 - DNA, 20 bp, Artificial Sequence
  Description of Artificial Sequence: Synthetic oligonucleotide
  Target: ATXN1; (-) strand; PAM type: NRG; PAM sequence: TAG
cacctgtaatcccagcactt

SEQ ID NO: 85479 - DNA, 20 bp, Artificial Sequence
  Description of Artificial Sequence: Synthetic oligonucleotide
  Target: ATXN1; (-) strand; PAM type: NRG; PAM sequence: CAG
ttggctcacacctgtaatcc

SEQ ID NO: 85480 - DNA, 20 bp, Artificial Sequence
  Description of Artificial Sequence: Synthetic oligonucleotide
  Target: ATXN1; (-) strand; PAM type: NRG; PAM sequence: TGG
tgcaatggggctgggggcat

SEQ ID NO: 85481 - DNA, 20 bp, Artificial Sequence
  Description of Artificial Sequence: Synthetic oligonucleotide
  Target: ATXN1; (-) strand; PAM type: NRG; PAM sequence: GGG
acatcctgcaatggggctgg

SEQ ID NO: 85482 - DNA, 20 bp, Artificial Sequence
  Description of Artificial Sequence: Synthetic oligonucleotide
  Target: ATXN1; (-) strand; PAM type: NRG; PAM sequence: GGG
aacatcctgcaatggggctg

SEQ ID NO: 85483 - DNA, 20 bp, Artificial Sequence
  Description of Artificial Sequence: Synthetic oligonucleotide
  Target: ATXN1; (-) strand; PAM type: NRG; PAM sequence: GGG
gaacatcctgcaatggggct

SEQ ID NO: 85484 - DNA, 20 bp, Artificial Sequence
  Description of Artificial Sequence: Synthetic oligonucleotide
  Target: ATXN1; (-) strand; PAM type: NRG; PAM sequence: TGG
tgaacatcctgcaatggggc

SEQ ID NO: 85485 - DNA, 20 bp, Artificial Sequence
  Description of Artificial Sequence: Synthetic oligonucleotide
  Target: ATXN1; (-) strand; PAM type: NRG; PAM sequence: GGG
ctgctgaacatcctgcaatg

SEQ ID NO: 85486 - DNA, 20 bp, Artificial Sequence
  Description of Artificial Sequence: Synthetic oligonucleotide
  Target: ATXN1; (-) strand; PAM type: NRG; PAM sequence: GGG
gctgctgaacatcctgcaat

SEQ ID NO: 85487 - DNA, 20 bp, Artificial Sequence
  Description of Artificial Sequence: Synthetic oligonucleotide
  Target: ATXN1; (-) strand; PAM type: NRG; PAM sequence: TGG
tgctgctgaacatcctgcaa

SEQ ID NO: 85488 - DNA, 20 bp, Artificial Sequence
  Description of Artificial Sequence: Synthetic oligonucleotide
  Target: ATXN1; (-) strand; PAM type: NRG; PAM sequence: CAG
ggcatctagtgagtagaggc

SEQ ID NO: 85489 - DNA, 20 bp, Artificial Sequence
  Description of Artificial Sequence: Synthetic oligonucleotide
  Target: ATXN1; (-) strand; PAM type: NRG; PAM sequence: AGG
tactggcatctagtgagtag

SEQ ID NO: 85490 - DNA, 20 bp, Artificial Sequence
  Description of Artificial Sequence: Synthetic oligonucleotide
  Target: ATXN1; (-) strand; PAM type: NRG; PAM sequence: GAG
atactggcatctagtgagta

SEQ ID NO: 85491 - DNA, 20 bp, Artificial Sequence
  Description of Artificial Sequence: Synthetic oligonucleotide
  Target: ATXN1; (-) strand; PAM type: NRG; PAM sequence: TAG
caatactggcatctagtgag

SEQ ID NO: 85492 - DNA, 20 bp, Artificial Sequence
  Description of Artificial Sequence: Synthetic oligonucleotide
  Target: ATXN1; (-) strand; PAM type: NRG; PAM sequence: GAG
tagcaatactggcatctagt

SEQ ID NO: 85493 - DNA, 20 bp, Artificial Sequence
  Description of Artificial Sequence: Synthetic oligonucleotide
  Target: ATXN1; (-) strand; PAM type: NRG; PAM sequence: TAG
aaggtagcaatactggcatc

SEQ ID NO: 85494 - DNA, 20 bp, Artificial Sequence
  Description of Artificial Sequence: Synthetic oligonucleotide
  Target: ATXN1; (-) strand; PAM type: NRG; PAM sequence: TGG
ggaaaacaaggtagcaatac

SEQ ID NO: 85495 - DNA, 20 bp, Artificial Sequence
  Description of Artificial Sequence: Synthetic oligonucleotide
  Target: ATXN1; (-) strand; PAM type: NRG; PAM sequence: TAG
tcccaaatgggaaaacaagg

SEQ ID NO: 85496 - DNA, 20 bp, Artificial Sequence
  Description of Artificial Sequence: Synthetic oligonucleotide
  Target: ATXN1; (-) strand; PAM type: NRG; PAM sequence: AGG
tcgtcccaaatgggaaaaca

SEQ ID NO: 85497 - DNA, 20 bp, Artificial Sequence
  Description of Artificial Sequence: Synthetic oligonucleotide
  Target: ATXN1; (-) strand; PAM type: NRG; PAM sequence: AAG
atcgtcccaaatgggaaaac

SEQ ID NO: 85498 - DNA, 20 bp, Artificial Sequence
  Description of Artificial Sequence: Synthetic oligonucleotide
  Target: ATXN1; (-) strand; PAM type: NRG; PAM sequence: GGG
actttttgatcgtcccaaat

SEQ ID NO: 85499 - DNA, 20 bp, Artificial Sequence
  Description of Artificial Sequence: Synthetic oligonucleotide
  Target: ATXN1; (-) strand; PAM type: NRG; PAM sequence: TGG
cactttttgatcgtcccaaa

SEQ ID NO: 85500 - DNA, 20 bp, Artificial Sequence
  Description of Artificial Sequence: Synthetic oligonucleotide
  Target: ATXN1; (-) strand; PAM type: NRG; PAM sequence: GAG
aggacatttggcaatgtttg

SEQ ID NO: 85501 - DNA, 20 bp, Artificial Sequence
  Description of Artificial Sequence: Synthetic oligonucleotide
  Target: ATXN1; (-) strand; PAM type: NRG; PAM sequence: TGG
tcaggacatttggcaatgtt

SEQ ID NO: 85502 - DNA, 20 bp, Artificial Sequence
  Description of Artificial Sequence: Synthetic oligonucleotide
  Target: ATXN1; (-) strand; PAM type: NRG; PAM sequence: TGG
ttttgccctctcaggacatt

SEQ ID NO: 85503 - DNA, 20 bp, Artificial Sequence
  Description of Artificial Sequence: Synthetic oligonucleotide
  Target: ATXN1; (-) strand; PAM type: NRG; PAM sequence: AGG
ggggaccattttgccctctc

SEQ ID NO: 85504 - DNA, 20 bp, Artificial Sequence
  Description of Artificial Sequence: Synthetic oligonucleotide
  Target: ATXN1; (-) strand; PAM type: NRG; PAM sequence: CAG
tggggaccattttgccctct

SEQ ID NO: 85505 - DNA, 20 bp, Artificial Sequence
  Description of Artificial Sequence: Synthetic oligonucleotide
  Target: ATXN1; (-) strand; PAM type: NRG; PAM sequence: GGG
caaccagtggatctcaactg

SEQ ID NO: 85506 - DNA, 20 bp, Artificial Sequence
  Description of Artificial Sequence: Synthetic oligonucleotide
  Target: ATXN1; (-) strand; PAM type: NRG; PAM sequence: GGG
tcaaccagtggatctcaact

SEQ ID NO: 85507 - DNA, 20 bp, Artificial Sequence
  Description of Artificial Sequence: Synthetic oligonucleotide
  Target: ATXN1; (-) strand; PAM type: NRG; PAM sequence: TGG
gtcaaccagtggatctcaac

SEQ ID NO: 85508 - DNA, 20 bp, Artificial Sequence
  Description of Artificial Sequence: Synthetic oligonucleotide
  Target: ATXN1; (-) strand; PAM type: NRG; PAM sequence: TGG
tgccacatgctgtcaaccag

SEQ ID NO: 85509 - DNA, 20 bp, Artificial Sequence
  Description of Artificial Sequence: Synthetic oligonucleotide
  Target: ATXN1; (-) strand; PAM type: NRG; PAM sequence: CAG
aactgccacatgctgtcaac

SEQ ID NO: 85510 - DNA, 20 bp, Artificial Sequence
  Description of Artificial Sequence: Synthetic oligonucleotide
  Target: ATXN1; (-) strand; PAM type: NRG; PAM sequence: CAG
gggaactgatggagagaaca

SEQ ID NO: 85511 - DNA, 20 bp, Artificial Sequence
  Description of Artificial Sequence: Synthetic oligonucleotide
  Target: ATXN1; (-) strand; PAM type: NRG; PAM sequence: GAG
tatgggagggaactgatgga

SEQ ID NO: 85512 - DNA, 20 bp, Artificial Sequence
  Description of Artificial Sequence: Synthetic oligonucleotide
  Target: ATXN1; (-) strand; PAM type: NRG; PAM sequence: GAG
tgtatgggagggaactgatg

SEQ ID NO: 85513 - DNA, 20 bp, Artificial Sequence
  Description of Artificial Sequence: Synthetic oligonucleotide
  Target: ATXN1; (-) strand; PAM type: NRG; PAM sequence: TGG
catgtatgggagggaactga

SEQ ID NO: 85514 - DNA, 20 bp, Artificial Sequence
  Description of Artificial Sequence: Synthetic oligonucleotide
  Target: ATXN1; (-) strand; PAM type: NRG; PAM sequence: GGG
gagcatttccatgtatggga

SEQ ID NO: 85515 - DNA, 20 bp, Artificial Sequence
  Description of Artificial Sequence: Synthetic oligonucleotide
  Target: ATXN1; (-) strand; PAM type: NRG; PAM sequence: AGG
agagcatttccatgtatggg

SEQ ID NO: 85516 - DNA, 20 bp, Artificial Sequence
  Description of Artificial Sequence: Synthetic oligonucleotide
  Target: ATXN1; (-) strand; PAM type: NRG; PAM sequence: GAG
tagagcatttccatgtatgg

SEQ ID NO: 85517 - DNA, 20 bp, Artificial Sequence
  Description of Artificial Sequence: Synthetic oligonucleotide
  Target: ATXN1; (-) strand; PAM type: NRG; PAM sequence: GGG
gttagagcatttccatgtat

SEQ ID NO: 85518 - DNA, 20 bp, Artificial Sequence
  Description of Artificial Sequence: Synthetic oligonucleotide
  Target: ATXN1; (-) strand; PAM type: NRG; PAM sequence: TGG
cgttagagcatttccatgta

SEQ ID NO: 85519 - DNA, 20 bp, Artificial Sequence
  Description of Artificial Sequence: Synthetic oligonucleotide
  Target: ATXN1; (-) strand; PAM type: NRG; PAM sequence: GAG
tatatatataaaacacgtta

SEQ ID NO: 85520 - DNA, 20 bp, Artificial Sequence
  Description of Artificial Sequence: Synthetic oligonucleotide
  Target: ATXN1; (-) strand; PAM type: NRG; PAM sequence: TAG
tatatatatataaaacacgt

SEQ ID NO: 85521 - DNA, 20 bp, Artificial Sequence
  Description of Artificial Sequence: Synthetic oligonucleotide
  Target: ATXN1; (-) strand; PAM type: NRG; PAM sequence: AAG
aatgagaccagcagcaatgt

SEQ ID NO: 85522 - DNA, 20 bp, Artificial Sequence
  Description of Artificial Sequence: Synthetic oligonucleotide
  Target: ATXN1; (-) strand; PAM type: NRG; PAM sequence: CAG
actcatttgaatgagaccag

SEQ ID NO: 85523 - DNA, 20 bp, Artificial Sequence
  Description of Artificial Sequence: Synthetic oligonucleotide
  Target: ATXN1; (-) strand; PAM type: NRG; PAM sequence: CAG
gagactcatttgaatgagac

SEQ ID NO: 85524 - DNA, 20 bp, Artificial Sequence
  Description of Artificial Sequence: Synthetic oligonucleotide
  Target: ATXN1; (-) strand; PAM type: NRG; PAM sequence: GAG
cttgggagactcatttgaat

SEQ ID NO: 85525 - DNA, 20 bp, Artificial Sequence
  Description of Artificial Sequence: Synthetic oligonucleotide
  Target: ATXN1; (-) strand; PAM type: NRG; PAM sequence: GAG
caaacagactgaatccttgg

SEQ ID NO: 85526 - DNA, 20 bp, Artificial Sequence
  Description of Artificial Sequence: Synthetic oligonucleotide
  Target: ATXN1; (-) strand; PAM type: NRG; PAM sequence: GGG
gtcaaacagactgaatcctt

SEQ ID NO: 85527 - DNA, 20 bp, Artificial Sequence
  Description of Artificial Sequence: Synthetic oligonucleotide
  Target: ATXN1; (-) strand; PAM type: NRG; PAM sequence: TGG
tgtcaaacagactgaatcct

SEQ ID NO: 85528 - DNA, 20 bp, Artificial Sequence
  Description of Artificial Sequence: Synthetic oligonucleotide
  Target: ATXN1; (-) strand; PAM type: NRG; PAM sequence: CAG
agctgttttaaaatgtcaaa

SEQ ID NO: 85529 - DNA, 20 bp, Artificial Sequence
  Description of Artificial Sequence: Synthetic oligonucleotide
  Target: ATXN1; (-) strand; PAM type: NRG; PAM sequence: GAG
tgtggttgaattctgagttt

SEQ ID NO: 85530 - DNA, 20 bp, Artificial Sequence
  Description of Artificial Sequence: Synthetic oligonucleotide
  Target: ATXN1; (-) strand; PAM type: NRG; PAM sequence: GAG
aagtcctgtggttgaattct

SEQ ID NO: 85531 - DNA, 20 bp, Artificial Sequence
  Description of Artificial Sequence: Synthetic oligonucleotide
  Target: ATXN1; (-) strand; PAM type: NRG; PAM sequence: TGG
cattttaaaaaaaagtcctg

SEQ ID NO: 85532 - DNA, 20 bp, Artificial Sequence
  Description of Artificial Sequence: Synthetic oligonucleotide
  Target: ATXN1; (-) strand; PAM type: NRG; PAM sequence: AAG
agtggggccattttaaaaaa

SEQ ID NO: 85533 - DNA, 20 bp, Artificial Sequence
  Description of Artificial Sequence: Synthetic oligonucleotide
  Target: ATXN1; (-) strand; PAM type: NRG; PAM sequence: GGG
ggctgggaataagtatagtg

SEQ ID NO: 85534 - DNA, 20 bp, Artificial Sequence
  Description of Artificial Sequence: Synthetic oligonucleotide
  Target: ATXN1; (-) strand; PAM type: NRG; PAM sequence: GGG
tggctgggaataagtatagt

SEQ ID NO: 85535 - DNA, 20 bp, Artificial Sequence
  Description of Artificial Sequence: Synthetic oligonucleotide
  Target: ATXN1; (-) strand; PAM type: NRG; PAM sequence: TGG
gtggctgggaataagtatag

SEQ ID NO: 85536 - DNA, 20 bp, Artificial Sequence
  Description of Artificial Sequence: Synthetic oligonucleotide
  Target: ATXN1; (-) strand; PAM type: NRG; PAM sequence: TAG
cctgtggctgggaataagta

SEQ ID NO: 85537 - DNA, 20 bp, Artificial Sequence
  Description of Artificial Sequence: Synthetic oligonucleotide
  Target: ATXN1; (-) strand; PAM type: NRG; PAM sequence: AAG
ccttgcctgtggctgggaat

SEQ ID NO: 85538 - DNA, 20 bp, Artificial Sequence
  Description of Artificial Sequence: Synthetic oligonucleotide
  Target: ATXN1; (-) strand; PAM type: NRG; PAM sequence: GGG
tgtttcccttgcctgtggct

SEQ ID NO: 85539 - DNA, 20 bp, Artificial Sequence
  Description of Artificial Sequence: Synthetic oligonucleotide
  Target: ATXN1; (-) strand; PAM type: NRG; PAM sequence: TGG
atgtttcccttgcctgtggc

SEQ ID NO: 85540 - DNA, 20 bp, Artificial Sequence
  Description of Artificial Sequence: Synthetic oligonucleotide
  Target: ATXN1; (-) strand; PAM type: NRG; PAM sequence: TGG
agccatgtttcccttgcctg

SEQ ID NO: 85541 - DNA, 20 bp, Artificial Sequence
  Description of Artificial Sequence: Synthetic oligonucleotide
  Target: ATXN1; (-) strand; PAM type: NRG; PAM sequence: AAG
ggctgcgggtcattgtggaa

SEQ ID NO: 85542 - DNA, 20 bp, Artificial Sequence
  Description of Artificial Sequence: Synthetic oligonucleotide
  Target: ATXN1; (-) strand; PAM type: NRG; PAM sequence: TGG
ggttgggctgcgggtcattg

SEQ ID NO: 85543 - DNA, 20 bp, Artificial Sequence
  Description of Artificial Sequence: Synthetic oligonucleotide
  Target: ATXN1; (-) strand; PAM type: NRG; PAM sequence: GGG
tgttggctaggttgggctgc

SEQ ID NO: 85544 - DNA, 20 bp, Artificial Sequence
  Description of Artificial Sequence: Synthetic oligonucleotide
  Target: ATXN1; (-) strand; PAM type: NRG; PAM sequence: CGG
ttgttggctaggttgggctg

SEQ ID NO: 85545 - DNA, 20 bp, Artificial Sequence
  Description of Artificial Sequence: Synthetic oligonucleotide
  Target: ATXN1; (-) strand; PAM type: NRG; PAM sequence: GGG
gtgagcttgttggctaggtt

SEQ ID NO: 85546 - DNA, 20 bp, Artificial Sequence
  Description of Artificial Sequence: Synthetic oligonucleotide
  Target: ATXN1; (-) strand; PAM type: NRG; PAM sequence: TGG
tgtgagcttgttggctaggt

SEQ ID NO: 85547 - DNA, 20 bp, Artificial Sequence
  Description of Artificial Sequence: Synthetic oligonucleotide
  Target: ATXN1; (-) strand; PAM type: NRG; PAM sequence: AGG
gaattgtgagcttgttggct

SEQ ID NO: 85548 - DNA, 20 bp, Artificial Sequence
  Description of Artificial Sequence: Synthetic oligonucleotide
  Target: ATXN1; (-) strand; PAM type: NRG; PAM sequence: TAG
tgaattgtgagcttgttggc

SEQ ID NO: 85549 - DNA, 20 bp, Artificial Sequence
  Description of Artificial Sequence: Synthetic oligonucleotide
  Target: ATXN1; (-) strand; PAM type: NRG; PAM sequence: TGG
tggatgaattgtgagcttgt

SEQ ID NO: 85550 - DNA, 20 bp, Artificial Sequence
  Description of Artificial Sequence: Synthetic oligonucleotide
  Target: ATXN1; (-) strand; PAM type: NRG; PAM sequence: GAG
cagcagtatggatgaattgt

SEQ ID NO: 85551 - DNA, 20 bp, Artificial Sequence
  Description of Artificial Sequence: Synthetic oligonucleotide
  Target: ATXN1; (-) strand; PAM type: NRG; PAM sequence: TGG
tcgcctctgtagcagcagta

SEQ ID NO: 85552 - DNA, 20 bp, Artificial Sequence
  Description of Artificial Sequence: Synthetic oligonucleotide
  Target: ATXN1; (-) strand; PAM type: NRG; PAM sequence: CAG
ctctgtcgcctctgtagcag

SEQ ID NO: 85553 - DNA, 20 bp, Artificial Sequence
  Description of Artificial Sequence: Synthetic oligonucleotide
  Target: ATXN1; (-) strand; PAM type: NRG; PAM sequence: CAG
gacctctgtcgcctctgtag

SEQ ID NO: 85554 - DNA, 20 bp, Artificial Sequence
  Description of Artificial Sequence: Synthetic oligonucleotide
  Target: ATXN1; (-) strand; PAM type: NRG; PAM sequence: TAG
gctgacctctgtcgcctctg

SEQ ID NO: 85555 - DNA, 20 bp, Artificial Sequence
  Description of Artificial Sequence: Synthetic oligonucleotide
  Target: ATXN1; (-) strand; PAM type: NRG; PAM sequence: AAG
ctctgtaacagtcaaatagc

SEQ ID NO: 85556 - DNA, 20 bp, Artificial Sequence
  Description of Artificial Sequence: Synthetic oligonucleotide
  Target: ATXN1; (-) strand; PAM type: NRG; PAM sequence: TAG
agttctctgtaacagtcaaa

SEQ ID NO: 85557 - DNA, 20 bp, Artificial Sequence
  Description of Artificial Sequence: Synthetic oligonucleotide
  Target: ATXN1; (-) strand; PAM type: NRG; PAM sequence: CAG
aaaaagaaagttctctgtaa

SEQ ID NO: 85558 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaaga

SEQ ID NO: 85559 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaaaaaaaaaaa

SEQ ID NO: 85560 - DNA, 20 bp, Artificial Sequence
  Description of Artificial Sequence: Synthetic oligonucleotide
  Target: ATXN1; (-) strand; PAM type: NRG; PAM sequence: GAG
ctccagcctggcaacagagc

SEQ ID NO: 85561 - DNA, 20 bp, Artificial Sequence
  Description of Artificial Sequence: Synthetic oligonucleotide
  Target: ATXN1; (-) strand; PAM type: NRG; PAM sequence: GAG
tgcactccagcctggcaaca

SEQ ID NO: 85562 - DNA, 20 bp, Artificial Sequence
  Description of Artificial Sequence: Synthetic oligonucleotide
  Target: ATXN1; (-) strand; PAM type: NRG; PAM sequence: CAG
actgcactccagcctggcaa

SEQ ID NO: 85563 - DNA, 20 bp, Artificial Sequence
  Description of Artificial Sequence: Synthetic oligonucleotide
  Target: ATXN1; (-) strand; PAM type: NRG; PAM sequence: TGG
cacaccactgcactccagcc

SEQ ID NO: 85564 - DNA, 20 bp, Artificial Sequence
  Description of Artificial Sequence: Synthetic oligonucleotide
  Target: ATXN1; (-) strand; PAM type: NRG; PAM sequence: CAG
gagatcacaccactgcactc

SEQ ID NO: 85565 - DNA, 20 bp, Artificial Sequence
  Description of Artificial Sequence: Synthetic oligonucleotide
  Target: ATXN1; (-) strand; PAM type: NRG; PAM sequence: GAG
ttgcagtgttgcagtgagcc

SEQ ID NO: 85566 - DNA, 20 bp, Artificial Sequence
  Description of Artificial Sequence: Synthetic oligonucleotide
  Target: ATXN1; (-) strand; PAM type: NRG; PAM sequence: GAG
ggagcttgcagtgttgcagt

SEQ ID NO: 85567 - DNA, 20 bp, Artificial Sequence
  Description of Artificial Sequence: Synthetic oligonucleotide
  Target: ATXN1; (-) strand; PAM type: NRG; PAM sequence: CAG
aggcggagcttgcagtgttg

SEQ ID NO: 85568 - DNA, 20 bp, Artificial Sequence
  Description of Artificial Sequence: Synthetic oligonucleotide
  Target: ATXN1; (-) strand; PAM type: NRG; PAM sequence: CAG
aacccatgaggcggagcttg

SEQ ID NO: 85569 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccatgaggcg

SEQ ID NO: 85570 - DNA, 20 bp, Artificial Sequence
  Description of Artificial Sequence: Synthetic oligonucleotide
  Target: ATXN1; (-) strand; PAM type: NRG; PAM sequence: CGG
aatcgcttgaacccatgagg

SEQ ID NO: 85571 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacccatg

SEQ ID NO: 85572 - DNA, 20 bp, Artificial Sequence
  Description of Artificial Sequence: Synthetic oligonucleotide
  Target: ATXN1; (-) strand; PAM type: NRG; PAM sequence: GAG
ggagaatcgcttgaacccat

SEQ ID NO: 85573 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctgaggcag

SEQ ID NO: 85574 - DNA, 20 bp, Artificial Sequence
  Description of Artificial Sequence: Synthetic oligonucleotide
  Target: ATXN1; (-) strand; PAM type: NRG; PAM sequence: AGG
gctacttgggaggctgaggc

SEQ ID NO: 85575 - DNA, 20 bp, Artificial Sequence
  Description of Artificial Sequence: Synthetic oligonucleotide
  Target: ATXN1; (-) strand; PAM type: NRG; PAM sequence: CAG
agctacttgggaggctgagg

SEQ ID NO: 85576 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggctg

SEQ ID NO: 85577 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggaggct

SEQ ID NO: 85578 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 85579 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 85580 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagctactt

SEQ ID NO: 85581 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagctact

SEQ ID NO: 85582 - DNA, 20 bp, Artificial Sequence
  Description of Artificial Sequence: Synthetic oligonucleotide
  Target: ATXN1; (-) strand; PAM type: NRG; PAM sequence: CAG
gtggtgggcgcctgtaatcc

SEQ ID NO: 85583 - DNA, 20 bp, Artificial Sequence
  Description of Artificial Sequence: Synthetic oligonucleotide
  Target: ATXN1; (-) strand; PAM type: NRG; PAM sequence: GGG
aattagctgggcgtggtggt

SEQ ID NO: 85584 - DNA, 20 bp, Artificial Sequence
  Description of Artificial Sequence: Synthetic oligonucleotide
  Target: ATXN1; (-) strand; PAM type: NRG; PAM sequence: TGG
aaattagctgggcgtggtgg

SEQ ID NO: 85585 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagctgggcgtgg

SEQ ID NO: 85586 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaattagctgggcg

SEQ ID NO: 85587 - DNA, 20 bp, Artificial Sequence
  Description of Artificial Sequence: Synthetic oligonucleotide
  Target: ATXN1; (-) strand; PAM type: NRG; PAM sequence: GGG
aaaaaaaaaaaaaattagct

SEQ ID NO: 85588 - DNA, 20 bp, Artificial Sequence
  Description of Artificial Sequence: Synthetic oligonucleotide
  Target: ATXN1; (-) strand; PAM type: NRG; PAM sequence: TGG
caaaaaaaaaaaaaattagc

SEQ ID NO: 85589 - DNA, 20 bp, Artificial Sequence
  Description of Artificial Sequence: Synthetic oligonucleotide
  Target: ATXN1; (-) strand; PAM type: NRG; PAM sequence: TAG
aatacaaaaaaaaaaaaaat

SEQ ID NO: 85590 - DNA, 20 bp, Artificial Sequence
  Description of Artificial Sequence: Synthetic oligonucleotide
  Target: ATXN1; (-) strand; PAM type: NRG; PAM sequence: CAG
tgagaccagcctagctaata

SEQ ID NO: 85591 - DNA, 20 bp, Artificial Sequence
  Description of Artificial Sequence: Synthetic oligonucleotide
  Target: ATXN1; (-) strand; PAM type: NRG; PAM sequence: TAG
tgaggagtttgagaccagcc

SEQ ID NO: 85592 - DNA, 20 bp, Artificial Sequence
  Description of Artificial Sequence: Synthetic oligonucleotide
  Target: ATXN1; (-) strand; PAM type: NRG; PAM sequence: CAG
tgaggtgaggagtttgagac

SEQ ID NO: 85593 - DNA, 20 bp, Artificial Sequence
  Description of Artificial Sequence: Synthetic oligonucleotide
  Target: ATXN1; (-) strand; PAM type: NRG; PAM sequence: GAG
gatcatgaggtgaggagttt

SEQ ID NO: 85594 - DNA, 20 bp, Artificial Sequence
  Description of Artificial Sequence: Synthetic oligonucleotide
  Target: ATXN1; (-) strand; PAM type: NRG; PAM sequence: GAG
tgggcagatcatgaggtgag

SEQ ID NO: 85595 - DNA, 20 bp, Artificial Sequence
  Description of Artificial Sequence: Synthetic oligonucleotide
  Target: ATXN1; (-) strand; PAM type: NRG; PAM sequence: AGG
ggtgggcagatcatgaggtg

SEQ ID NO: 85596 - DNA, 20 bp, Artificial Sequence
  Description of Artificial Sequence: Synthetic oligonucleotide
  Target: ATXN1; (-) strand; PAM type: NRG; PAM sequence: GAG
aggtgggcagatcatgaggt

SEQ ID NO: 85597 - DNA, 20 bp, Artificial Sequence
  Description of Artificial Sequence: Synthetic oligonucleotide
  Target: ATXN1; (-) strand; PAM type: NRG; PAM sequence: AGG
gccaaggtgggcagatcatg

SEQ ID NO: 85598 - DNA, 20 bp, Artificial Sequence
  Description of Artificial Sequence: Synthetic oligonucleotide
  Target: ATXN1; (-) strand; PAM type: NRG; PAM sequence: GAG
ggccaaggtgggcagatcat

SEQ ID NO: 85599 - DNA, 20 bp, Artificial Sequence
  Description of Artificial Sequence: Synthetic oligonucleotide
  Target: ATXN1; (-) strand; PAM type: NRG; PAM sequence: CAG
ttttcggaggccaaggtggg

SEQ ID NO: 85600 - DNA, 20 bp, Artificial Sequence
  Description of Artificial Sequence: Synthetic oligonucleotide
  Target: ATXN1; (-) strand; PAM type: NRG; PAM sequence: GGG
gcattttcggaggccaaggt

SEQ ID NO: 85601 - DNA, 20 bp, Artificial Sequence
  Description of Artificial Sequence: Synthetic oligonucleotide
  Target: ATXN1; (-) strand; PAM type: NRG; PAM sequence: TGG
agcattttcggaggccaagg

SEQ ID NO: 85602 - DNA, 20 bp, Artificial Sequence
  Description of Artificial Sequence: Synthetic oligonucleotide
  Target: ATXN1; (-) strand; PAM type: NRG; PAM sequence: AGG
cccagcattttcggaggcca

SEQ ID NO: 85603 - DNA, 20 bp, Artificial Sequence
  Description of Artificial Sequence: Synthetic oligonucleotide
  Target: ATXN1; (-) strand; PAM type: NRG; PAM sequence: AAG
tcccagcattttcggaggcc

SEQ ID NO: 85604 - DNA, 20 bp, Artificial Sequence
  Description of Artificial Sequence: Synthetic oligonucleotide
  Target: ATXN1; (-) strand; PAM type: NRG; PAM sequence: AGG
tataatcccagcattttcgg

SEQ ID NO: 85605 - DNA, 20 bp, Artificial Sequence
  Description of Artificial Sequence: Synthetic oligonucleotide
  Target: ATXN1; (-) strand; PAM type: NRG; PAM sequence: GAG
ctataatcccagcattttcg

SEQ ID NO: 85606 - DNA, 20 bp, Artificial Sequence
  Description of Artificial Sequence: Synthetic oligonucleotide
  Target: ATXN1; (-) strand; PAM type: NRG; PAM sequence: CGG
gcctataatcccagcatttt

SEQ ID NO: 85607 - DNA, 20 bp, Artificial Sequence
  Description of Artificial Sequence: Synthetic oligonucleotide
  Target: ATXN1; (-) strand; PAM type: NRG; PAM sequence: CAG
gtggctcaagcctataatcc

SEQ ID NO: 85608 - DNA, 20 bp, Artificial Sequence
  Description of Artificial Sequence: Synthetic oligonucleotide
  Target: ATXN1; (-) strand; PAM type: NRG; PAM sequence: AAG
taggcagggcgtggtggctc

SEQ ID NO: 85609 - DNA, 20 bp, Artificial Sequence
  Description of Artificial Sequence: Synthetic oligonucleotide
  Target: ATXN1; (-) strand; PAM type: NRG; PAM sequence: TGG
tctctgtaggcagggcgtgg

SEQ ID NO: 85610 - DNA, 20 bp, Artificial Sequence
  Description of Artificial Sequence: Synthetic oligonucleotide
  Target: ATXN1; (-) strand; PAM type: NRG; PAM sequence: TGG
agttctctgtaggcagggcg

SEQ ID NO: 85611 - DNA, 20 bp, Artificial Sequence
  Description of Artificial Sequence: Synthetic oligonucleotide
  Target: ATXN1; (-) strand; PAM type: NRG; PAM sequence: GGG
taggaagttctctgtaggca

SEQ ID NO: 85612 - DNA, 20 bp, Artificial Sequence
  Description of Artificial Sequence: Synthetic oligonucleotide
  Target: ATXN1; (-) strand; PAM type: NRG; PAM sequence: AGG
ttaggaagttctctgtaggc

SEQ ID NO: 85613 - DNA, 20 bp, Artificial Sequence
  Description of Artificial Sequence: Synthetic oligonucleotide
  Target: ATXN1; (-) strand; PAM type: NRG; PAM sequence: CAG
tttaggaagttctctgtagg

SEQ ID NO: 85614 - DNA, 20 bp, Artificial Sequence
  Description of Artificial Sequence: Synthetic oligonucleotide
  Target: ATXN1; (-) strand; PAM type: NRG; PAM sequence: AGG
aactttaggaagttctctgt

SEQ ID NO: 85615 - DNA, 20 bp, Artificial Sequence
  Description of Artificial Sequence: Synthetic oligonucleotide
  Target: ATXN1; (-) strand; PAM type: NRG; PAM sequence: TAG
gaactttaggaagttctctg

SEQ ID NO: 85616 - DNA, 20 bp, Artificial Sequence
  Description of Artificial Sequence: Synthetic oligonucleotide
  Target: ATXN1; (-) strand; PAM type: NRG; PAM sequence: AAG
aagttgcagtgaactttagg

SEQ ID NO: 85617 - DNA, 20 bp, Artificial Sequence
  Description of Artificial Sequence: Synthetic oligonucleotide
  Target: ATXN1; (-) strand; PAM type: NRG; PAM sequence: AGG
ataaagttgcagtgaacttt

SEQ ID NO: 85618 - DNA, 20 bp, Artificial Sequence
  Description of Artificial Sequence: Synthetic oligonucleotide
  Target: ATXN1; (-) strand; PAM type: NRG; PAM sequence: TAG
aataaagttgcagtgaactt

SEQ ID NO: 85619 - DNA, 20 bp, Artificial Sequence
  Description of Artificial Sequence: Synthetic oligonucleotide
  Target: ATXN1; (-) strand; PAM type: NRG; PAM sequence: CAG
aaatctaggtaataaagttg

SEQ ID NO: 85620 - DNA, 20 bp, Artificial Sequence
  Description of Artificial Sequence: Synthetic oligonucleotide
  Target: ATXN1; (-) strand; PAM type: NRG; PAM sequence: AAG
ttaatgaaatctaggtaata

SEQ ID NO: 85621 - DNA, 20 bp, Artificial Sequence
  Description of Artificial Sequence: Synthetic oligonucleotide
  Target: ATXN1; (-) strand; PAM type: NRG; PAM sequence: AGG
gatttttattaatgaaatct

SEQ ID NO: 85622 - DNA, 20 bp, Artificial Sequence
  Description of Artificial Sequence: Synthetic oligonucleotide
  Target: ATXN1; (-) strand; PAM type: NRG; PAM sequence: TAG
ggatttttattaatgaaatc

SEQ ID NO: 85623 - DNA, 20 bp, Artificial Sequence
  Description of Artificial Sequence: Synthetic oligonucleotide
  Target: ATXN1; (-) strand; PAM type: NRG; PAM sequence: AGG
tgctaaaccttctgattgaa

SEQ ID NO: 85624 - DNA, 20 bp, Artificial Sequence
  Description of Artificial Sequence: Synthetic oligonucleotide
  Target: ATXN1; (-) strand; PAM type: NRG; PAM sequence: AAG
gtgctaaaccttctgattga

SEQ ID NO: 85625 - DNA, 20 bp, Artificial Sequence
  Description of Artificial Sequence: Synthetic oligonucleotide
  Target: ATXN1; (-) strand; PAM type: NRG; PAM sequence: TGG
ctttcagtgaatgatctctt

SEQ ID NO: 85626 - DNA, 20 bp, Artificial Sequence
  Description of Artificial Sequence: Synthetic oligonucleotide
  Target: ATXN1; (-) strand; PAM type: NRG; PAM sequence: CAG
tgccatcagagccagccttt

SEQ ID NO: 85627 - DNA, 20 bp, Artificial Sequence
  Description of Artificial Sequence: Synthetic oligonucleotide
  Target: ATXN1; (-) strand; PAM type: NRG; PAM sequence: CAG
atctgttttgccatcagagc

SEQ ID NO: 85628 - DNA, 20 bp, Artificial Sequence
  Description of Artificial Sequence: Synthetic oligonucleotide
  Target: ATXN1; (-) strand; PAM type: NRG; PAM sequence: GAG
aaccatctgttttgccatca

SEQ ID NO: 85629 - DNA, 20 bp, Artificial Sequence
  Description of Artificial Sequence: Synthetic oligonucleotide
  Target: ATXN1; (-) strand; PAM type: NRG; PAM sequence: CAG
caaaccatctgttttgccat

SEQ ID NO: 85630 - DNA, 20 bp, Artificial Sequence
  Description of Artificial Sequence: Synthetic oligonucleotide
  Target: ATXN1; (-) strand; PAM type: NRG; PAM sequence: AGG
cagtacagtggccatttccc

SEQ ID NO: 85631 - DNA, 20 bp, Artificial Sequence
  Description of Artificial Sequence: Synthetic oligonucleotide
  Target: ATXN1; (-) strand; PAM type: NRG; PAM sequence: CAG
ccagtacagtggccatttcc

SEQ ID NO: 85632 - DNA, 20 bp, Artificial Sequence
  Description of Artificial Sequence: Synthetic oligonucleotide
  Target: ATXN1; (-) strand; PAM type: NRG; PAM sequence: TGG
gatttcttactccagtacag

SEQ ID NO: 85633 - DNA, 20 bp, Artificial Sequence
  Description of Artificial Sequence: Synthetic oligonucleotide
  Target: ATXN1; (-) strand; PAM type: NRG; PAM sequence: CAG
attgatttcttactccagta

SEQ ID NO: 85634 - DNA, 20 bp, Artificial Sequence
  Description of Artificial Sequence: Synthetic oligonucleotide
  Target: ATXN1; (-) strand; PAM type: NRG; PAM sequence: CAG
ggagcattgatttcttactc

SEQ ID NO: 85635 - DNA, 20 bp, Artificial Sequence
  Description of Artificial Sequence: Synthetic oligonucleotide
  Target: ATXN1; (-) strand; PAM type: NRG; PAM sequence: GAG
gaaatgatctgtttctctag

SEQ ID NO: 85636 - DNA, 20 bp, Artificial Sequence
  Description of Artificial Sequence: Synthetic oligonucleotide
  Target: ATXN1; (-) strand; PAM type: NRG; PAM sequence: AGG
aggaaatgatctgtttctct

SEQ ID NO: 85637 - DNA, 20 bp, Artificial Sequence
  Description of Artificial Sequence: Synthetic oligonucleotide
  Target: ATXN1; (-) strand; PAM type: NRG; PAM sequence: TAG
gaggaaatgatctgtttctc

SEQ ID NO: 85638 - DNA, 20 bp, Artificial Sequence
  Description of Artificial Sequence: Synthetic oligonucleotide
  Target: ATXN1; (-) strand; PAM type: NRG; PAM sequence: AGG
ttcttggcaaaaacttgctg

SEQ ID NO: 85639 - DNA, 20 bp, Artificial Sequence
  Description of Artificial Sequence: Synthetic oligonucleotide
  Target: ATXN1; (-) strand; PAM type: NRG; PAM sequence: GAG
gttcttggcaaaaacttgct

SEQ ID NO: 85640 - DNA, 20 bp, Artificial Sequence
  Description of Artificial Sequence: Synthetic oligonucleotide
  Target: ATXN1; (-) strand; PAM type: NRG; PAM sequence: TGG
gtttgtttaagtcatgttct

SEQ ID NO: 85641 - DNA, 20 bp, Artificial Sequence
  Description of Artificial Sequence: Synthetic oligonucleotide
  Target: ATXN1; (-) strand; PAM type: NRG; PAM sequence: AAG
atcttttcacatgtttgttt

SEQ ID NO: 85642 - DNA, 20 bp, Artificial Sequence
  Description of Artificial Sequence: Synthetic oligonucleotide
  Target: ATXN1; (-) strand; PAM type: NRG; PAM sequence: AGG
aattcagaactacacaaaac

SEQ ID NO: 85643 - DNA, 20 bp, Artificial Sequence
  Description of Artificial Sequence: Synthetic oligonucleotide
  Target: ATXN1; (-) strand; PAM type: NRG; PAM sequence: CAG
gaattcagaactacacaaaa

SEQ ID NO: 85644 - DNA, 20 bp, Artificial Sequence
  Description of Artificial Sequence: Synthetic oligonucleotide
  Target: ATXN1; (-) strand; PAM type: NRG; PAM sequence: CAG
ttgaaagtctgagcagaatt

SEQ ID NO: 85645 - DNA, 20 bp, Artificial Sequence
  Description of Artificial Sequence: Synthetic oligonucleotide
  Target: ATXN1; (-) strand; PAM type: NRG; PAM sequence: CAG
tttgaaattgaaagtctgag

SEQ ID NO: 85646 - DNA, 20 bp, Artificial Sequence
  Description of Artificial Sequence: Synthetic oligonucleotide
  Target: ATXN1; (-) strand; PAM type: NRG; PAM sequence: GAG
tattttgaaattgaaagtct

SEQ ID NO: 85647 - DNA, 20 bp, Artificial Sequence
  Description of Artificial Sequence: Synthetic oligonucleotide
  Target: ATXN1; (-) strand; PAM type: NRG; PAM sequence: AAG
ctttgttattttgaaattga

SEQ ID NO: 85648 - DNA, 20 bp, Artificial Sequence
  Description of Artificial Sequence: Synthetic oligonucleotide
  Target: ATXN1; (-) strand; PAM type: NRG; PAM sequence: CAG
aagaatgggggctatgtttc

SEQ ID NO: 85649 - DNA, 20 bp, Artificial Sequence
  Description of Artificial Sequence: Synthetic oligonucleotide
  Target: ATXN1; (-) strand; PAM type: NRG; PAM sequence: GGG
taagatttcagaaagaatgg

SEQ ID NO: 85650 - DNA, 20 bp, Artificial Sequence
  Description of Artificial Sequence: Synthetic oligonucleotide
  Target: ATXN1; (-) strand; PAM type: NRG; PAM sequence: GGG
ttaagatttcagaaagaatg

SEQ ID NO: 85651 - DNA, 20 bp, Artificial Sequence
  Description of Artificial Sequence: Synthetic oligonucleotide
  Target: ATXN1; (-) strand; PAM type: NRG; PAM sequence: GGG
tttaagatttcagaaagaat

SEQ ID NO: 85652 - DNA, 20 bp, Artificial Sequence
  Description of Artificial Sequence: Synthetic oligonucleotide
  Target: ATXN1; (-) strand; PAM type: NRG; PAM sequence: TGG
gtttaagatttcagaaagaa

SEQ ID NO: 85653 - DNA, 20 bp, Artificial Sequence
  Description of Artificial Sequence: Synthetic oligonucleotide
  Target: ATXN1; (-) strand; PAM type: NRG; PAM sequence: AAG
agtctgtttaagatttcaga

SEQ ID NO: 85654 - DNA, 20 bp, Artificial Sequence
  Description of Artificial Sequence: Synthetic oligonucleotide
  Target: ATXN1; (-) strand; PAM type: NRG; PAM sequence: CAG
ctgcagtctgtttaagattt

SEQ ID NO: 85655 - DNA, 20 bp, Artificial Sequence
  Description of Artificial Sequence: Synthetic oligonucleotide
  Target: ATXN1; (-) strand; PAM type: NRG; PAM sequence: AAG
ttggaagctgcagtctgttt

SEQ ID NO: 85656 - DNA, 20 bp, Artificial Sequence
  Description of Artificial Sequence: Synthetic oligonucleotide
  Target: ATXN1; (-) strand; PAM type: NRG; PAM sequence: CAG
acatccaaccttggaagctg

SEQ ID NO: 85657 - DNA, 20 bp, Artificial Sequence
  Description of Artificial Sequence: Synthetic oligonucleotide
  Target: ATXN1; (-) strand; PAM type: NRG; PAM sequence: AAG
aatttcacatccaaccttgg

SEQ ID NO: 85658 - DNA, 20 bp, Artificial Sequence
  Description of Artificial Sequence: Synthetic oligonucleotide
  Target: ATXN1; (-) strand; PAM type: NRG; PAM sequence: TGG
ctgaatttcacatccaacct

SEQ ID NO: 85659 - DNA, 20 bp, Artificial Sequence
  Description of Artificial Sequence: Synthetic oligonucleotide
  Target: ATXN1; (-) strand; PAM type: NRG; PAM sequence: GAG
gctgcagctttctaccaaaa

SEQ ID NO: 85660 - DNA, 20 bp, Artificial Sequence
  Description of Artificial Sequence: Synthetic oligonucleotide
  Target: ATXN1; (-) strand; PAM type: NRG; PAM sequence: AAG
gggctgcagctttctaccaa

SEQ ID NO: 85661 - DNA, 20 bp, Artificial Sequence
  Description of Artificial Sequence: Synthetic oligonucleotide
  Target: ATXN1; (-) strand; PAM type: NRG; PAM sequence: CAG
cagagagctctgctgggctg

SEQ ID NO: 85662 - DNA, 20 bp, Artificial Sequence
  Description of Artificial Sequence: Synthetic oligonucleotide
  Target: ATXN1; (-) strand; PAM type: NRG; PAM sequence: GGG
agacttcagagagctctgct

SEQ ID NO: 85663 - DNA, 20 bp, Artificial Sequence
  Description of Artificial Sequence: Synthetic oligonucleotide
  Target: ATXN1; (-) strand; PAM type: NRG; PAM sequence: TGG
tagacttcagagagctctgc

SEQ ID NO: 85664 - DNA, 20 bp, Artificial Sequence
  Description of Artificial Sequence: Synthetic oligonucleotide
  Target: ATXN1; (-) strand; PAM type: NRG; PAM sequence: GAG
acctccccctagacttcaga

SEQ ID NO: 85665 - DNA, 20 bp, Artificial Sequence
  Description of Artificial Sequence: Synthetic oligonucleotide
  Target: ATXN1; (-) strand; PAM type: NRG; PAM sequence: GAG
ccacctccccctagacttca

SEQ ID NO: 85666 - DNA, 20 bp, Artificial Sequence
  Description of Artificial Sequence: Synthetic oligonucleotide
  Target: ATXN1; (-) strand; PAM type: NRG; PAM sequence: CAG
acccacctccccctagactt

SEQ ID NO: 85667 - DNA, 20 bp, Artificial Sequence
  Description of Artificial Sequence: Synthetic oligonucleotide
  Target: ATXN1; (-) strand; PAM type: NRG; PAM sequence: TAG
cacagacacccacctccccc

SEQ ID NO: 85668 - DNA, 20 bp, Artificial Sequence
  Description of Artificial Sequence: Synthetic oligonucleotide
  Target: ATXN1; (-) strand; PAM type: NRG; PAM sequence: CAG
aaagtcaccaatctacaaca

SEQ ID NO: 85669 - DNA, 20 bp, Artificial Sequence
  Description of Artificial Sequence: Synthetic oligonucleotide
  Target: ATXN1; (-) strand; PAM type: NRG; PAM sequence: AAG
tcctggaagcacattctata

SEQ ID NO: 85670 - DNA, 20 bp, Artificial Sequence
  Description of Artificial Sequence: Synthetic oligonucleotide
  Target: ATXN1; (-) strand; PAM type: NRG; PAM sequence: AAG
gtgtatgctcacattcctgg

SEQ ID NO: 85671 - DNA, 20 bp, Artificial Sequence
  Description of Artificial Sequence: Synthetic oligonucleotide
  Target: ATXN1; (-) strand; PAM type: NRG; PAM sequence: TGG
ggtgtgtatgctcacattcc

SEQ ID NO: 85672 - DNA, 20 bp, Artificial Sequence
  Description of Artificial Sequence: Synthetic oligonucleotide
  Target: ATXN1; (-) strand; PAM type: NRG; PAM sequence: GGG
tggttactttcagttgccag

SEQ ID NO: 85673 - DNA, 20 bp, Artificial Sequence
  Description of Artificial Sequence: Synthetic oligonucleotide
  Target: ATXN1; (-) strand; PAM type: NRG; PAM sequence: GGG
ttggttactttcagttgcca

SEQ ID NO: 85674 - DNA, 20 bp, Artificial Sequence
  Description of Artificial Sequence: Synthetic oligonucleotide
  Target: ATXN1; (-) strand; PAM type: NRG; PAM sequence: AGG
attggttactttcagttgcc

SEQ ID NO: 85675 - DNA, 20 bp, Artificial Sequence
  Description of Artificial Sequence: Synthetic oligonucleotide
  Target: ATXN1; (-) strand; PAM type: NRG; PAM sequence: CAG
cattggttactttcagttgc

SEQ ID NO: 85676 - DNA, 20 bp, Artificial Sequence
  Description of Artificial Sequence: Synthetic oligonucleotide
  Target: ATXN1; (-) strand; PAM type: NRG; PAM sequence: CAG
aaaaagccattggttacttt

SEQ ID NO: 85677 - DNA, 20 bp, Artificial Sequence
  Description of Artificial Sequence: Synthetic oligonucleotide
  Target: ATXN1; (-) strand; PAM type: NRG; PAM sequence: TGG
tggatctgttaaaaagccat

SEQ ID NO: 85678 - DNA, 20 bp, Artificial Sequence
  Description of Artificial Sequence: Synthetic oligonucleotide
  Target: ATXN1; (-) strand; PAM type: NRG; PAM sequence: AAG
aataaagtggatctgttaaa

SEQ ID NO: 85679 - DNA, 20 bp, Artificial Sequence
  Description of Artificial Sequence: Synthetic oligonucleotide
  Target: ATXN1; (-) strand; PAM type: NRG; PAM sequence: TGG
ctccaaacgttgaaataaag

SEQ ID NO: 85680 - DNA, 20 bp, Artificial Sequence
  Description of Artificial Sequence: Synthetic oligonucleotide
  Target: ATXN1; (-) strand; PAM type: NRG; PAM sequence: AAG
aatctccaaacgttgaaata

SEQ ID NO: 85681 - DNA, 20 bp, Artificial Sequence
  Description of Artificial Sequence: Synthetic oligonucleotide
  Target: ATXN1; (-) strand; PAM type: NRG; PAM sequence: GGG
atacggcagtatttgattgc

SEQ ID NO: 85682 - DNA, 20 bp, Artificial Sequence
  Description of Artificial Sequence: Synthetic oligonucleotide
  Target: ATXN1; (-) strand; PAM type: NRG; PAM sequence: CGG
catacggcagtatttgattg

SEQ ID NO: 85683 - DNA, 20 bp, Artificial Sequence
  Description of Artificial Sequence: Synthetic oligonucleotide
  Target: ATXN1; (-) strand; PAM type: NRG; PAM sequence: CAG
cttagcacggactcatacgg

SEQ ID NO: 85684 - DNA, 20 bp, Artificial Sequence
  Description of Artificial Sequence: Synthetic oligonucleotide
  Target: ATXN1; (-) strand; PAM type: NRG; PAM sequence: CGG
agtcttagcacggactcata

SEQ ID NO: 85685 - DNA, 20 bp, Artificial Sequence
  Description of Artificial Sequence: Synthetic oligonucleotide
  Target: ATXN1; (-) strand; PAM type: NRG; PAM sequence: CGG
gaaatgatgaagtcttagca

SEQ ID NO: 85686 - DNA, 20 bp, Artificial Sequence
  Description of Artificial Sequence: Synthetic oligonucleotide
  Target: ATXN1; (-) strand; PAM type: NRG; PAM sequence: TAG
aatgtgaaatgatgaagtct

SEQ ID NO: 85687 - DNA, 20 bp, Artificial Sequence
  Description of Artificial Sequence: Synthetic oligonucleotide
  Target: ATXN1; (-) strand; PAM type: NRG; PAM sequence: AAG
acagaaaatgtgaaatgatg

SEQ ID NO: 85688 - DNA, 20 bp, Artificial Sequence
  Description of Artificial Sequence: Synthetic oligonucleotide
  Target: ATXN1; (-) strand; PAM type: NRG; PAM sequence: CAG
aattgaagaaaggcttttga

SEQ ID NO: 85689 - DNA, 20 bp, Artificial Sequence
  Description of Artificial Sequence: Synthetic oligonucleotide
  Target: ATXN1; (-) strand; PAM type: NRG; PAM sequence: AGG
actatggtgcaattgaagaa

SEQ ID NO: 85690 - DNA, 20 bp, Artificial Sequence
  Description of Artificial Sequence: Synthetic oligonucleotide
  Target: ATXN1; (-) strand; PAM type: NRG; PAM sequence: AAG
gactatggtgcaattgaaga

SEQ ID NO: 85691 - DNA, 20 bp, Artificial Sequence
  Description of Artificial Sequence: Synthetic oligonucleotide
  Target: ATXN1; (-) strand; PAM type: NRG; PAM sequence: AAG
atgggactatggtgcaattg

SEQ ID NO: 85692 - DNA, 20 bp, Artificial Sequence
  Description of Artificial Sequence: Synthetic oligonucleotide
  Target: ATXN1; (-) strand; PAM type: NRG; PAM sequence: TGG
tttcagattttatgggacta

SEQ ID NO: 85693 - DNA, 20 bp, Artificial Sequence
  Description of Artificial Sequence: Synthetic oligonucleotide
  Target: ATXN1; (-) strand; PAM type: NRG; PAM sequence: GGG
gtgatattttcagattttat

SEQ ID NO: 85694 - DNA, 20 bp, Artificial Sequence
  Description of Artificial Sequence: Synthetic oligonucleotide
  Target: ATXN1; (-) strand; PAM type: NRG; PAM sequence: TGG
tgtgatattttcagatttta

SEQ ID NO: 85695 - DNA, 20 bp, Artificial Sequence
  Description of Artificial Sequence: Synthetic oligonucleotide
  Target: ATXN1; (-) strand; PAM type: NRG; PAM sequence: CAG
cctcagtcatgtgatatttt

SEQ ID NO: 85696 - DNA, 20 bp, Artificial Sequence
  Description of Artificial Sequence: Synthetic oligonucleotide
  Target: ATXN1; (-) strand; PAM type: NRG; PAM sequence: CAG
gaccttggctcttagatcct

SEQ ID NO: 85697 - DNA, 20 bp, Artificial Sequence
  Description of Artificial Sequence: Synthetic oligonucleotide
  Target: ATXN1; (-) strand; PAM type: NRG; PAM sequence: TAG
tgattcaggaccttggctct

SEQ ID NO: 85698 - DNA, 20 bp, Artificial Sequence
  Description of Artificial Sequence: Synthetic oligonucleotide
  Target: ATXN1; (-) strand; PAM type: NRG; PAM sequence: TGG
tgttgtgtgattcaggacct

SEQ ID NO: 85699 - DNA, 20 bp, Artificial Sequence
  Description of Artificial Sequence: Synthetic oligonucleotide
  Target: ATXN1; (-) strand; PAM type: NRG; PAM sequence: AGG
atgagtatgttgtgtgattc

SEQ ID NO: 85700 - DNA, 20 bp, Artificial Sequence
  Description of Artificial Sequence: Synthetic oligonucleotide
  Target: ATXN1; (-) strand; PAM type: NRG; PAM sequence: CAG
aatgagtatgttgtgtgatt

SEQ ID NO: 85701 - DNA, 20 bp, Artificial Sequence
  Description of Artificial Sequence: Synthetic oligonucleotide
  Target: ATXN1; (-) strand; PAM type: NRG; PAM sequence: GAG
aagggagaagattccctaat

SEQ ID NO: 85702 - DNA, 20 bp, Artificial Sequence
  Description of Artificial Sequence: Synthetic oligonucleotide
  Target: ATXN1; (-) strand; PAM type: NRG; PAM sequence: AAG
tctgaaagggggaaagggag

SEQ ID NO: 85703 - DNA, 20 bp, Artificial Sequence
  Description of Artificial Sequence: Synthetic oligonucleotide
  Target: ATXN1; (-) strand; PAM type: NRG; PAM sequence: GAG
atatctgaaagggggaaagg

SEQ ID NO: 85704 - DNA, 20 bp, Artificial Sequence
  Description of Artificial Sequence: Synthetic oligonucleotide
  Target: ATXN1; (-) strand; PAM type: NRG; PAM sequence: GGG
aaatatctgaaagggggaaa

SEQ ID NO: 85705 - DNA, 20 bp, Artificial Sequence
  Description of Artificial Sequence: Synthetic oligonucleotide
  Target: ATXN1; (-) strand; PAM type: NRG; PAM sequence: AGG
aaaatatctgaaagggggaa

SEQ ID NO: 85706 - DNA, 20 bp, Artificial Sequence
  Description of Artificial Sequence: Synthetic oligonucleotide
  Target: ATXN1; (-) strand; PAM type: NRG; PAM sequence: AAG
taaaatatctgaaaggggga

SEQ ID NO: 85707 - DNA, 20 bp, Artificial Sequence
  Description of Artificial Sequence: Synthetic oligonucleotide
  Target: ATXN1; (-) strand; PAM type: NRG; PAM sequence: GGG
attttaaaatatctgaaagg

SEQ ID NO: 85708 - DNA, 20 bp, Artificial Sequence
  Description of Artificial Sequence: Synthetic oligonucleotide
  Target: ATXN1; (-) strand; PAM type: NRG; PAM sequence: GGG
aattttaaaatatctgaaag

SEQ ID NO: 85709 - DNA, 20 bp, Artificial Sequence
  Description of Artificial Sequence: Synthetic oligonucleotide
  Target: ATXN1; (-) strand; PAM type: NRG; PAM sequence: GGG
taattttaaaatatctgaaa

SEQ ID NO: 85710 - DNA, 20 bp, Artificial Sequence
  Description of Artificial Sequence: Synthetic oligonucleotide
  Target: ATXN1; (-) strand; PAM type: NRG; PAM sequence: AGG
ttaattttaaaatatctgaa

SEQ ID NO: 85711 - DNA, 20 bp, Artificial Sequence
  Description of Artificial Sequence: Synthetic oligonucleotide
  Target: ATXN1; (-) strand; PAM type: NRG; PAM sequence: AAG
tttaattttaaaatatctga

SEQ ID NO: 85712 - DNA, 20 bp, Artificial Sequence
  Description of Artificial Sequence: Synthetic oligonucleotide
  Target: ATXN1; (-) strand; PAM type: NRG; PAM sequence: AGG
gccataagttgactgccatc

SEQ ID NO: 85713 - DNA, 20 bp, Artificial Sequence
  Description of Artificial Sequence: Synthetic oligonucleotide
  Target: ATXN1; (-) strand; PAM type: NRG; PAM sequence: CAG
tgccataagttgactgccat

SEQ ID NO: 85714 - DNA, 20 bp, Artificial Sequence
  Description of Artificial Sequence: Synthetic oligonucleotide
  Target: ATXN1; (-) strand; PAM type: NRG; PAM sequence: AAG
ttcgccttcatgtgtgccat

SEQ ID NO: 85715 - DNA, 20 bp, Artificial Sequence
  Description of Artificial Sequence: Synthetic oligonucleotide
  Target: ATXN1; (-) strand; PAM type: NRG; PAM sequence: AGG
ctccaattttaaatatatgt

SEQ ID NO: 85716 - DNA, 20 bp, Artificial Sequence
  Description of Artificial Sequence: Synthetic oligonucleotide
  Target: ATXN1; (-) strand; PAM type: NRG; PAM sequence: TAG
cctccaattttaaatatatg

SEQ ID NO: 85717 - DNA, 20 bp, Artificial Sequence
  Description of Artificial Sequence: Synthetic oligonucleotide
  Target: ATXN1; (-) strand; PAM type: NRG; PAM sequence: TGG
caggcgtgagccaccgcacc

SEQ ID NO: 85718 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 85719 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 85720 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 85721 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 85722 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaagtgc

SEQ ID NO: 85723 - DNA, 20 bp, Artificial Sequence
  Description of Artificial Sequence: Synthetic oligonucleotide
  Target: ATXN1; (-) strand; PAM type: NRG; PAM sequence: AAG
ccgccagcctcagcctccca

SEQ ID NO: 85724 - DNA, 20 bp, Artificial Sequence
  Description of Artificial Sequence: Synthetic oligonucleotide
  Target: ATXN1; (-) strand; PAM type: NRG; PAM sequence: CAG
ctcaaatgatccgccagcct

SEQ ID NO: 85725 - DNA, 20 bp, Artificial Sequence
  Description of Artificial Sequence: Synthetic oligonucleotide
  Target: ATXN1; (-) strand; PAM type: NRG; PAM sequence: CAG
cctgacctcaaatgatccgc

SEQ ID NO: 85726 - DNA, 20 bp, Artificial Sequence
  Description of Artificial Sequence: Synthetic oligonucleotide
  Target: ATXN1; (-) strand; PAM type: NRG; PAM sequence: TGG
cttcaccatgtcagtcagac

SEQ ID NO: 85727 - DNA, 20 bp, Artificial Sequence
  Description of Artificial Sequence: Synthetic oligonucleotide
  Target: ATXN1; (-) strand; PAM type: NRG; PAM sequence: CAG
tggggcttcaccatgtcagt

SEQ ID NO: 85728 - DNA, 20 bp, Artificial Sequence
  Description of Artificial Sequence: Synthetic oligonucleotide
  Target: ATXN1; (-) strand; PAM type: NRG; PAM sequence: CAG
gagatggggcttcaccatgt

SEQ ID NO: 85729 - DNA, 20 bp, Artificial Sequence
  Description of Artificial Sequence: Synthetic oligonucleotide
  Target: ATXN1; (-) strand; PAM type: NRG; PAM sequence: GGG
tattttttttagtagagatg

SEQ ID NO: 85730 - DNA, 20 bp, Artificial Sequence
  Description of Artificial Sequence: Synthetic oligonucleotide
  Target: ATXN1; (-) strand; PAM type: NRG; PAM sequence: GGG
atattttttttagtagagat

SEQ ID NO: 85731 - DNA, 20 bp, Artificial Sequence
  Description of Artificial Sequence: Synthetic oligonucleotide
  Target: ATXN1; (-) strand; PAM type: NRG; PAM sequence: TGG
tatattttttttagtagaga

SEQ ID NO: 85732 - DNA, 20 bp, Artificial Sequence
  Description of Artificial Sequence: Synthetic oligonucleotide
  Target: ATXN1; (-) strand; PAM type: NRG; PAM sequence: GAG
tttatatattttttttagta

SEQ ID NO: 85733 - DNA, 20 bp, Artificial Sequence
  Description of Artificial Sequence: Synthetic oligonucleotide
  Target: ATXN1; (-) strand; PAM type: NRG; PAM sequence: TAG
tttttatatattttttttag

SEQ ID NO: 85734 - DNA, 20 bp, Artificial Sequence
  Description of Artificial Sequence: Synthetic oligonucleotide
  Target: ATXN1; (-) strand; PAM type: NRG; PAM sequence: TAG
ttttttttatatattttttt

SEQ ID NO: 85735 - DNA, 20 bp, Artificial Sequence
  Description of Artificial Sequence: Synthetic oligonucleotide
  Target: ATXN1; (-) strand; PAM type: NRG; PAM sequence: TGG
caggtatgcaccacaatgcc

SEQ ID NO: 85736 - DNA, 20 bp, Artificial Sequence
  Description of Artificial Sequence: Synthetic oligonucleotide
  Target: ATXN1; (-) strand; PAM type: NRG; PAM sequence: AGG
tcccgagtcgctgggactac

SEQ ID NO: 85737 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtcgctgggacta

SEQ ID NO: 85738 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtcgct

SEQ ID NO: 85739 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtcgc

SEQ ID NO: 85740 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 85741 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 85742 - DNA, 20 bp, Artificial Sequence
  Description of Artificial Sequence: Synthetic oligonucleotide
  Target: ATXN1; (-) strand; PAM type: NRG; PAM sequence: AAG
agcctccacctcccaggttc

SEQ ID NO: 85743 - DNA, 20 bp, Artificial Sequence
  Description of Artificial Sequence: Synthetic oligonucleotide
  Target: ATXN1; (-) strand; PAM type: NRG; PAM sequence: AGG
cactgcagcctccacctccc

SEQ ID NO: 85744 - DNA, 20 bp, Artificial Sequence
  Description of Artificial Sequence: Synthetic oligonucleotide
  Target: ATXN1; (-) strand; PAM type: NRG; PAM sequence: CAG
tcactgcagcctccacctcc

SEQ ID NO: 85745 - DNA, 20 bp, Artificial Sequence
  Description of Artificial Sequence: Synthetic oligonucleotide
  Target: ATXN1; (-) strand; PAM type: NRG; PAM sequence: CAG
ggtgcaatcttggctcactg

SEQ ID NO: 85746 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggtgcaatct

SEQ ID NO: 85747 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 85748 - DNA, 20 bp, Artificial Sequence
  Description of Artificial Sequence: Synthetic oligonucleotide
  Target: ATXN1; (-) strand; PAM type: NRG; PAM sequence: CAG
ccgtcacccaggctggagtg

SEQ ID NO: 85749 - DNA, 20 bp, Artificial Sequence
  Description of Artificial Sequence: Synthetic oligonucleotide
  Target: ATXN1; (-) strand; PAM type: NRG; PAM sequence: GAG
tcactccgtcacccaggctg

SEQ ID NO: 85750 - DNA, 20 bp, Artificial Sequence
  Description of Artificial Sequence: Synthetic oligonucleotide
  Target: ATXN1; (-) strand; PAM type: NRG; PAM sequence: TGG
tctcactccgtcacccaggc

SEQ ID NO: 85751 - DNA, 20 bp, Artificial Sequence
  Description of Artificial Sequence: Synthetic oligonucleotide
  Target: ATXN1; (-) strand; PAM type: NRG; PAM sequence: AGG
agagtctcactccgtcaccc

SEQ ID NO: 85752 - DNA, 20 bp, Artificial Sequence
  Description of Artificial Sequence: Synthetic oligonucleotide
  Target: ATXN1; (-) strand; PAM type: NRG; PAM sequence: CAG
aagagtctcactccgtcacc

SEQ ID NO: 85753 - DNA, 20 bp, Artificial Sequence
  Description of Artificial Sequence: Synthetic oligonucleotide
  Target: ATXN1; (-) strand; PAM type: NRG; PAM sequence: GAG
tttatttattttttgagaaa

SEQ ID NO: 85754 - DNA, 20 bp, Artificial Sequence
  Description of Artificial Sequence: Synthetic oligonucleotide
  Target: ATXN1; (-) strand; PAM type: NRG; PAM sequence: AAG
tatttatttattttttgaga

SEQ ID NO: 85755 - DNA, 20 bp, Artificial Sequence
  Description of Artificial Sequence: Synthetic oligonucleotide
  Target: ATXN1; (-) strand; PAM type: NRG; PAM sequence: GAG
tatttatttatttatttttt

SEQ ID NO: 85756 - DNA, 20 bp, Artificial Sequence
  Description of Artificial Sequence: Synthetic oligonucleotide
  Target: ATXN1; (-) strand; PAM type: NRG; PAM sequence: CAG
cctgtccgcttctcctttgg

SEQ ID NO: 85757 - DNA, 20 bp, Artificial Sequence
  Description of Artificial Sequence: Synthetic oligonucleotide
  Target: ATXN1; (-) strand; PAM type: NRG; PAM sequence: TGG
aaccctgtccgcttctcctt

SEQ ID NO: 85758 - DNA, 20 bp, Artificial Sequence
  Description of Artificial Sequence: Synthetic oligonucleotide
  Target: ATXN1; (-) strand; PAM type: NRG; PAM sequence: GAG
tgcagcatttttctatattg

SEQ ID NO: 85759 - DNA, 20 bp, Artificial Sequence
  Description of Artificial Sequence: Synthetic oligonucleotide
  Target: ATXN1; (-) strand; PAM type: NRG; PAM sequence: TGG
aatgcagcatttttctatat

SEQ ID NO: 85760 - DNA, 20 bp, Artificial Sequence
  Description of Artificial Sequence: Synthetic oligonucleotide
  Target: ATXN1; (-) strand; PAM type: NRG; PAM sequence: CAG
taatgcagcatttgggaatg

SEQ ID NO: 85761 - DNA, 20 bp, Artificial Sequence
  Description of Artificial Sequence: Synthetic oligonucleotide
  Target: ATXN1; (-) strand; PAM type: NRG; PAM sequence: GGG
tcattcataatgcagcattt

SEQ ID NO: 85762 - DNA, 20 bp, Artificial Sequence
  Description of Artificial Sequence: Synthetic oligonucleotide
  Target: ATXN1; (-) strand; PAM type: NRG; PAM sequence: TGG
ttcattcataatgcagcatt

SEQ ID NO: 85763 - DNA, 20 bp, Artificial Sequence
  Description of Artificial Sequence: Synthetic oligonucleotide
  Target: ATXN1; (-) strand; PAM type: NRG; PAM sequence: CAG
tgatgttttcattcataatg

SEQ ID NO: 85764 - DNA, 20 bp, Artificial Sequence
  Description of Artificial Sequence: Synthetic oligonucleotide
  Target: ATXN1; (-) strand; PAM type: NRG; PAM sequence: TGG
gattagagacacaggcttca

SEQ ID NO: 85765 - DNA, 20 bp, Artificial Sequence
  Description of Artificial Sequence: Synthetic oligonucleotide
  Target: ATXN1; (-) strand; PAM type: NRG; PAM sequence: AGG
ggtagccagattagagacac

SEQ ID NO: 85766 - DNA, 20 bp, Artificial Sequence
  Description of Artificial Sequence: Synthetic oligonucleotide
  Target: ATXN1; (-) strand; PAM type: NRG; PAM sequence: CAG
gggtagccagattagagaca

SEQ ID NO: 85767 - DNA, 20 bp, Artificial Sequence
  Description of Artificial Sequence: Synthetic oligonucleotide
  Target: ATXN1; (-) strand; PAM type: NRG; PAM sequence: GAG
ttatttgggtagccagatta

SEQ ID NO: 85768 - DNA, 20 bp, Artificial Sequence
  Description of Artificial Sequence: Synthetic oligonucleotide
  Target: ATXN1; (-) strand; PAM type: NRG; PAM sequence: TAG
ccttatttgggtagccagat

SEQ ID NO: 85769 - DNA, 20 bp, Artificial Sequence
  Description of Artificial Sequence: Synthetic oligonucleotide
  Target: ATXN1; (-) strand; PAM type: NRG; PAM sequence: CAG
agtagccttatttgggtagc

SEQ ID NO: 85770 - DNA, 20 bp, Artificial Sequence
  Description of Artificial Sequence: Synthetic oligonucleotide
  Target: ATXN1; (-) strand; PAM type: NRG; PAM sequence: TAG
cattagtagccttatttggg

SEQ ID NO: 85771 - DNA, 20 bp, Artificial Sequence
  Description of Artificial Sequence: Synthetic oligonucleotide
  Target: ATXN1; (-) strand; PAM type: NRG; PAM sequence: GGG
gagcattagtagccttattt

SEQ ID NO: 85772 - DNA, 20 bp, Artificial Sequence
  Description of Artificial Sequence: Synthetic oligonucleotide
  Target: ATXN1; (-) strand; PAM type: NRG; PAM sequence: TGG
tgagcattagtagccttatt

SEQ ID NO: 85773 - DNA, 20 bp, Artificial Sequence
  Description of Artificial Sequence: Synthetic oligonucleotide
  Target: ATXN1; (-) strand; PAM type: NRG; PAM sequence: TAG
accctgttgatgagcattag

SEQ ID NO: 85774 - DNA, 20 bp, Artificial Sequence
  Description of Artificial Sequence: Synthetic oligonucleotide
  Target: ATXN1; (-) strand; PAM type: NRG; PAM sequence: TAG
actaccctgttgatgagcat

SEQ ID NO: 85775 - DNA, 20 bp, Artificial Sequence
  Description of Artificial Sequence: Synthetic oligonucleotide
  Target: ATXN1; (-) strand; PAM type: NRG; PAM sequence: GAG
tgtaatactaccctgttgat

SEQ ID NO: 85776 - DNA, 20 bp, Artificial Sequence
  Description of Artificial Sequence: Synthetic oligonucleotide
  Target: ATXN1; (-) strand; PAM type: NRG; PAM sequence: CAG
aattatcttttagaaatctt

SEQ ID NO: 85777 - DNA, 20 bp, Artificial Sequence
  Description of Artificial Sequence: Synthetic oligonucleotide
  Target: ATXN1; (-) strand; PAM type: NRG; PAM sequence: TAG
taagttagtgaattatcttt

SEQ ID NO: 85778 - DNA, 20 bp, Artificial Sequence
  Description of Artificial Sequence: Synthetic oligonucleotide
  Target: ATXN1; (-) strand; PAM type: NRG; PAM sequence: TAG
gtaaaagggtgaatgtaagt

SEQ ID NO: 85779 - DNA, 20 bp, Artificial Sequence
  Description of Artificial Sequence: Synthetic oligonucleotide
  Target: ATXN1; (-) strand; PAM type: NRG; PAM sequence: AAG
ccatgtaaaagggtgaatgt

SEQ ID NO: 85780 - DNA, 20 bp, Artificial Sequence
  Description of Artificial Sequence: Synthetic oligonucleotide
  Target: ATXN1; (-) strand; PAM type: NRG; PAM sequence: GGG
tcttgactagccatgtaaaa

SEQ ID NO: 85781 - DNA, 20 bp, Artificial Sequence
  Description of Artificial Sequence: Synthetic oligonucleotide
  Target: ATXN1; (-) strand; PAM type: NRG; PAM sequence: AGG
ttcttgactagccatgtaaa

SEQ ID NO: 85782 - DNA, 20 bp, Artificial Sequence
  Description of Artificial Sequence: Synthetic oligonucleotide
  Target: ATXN1; (-) strand; PAM type: NRG; PAM sequence: AAG
cttcttgactagccatgtaa

SEQ ID NO: 85783 - DNA, 20 bp, Artificial Sequence
  Description of Artificial Sequence: Synthetic oligonucleotide
  Target: ATXN1; (-) strand; PAM type: NRG; PAM sequence: TAG
attcttttgctcttcttgac

SEQ ID NO: 85784 - DNA, 20 bp, Artificial Sequence
  Description of Artificial Sequence: Synthetic oligonucleotide
  Target: ATXN1; (-) strand; PAM type: NRG; PAM sequence: GAG
ctgagtctcagtccatgtaa

SEQ ID NO: 85785 - DNA, 20 bp, Artificial Sequence
  Description of Artificial Sequence: Synthetic oligonucleotide
  Target: ATXN1; (-) strand; PAM type: NRG; PAM sequence: AAG
acctgagtctcagtccatgt

SEQ ID NO: 85786 - DNA, 20 bp, Artificial Sequence
  Description of Artificial Sequence: Synthetic oligonucleotide
  Target: ATXN1; (-) strand; PAM type: NRG; PAM sequence: CAG
gggtcttaaaacctgagtct

SEQ ID NO: 85787 - DNA, 20 bp, Artificial Sequence
  Description of Artificial Sequence: Synthetic oligonucleotide
  Target: ATXN1; (-) strand; PAM type: NRG; PAM sequence: GAG
ctggcagggtcttaaaacct

SEQ ID NO: 85788 - DNA, 20 bp, Artificial Sequence
  Description of Artificial Sequence: Synthetic oligonucleotide
  Target: ATXN1; (-) strand; PAM type: NRG; PAM sequence: GGG
agaggttattaaatctggca

SEQ ID NO: 85789 - DNA, 20 bp, Artificial Sequence
  Description of Artificial Sequence: Synthetic oligonucleotide
  Target: ATXN1; (-) strand; PAM type: NRG; PAM sequence: AGG
tagaggttattaaatctggc

SEQ ID NO: 85790 - DNA, 20 bp, Artificial Sequence
  Description of Artificial Sequence: Synthetic oligonucleotide
  Target: ATXN1; (-) strand; PAM type: NRG; PAM sequence: CAG
ttagaggttattaaatctgg

SEQ ID NO: 85791 - DNA, 20 bp, Artificial Sequence
  Description of Artificial Sequence: Synthetic oligonucleotide
  Target: ATXN1; (-) strand; PAM type: NRG; PAM sequence: TGG
aagttagaggttattaaatc

SEQ ID NO: 85792 - DNA, 20 bp, Artificial Sequence
  Description of Artificial Sequence: Synthetic oligonucleotide
  Target: ATXN1; (-) strand; PAM type: NRG; PAM sequence: AGG
ctttcaaggtaaaaagttag

SEQ ID NO: 85793 - DNA, 20 bp, Artificial Sequence
  Description of Artificial Sequence: Synthetic oligonucleotide
  Target: ATXN1; (-) strand; PAM type: NRG; PAM sequence: GAG
actttcaaggtaaaaagtta

SEQ ID NO: 85794 - DNA, 20 bp, Artificial Sequence
  Description of Artificial Sequence: Synthetic oligonucleotide
  Target: ATXN1; (-) strand; PAM type: NRG; PAM sequence: TAG
taactttcaaggtaaaaagt

SEQ ID NO: 85795 - DNA, 20 bp, Artificial Sequence
  Description of Artificial Sequence: Synthetic oligonucleotide
  Target: ATXN1; (-) strand; PAM type: NRG; PAM sequence: AAG
tcagtaactttcaaggtaaa

SEQ ID NO: 85796 - DNA, 20 bp, Artificial Sequence
  Description of Artificial Sequence: Synthetic oligonucleotide
  Target: ATXN1; (-) strand; PAM type: NRG; PAM sequence: AGG
atatacttcagtaactttca

SEQ ID NO: 85797 - DNA, 20 bp, Artificial Sequence
  Description of Artificial Sequence: Synthetic oligonucleotide
  Target: ATXN1; (-) strand; PAM type: NRG; PAM sequence: AAG
tatatacttcagtaactttc

SEQ ID NO: 85798 - DNA, 20 bp, Artificial Sequence
  Description of Artificial Sequence: Synthetic oligonucleotide
  Target: ATXN1; (-) strand; PAM type: NRG; PAM sequence: CAG
tacaactgtgttatatactt

SEQ ID NO: 85799 - DNA, 20 bp, Artificial Sequence
  Description of Artificial Sequence: Synthetic oligonucleotide
  Target: ATXN1; (-) strand; PAM type: NRG; PAM sequence: GGG
tttcataggctgttaattgt

SEQ ID NO: 85800 - DNA, 20 bp, Artificial Sequence
  Description of Artificial Sequence: Synthetic oligonucleotide
  Target: ATXN1; (-) strand; PAM type: NRG; PAM sequence: TGG
ttttcataggctgttaattg

SEQ ID NO: 85801 - DNA, 20 bp, Artificial Sequence
  Description of Artificial Sequence: Synthetic oligonucleotide
  Target: ATXN1; (-) strand; PAM type: NRG; PAM sequence: AGG
cagaaagagttggttttcat

SEQ ID NO: 85802 - DNA, 20 bp, Artificial Sequence
  Description of Artificial Sequence: Synthetic oligonucleotide
  Target: ATXN1; (-) strand; PAM type: NRG; PAM sequence: TAG
ccagaaagagttggttttca

SEQ ID NO: 85803 - DNA, 20 bp, Artificial Sequence
  Description of Artificial Sequence: Synthetic oligonucleotide
  Target: ATXN1; (-) strand; PAM type: NRG; PAM sequence: TGG
gtgctaataccagaaagagt

SEQ ID NO: 85804 - DNA, 20 bp, Artificial Sequence
  Description of Artificial Sequence: Synthetic oligonucleotide
  Target: ATXN1; (-) strand; PAM type: NRG; PAM sequence: GAG
actagtgctaataccagaaa

SEQ ID NO: 85805 - DNA, 20 bp, Artificial Sequence
  Description of Artificial Sequence: Synthetic oligonucleotide
  Target: ATXN1; (-) strand; PAM type: NRG; PAM sequence: AAG
aaactagtgctaataccaga

SEQ ID NO: 85806 - DNA, 20 bp, Artificial Sequence
  Description of Artificial Sequence: Synthetic oligonucleotide
  Target: ATXN1; (-) strand; PAM type: NRG; PAM sequence: CAG
tatgaaactagtgctaatac

SEQ ID NO: 85807 - DNA, 20 bp, Artificial Sequence
  Description of Artificial Sequence: Synthetic oligonucleotide
  Target: ATXN1; (-) strand; PAM type: NRG; PAM sequence: TAG
tttaaaaggatgtatgaaac

SEQ ID NO: 85808 - DNA, 20 bp, Artificial Sequence
  Description of Artificial Sequence: Synthetic oligonucleotide
  Target: ATXN1; (-) strand; PAM type: NRG; PAM sequence: AGG
caatgtccctaacatttaaa

SEQ ID NO: 85809 - DNA, 20 bp, Artificial Sequence
  Description of Artificial Sequence: Synthetic oligonucleotide
  Target: ATXN1; (-) strand; PAM type: NRG; PAM sequence: AAG
tcaatgtccctaacatttaa

SEQ ID NO: 85810 - DNA, 20 bp, Artificial Sequence
  Description of Artificial Sequence: Synthetic oligonucleotide
  Target: ATXN1; (-) strand; PAM type: NRG; PAM sequence: AAG
gcactcagtaatgaagaagt

SEQ ID NO: 85811 - DNA, 20 bp, Artificial Sequence
  Description of Artificial Sequence: Synthetic oligonucleotide
  Target: ATXN1; (-) strand; PAM type: NRG; PAM sequence: AAG
gtaggcactcagtaatgaag

SEQ ID NO: 85812 - DNA, 20 bp, Artificial Sequence
  Description of Artificial Sequence: Synthetic oligonucleotide
  Target: ATXN1; (-) strand; PAM type: NRG; PAM sequence: AAG
aaagtaggcactcagtaatg

SEQ ID NO: 85813 - DNA, 20 bp, Artificial Sequence
  Description of Artificial Sequence: Synthetic oligonucleotide
  Target: ATXN1; (-) strand; PAM type: NRG; PAM sequence: CAG
cctagcacaaagtaggcact

SEQ ID NO: 85814 - DNA, 20 bp, Artificial Sequence
  Description of Artificial Sequence: Synthetic oligonucleotide
  Target: ATXN1; (-) strand; PAM type: NRG; PAM sequence: AGG
ctcagggcctagcacaaagt

SEQ ID NO: 85815 - DNA, 20 bp, Artificial Sequence
  Description of Artificial Sequence: Synthetic oligonucleotide
  Target: ATXN1; (-) strand; PAM type: NRG; PAM sequence: TAG
cctcagggcctagcacaaag

SEQ ID NO: 85816 - DNA, 20 bp, Artificial Sequence
  Description of Artificial Sequence: Synthetic oligonucleotide
  Target: ATXN1; (-) strand; PAM type: NRG; PAM sequence: AAG
tatcctcagggcctagcaca

SEQ ID NO: 85817 - DNA, 20 bp, Artificial Sequence
  Description of Artificial Sequence: Synthetic oligonucleotide
  Target: ATXN1; (-) strand; PAM type: NRG; PAM sequence: TAG
tcatgtgtatcctcagggcc

SEQ ID NO: 85818 - DNA, 20 bp, Artificial Sequence
  Description of Artificial Sequence: Synthetic oligonucleotide
  Target: ATXN1; (-) strand; PAM type: NRG; PAM sequence: GGG
tttactcatgtgtatcctca

SEQ ID NO: 85819 - DNA, 20 bp, Artificial Sequence
  Description of Artificial Sequence: Synthetic oligonucleotide
  Target: ATXN1; (-) strand; PAM type: NRG; PAM sequence: AGG
ttttactcatgtgtatcctc

SEQ ID NO: 85820 - DNA, 20 bp, Artificial Sequence
  Description of Artificial Sequence: Synthetic oligonucleotide
  Target: ATXN1; (-) strand; PAM type: NRG; PAM sequence: CAG
attttactcatgtgtatcct

SEQ ID NO: 85821 - DNA, 20 bp, Artificial Sequence
  Description of Artificial Sequence: Synthetic oligonucleotide
  Target: ATXN1; (-) strand; PAM type: NRG; PAM sequence: AGG
acaactagatggagagtgca

SEQ ID NO: 85822 - DNA, 20 bp, Artificial Sequence
  Description of Artificial Sequence: Synthetic oligonucleotide
  Target: ATXN1; (-) strand; PAM type: NRG; PAM sequence: AAG
cacaactagatggagagtgc

SEQ ID NO: 85823 - DNA, 20 bp, Artificial Sequence
  Description of Artificial Sequence: Synthetic oligonucleotide
  Target: ATXN1; (-) strand; PAM type: NRG; PAM sequence: GAG
tttccccacaactagatgga

SEQ ID NO: 85824 - DNA, 20 bp, Artificial Sequence
  Description of Artificial Sequence: Synthetic oligonucleotide
  Target: ATXN1; (-) strand; PAM type: NRG; PAM sequence: GAG
attttccccacaactagatg

SEQ ID NO: 85825 - DNA, 20 bp, Artificial Sequence
  Description of Artificial Sequence: Synthetic oligonucleotide
  Target: ATXN1; (-) strand; PAM type: NRG; PAM sequence: TGG
ttattttccccacaactaga

SEQ ID NO: 85826 - DNA, 20 bp, Artificial Sequence
  Description of Artificial Sequence: Synthetic oligonucleotide
  Target: ATXN1; (-) strand; PAM type: NRG; PAM sequence: TAG
ttgtttattttccccacaac

SEQ ID NO: 85827 - DNA, 20 bp, Artificial Sequence
  Description of Artificial Sequence: Synthetic oligonucleotide
  Target: ATXN1; (-) strand; PAM type: NRG; PAM sequence: TGG
gctttcctctttcataatcg

SEQ ID NO: 85828 - DNA, 20 bp, Artificial Sequence
  Description of Artificial Sequence: Synthetic oligonucleotide
  Target: ATXN1; (-) strand; PAM type: NRG; PAM sequence: CAG
gaagaatccattccaccact

SEQ ID NO: 85829 - DNA, 20 bp, Artificial Sequence
  Description of Artificial Sequence: Synthetic oligonucleotide
  Target: ATXN1; (-) strand; PAM type: NRG; PAM sequence: AAG
tatattctttttataggaag

SEQ ID NO: 85830 - DNA, 20 bp, Artificial Sequence
  Description of Artificial Sequence: Synthetic oligonucleotide
  Target: ATXN1; (-) strand; PAM type: NRG; PAM sequence: AAG
ttttatattctttttatagg

SEQ ID NO: 85831 - DNA, 20 bp, Artificial Sequence
  Description of Artificial Sequence: Synthetic oligonucleotide
  Target: ATXN1; (-) strand; PAM type: NRG; PAM sequence: AGG
caattttatattctttttat

SEQ ID NO: 85832 - DNA, 20 bp, Artificial Sequence
  Description of Artificial Sequence: Synthetic oligonucleotide
  Target: ATXN1; (-) strand; PAM type: NRG; PAM sequence: TAG
ccaattttatattcttttta

SEQ ID NO: 85833 - DNA, 20 bp, Artificial Sequence
  Description of Artificial Sequence: Synthetic oligonucleotide
  Target: ATXN1; (-) strand; PAM type: NRG; PAM sequence: AGG
tgtgagttgggaatcaggat

SEQ ID NO: 85834 - DNA, 20 bp, Artificial Sequence
  Description of Artificial Sequence: Synthetic oligonucleotide
  Target: ATXN1; (-) strand; PAM type: NRG; PAM sequence: TAG
ttgtgagttgggaatcagga

SEQ ID NO: 85835 - DNA, 20 bp, Artificial Sequence
  Description of Artificial Sequence: Synthetic oligonucleotide
  Target: ATXN1; (-) strand; PAM type: NRG; PAM sequence: AGG
taatttgtgagttgggaatc

SEQ ID NO: 85836 - DNA, 20 bp, Artificial Sequence
  Description of Artificial Sequence: Synthetic oligonucleotide
  Target: ATXN1; (-) strand; PAM type: NRG; PAM sequence: CAG
ttaatttgtgagttgggaat

SEQ ID NO: 85837 - DNA, 20 bp, Artificial Sequence
  Description of Artificial Sequence: Synthetic oligonucleotide
  Target: ATXN1; (-) strand; PAM type: NRG; PAM sequence: GGG
gaaactttaatttgtgagtt

SEQ ID NO: 85838 - DNA, 20 bp, Artificial Sequence
  Description of Artificial Sequence: Synthetic oligonucleotide
  Target: ATXN1; (-) strand; PAM type: NRG; PAM sequence: TGG
cgaaactttaatttgtgagt

SEQ ID NO: 85839 - DNA, 20 bp, Artificial Sequence
  Description of Artificial Sequence: Synthetic oligonucleotide
  Target: ATXN1; (-) strand; PAM type: NRG; PAM sequence: GAG
taaccgaaactttaatttgt

SEQ ID NO: 85840 - DNA, 20 bp, Artificial Sequence
  Description of Artificial Sequence: Synthetic oligonucleotide
  Target: ATXN1; (-) strand; PAM type: NRG; PAM sequence: CAG
aattattttatcacaacaag

SEQ ID NO: 85841 - DNA, 20 bp, Artificial Sequence
  Description of Artificial Sequence: Synthetic oligonucleotide
  Target: ATXN1; (-) strand; PAM type: NRG; PAM sequence: AAG
taaaattattttatcacaac

SEQ ID NO: 85842 - DNA, 20 bp, Artificial Sequence
  Description of Artificial Sequence: Synthetic oligonucleotide
  Target: ATXN1; (-) strand; PAM type: NRG; PAM sequence: AGG
ggaagatgtttccaaccaga

SEQ ID NO: 85843 - DNA, 20 bp, Artificial Sequence
  Description of Artificial Sequence: Synthetic oligonucleotide
  Target: ATXN1; (-) strand; PAM type: NRG; PAM sequence: AAG
aggaagatgtttccaaccag

SEQ ID NO: 85844 - DNA, 20 bp, Artificial Sequence
  Description of Artificial Sequence: Synthetic oligonucleotide
  Target: ATXN1; (-) strand; PAM type: NRG; PAM sequence: CAG
ggtaggaagatgtttccaac

SEQ ID NO: 85845 - DNA, 20 bp, Artificial Sequence
  Description of Artificial Sequence: Synthetic oligonucleotide
  Target: ATXN1; (-) strand; PAM type: NRG; PAM sequence: AAG
ttgtagttaaatctggtagg

SEQ ID NO: 85846 - DNA, 20 bp, Artificial Sequence
  Description of Artificial Sequence: Synthetic oligonucleotide
  Target: ATXN1; (-) strand; PAM type: NRG; PAM sequence: AGG
gttttgtagttaaatctggt

SEQ ID NO: 85847 - DNA, 20 bp, Artificial Sequence
  Description of Artificial Sequence: Synthetic oligonucleotide
  Target: ATXN1; (-) strand; PAM type: NRG; PAM sequence: TAG
agttttgtagttaaatctgg

SEQ ID NO: 85848 - DNA, 20 bp, Artificial Sequence
  Description of Artificial Sequence: Synthetic oligonucleotide
  Target: ATXN1; (-) strand; PAM type: NRG; PAM sequence: TGG
gtcagttttgtagttaaatc

SEQ ID NO: 85849 - DNA, 20 bp, Artificial Sequence
  Description of Artificial Sequence: Synthetic oligonucleotide
  Target: ATXN1; (-) strand; PAM type: NRG; PAM sequence: TAG
cagagtagaggtcagttttg

SEQ ID NO: 85850 - DNA, 20 bp, Artificial Sequence
  Description of Artificial Sequence: Synthetic oligonucleotide
  Target: ATXN1; (-) strand; PAM type: NRG; PAM sequence: CAG
gaacattccagagtagaggt

SEQ ID NO: 85851 - DNA, 20 bp, Artificial Sequence
  Description of Artificial Sequence: Synthetic oligonucleotide
  Target: ATXN1; (-) strand; PAM type: NRG; PAM sequence: AGG
agttgaacattccagagtag

SEQ ID NO: 85852 - DNA, 20 bp, Artificial Sequence
  Description of Artificial Sequence: Synthetic oligonucleotide
  Target: ATXN1; (-) strand; PAM type: NRG; PAM sequence: GAG
cagttgaacattccagagta

SEQ ID NO: 85853 - DNA, 20 bp, Artificial Sequence
  Description of Artificial Sequence: Synthetic oligonucleotide
  Target: ATXN1; (-) strand; PAM type: NRG; PAM sequence: TAG
gccagttgaacattccagag

SEQ ID NO: 85854 - DNA, 20 bp, Artificial Sequence
  Description of Artificial Sequence: Synthetic oligonucleotide
  Target: ATXN1; (-) strand; PAM type: NRG; PAM sequence: GAG
ttggccagttgaacattcca

SEQ ID NO: 85855 - DNA, 20 bp, Artificial Sequence
  Description of Artificial Sequence: Synthetic oligonucleotide
  Target: ATXN1; (-) strand; PAM type: NRG; PAM sequence: CAG
tcttggccagttgaacattc

SEQ ID NO: 85856 - DNA, 20 bp, Artificial Sequence
  Description of Artificial Sequence: Synthetic oligonucleotide
  Target: ATXN1; (-) strand; PAM type: NRG; PAM sequence: CAG
gatgtaacacttttcttggc

SEQ ID NO: 85857 - DNA, 20 bp, Artificial Sequence
  Description of Artificial Sequence: Synthetic oligonucleotide
  Target: ATXN1; (-) strand; PAM type: NRG; PAM sequence: TGG
tgttgatgtaacacttttct

SEQ ID NO: 85858 - DNA, 20 bp, Artificial Sequence
  Description of Artificial Sequence: Synthetic oligonucleotide
  Target: ATXN1; (-) strand; PAM type: NRG; PAM sequence: TGG
atagaaaaaaaaaaagtgat

SEQ ID NO: 85859 - DNA, 20 bp, Artificial Sequence
  Description of Artificial Sequence: Synthetic oligonucleotide
  Target: ATXN1; (-) strand; PAM type: NRG; PAM sequence: AAG
tgatggaatagaaaaaaaaa

SEQ ID NO: 85860 - DNA, 20 bp, Artificial Sequence
  Description of Artificial Sequence: Synthetic oligonucleotide
  Target: ATXN1; (-) strand; PAM type: NRG; PAM sequence: TAG
tccccaatcttgtgatggaa

SEQ ID NO: 85861 - DNA, 20 bp, Artificial Sequence
  Description of Artificial Sequence: Synthetic oligonucleotide
  Target: ATXN1; (-) strand; PAM type: NRG; PAM sequence: TGG
tgatatccccaatcttgtga

SEQ ID NO: 85862 - DNA, 20 bp, Artificial Sequence
  Description of Artificial Sequence: Synthetic oligonucleotide
  Target: ATXN1; (-) strand; PAM type: NRG; PAM sequence: AGG
ttcagtggacataagaggaa

SEQ ID NO: 85863 - DNA, 20 bp, Artificial Sequence
  Description of Artificial Sequence: Synthetic oligonucleotide
  Target: ATXN1; (-) strand; PAM type: NRG; PAM sequence: AAG
gttcagtggacataagagga

SEQ ID NO: 85864 - DNA, 20 bp, Artificial Sequence
  Description of Artificial Sequence: Synthetic oligonucleotide
  Target: ATXN1; (-) strand; PAM type: NRG; PAM sequence: AGG
gagggttcagtggacataag

SEQ ID NO: 85865 - DNA, 20 bp, Artificial Sequence
  Description of Artificial Sequence: Synthetic oligonucleotide
  Target: ATXN1; (-) strand; PAM type: NRG; PAM sequence: GAG
agagggttcagtggacataa

SEQ ID NO: 85866 - DNA, 20 bp, Artificial Sequence
  Description of Artificial Sequence: Synthetic oligonucleotide
  Target: ATXN1; (-) strand; PAM type: NRG; PAM sequence: AAG
gcagagggttcagtggacat

SEQ ID NO: 85867 - DNA, 20 bp, Artificial Sequence
  Description of Artificial Sequence: Synthetic oligonucleotide
  Target: ATXN1; (-) strand; PAM type: NRG; PAM sequence: TGG
aaatacagcagagggttcag

SEQ ID NO: 85868 - DNA, 20 bp, Artificial Sequence
  Description of Artificial Sequence: Synthetic oligonucleotide
  Target: ATXN1; (-) strand; PAM type: NRG; PAM sequence: CAG
acaaaatacagcagagggtt

SEQ ID NO: 85869 - DNA, 20 bp, Artificial Sequence
  Description of Artificial Sequence: Synthetic oligonucleotide
  Target: ATXN1; (-) strand; PAM type: NRG; PAM sequence: GGG
aggctacaaaatacagcaga

SEQ ID NO: 85870 - DNA, 20 bp, Artificial Sequence
  Description of Artificial Sequence: Synthetic oligonucleotide
  Target: ATXN1; (-) strand; PAM type: NRG; PAM sequence: AGG
aaggctacaaaatacagcag

SEQ ID NO: 85871 - DNA, 20 bp, Artificial Sequence
  Description of Artificial Sequence: Synthetic oligonucleotide
  Target: ATXN1; (-) strand; PAM type: NRG; PAM sequence: GAG
aaaggctacaaaatacagca

SEQ ID NO: 85872 - DNA, 20 bp, Artificial Sequence
  Description of Artificial Sequence: Synthetic oligonucleotide
  Target: ATXN1; (-) strand; PAM type: NRG; PAM sequence: CAG
tgaaaggctacaaaatacag

SEQ ID NO: 85873 - DNA, 20 bp, Artificial Sequence
  Description of Artificial Sequence: Synthetic oligonucleotide
  Target: ATXN1; (-) strand; PAM type: NRG; PAM sequence: CAG
atctgaaaggctacaaaata

SEQ ID NO: 85874 - DNA, 20 bp, Artificial Sequence
  Description of Artificial Sequence: Synthetic oligonucleotide
  Target: ATXN1; (-) strand; PAM type: NRG; PAM sequence: AGG
gacaaacgcctagatctgaa

SEQ ID NO: 85875 - DNA, 20 bp, Artificial Sequence
  Description of Artificial Sequence: Synthetic oligonucleotide
  Target: ATXN1; (-) strand; PAM type: NRG; PAM sequence: AAG
agacaaacgcctagatctga

SEQ ID NO: 85876 - DNA, 20 bp, Artificial Sequence
  Description of Artificial Sequence: Synthetic oligonucleotide
  Target: ATXN1; (-) strand; PAM type: NRG; PAM sequence: TAG
agcaaaatgagacaaacgcc

SEQ ID NO: 85877 - DNA, 20 bp, Artificial Sequence
  Description of Artificial Sequence: Synthetic oligonucleotide
  Target: ATXN1; (-) strand; PAM type: NRG; PAM sequence: GAG
ataaaatgaaacagcaaaat

SEQ ID NO: 85878 - DNA, 20 bp, Artificial Sequence
  Description of Artificial Sequence: Synthetic oligonucleotide
  Target: ATXN1; (-) strand; PAM type: NRG; PAM sequence: CAG
taagtgaaaataaaatgaaa

SEQ ID NO: 85879 - DNA, 20 bp, Artificial Sequence
  Description of Artificial Sequence: Synthetic oligonucleotide
  Target: ATXN1; (-) strand; PAM type: NRG; PAM sequence: AAG
aaaaaaagtgttaactagtt

SEQ ID NO: 85880 - DNA, 20 bp, Artificial Sequence
  Description of Artificial Sequence: Synthetic oligonucleotide
  Target: ATXN1; (-) strand; PAM type: NRG; PAM sequence: TAG
gttttaaaaaaagtgttaac

SEQ ID NO: 85881 - DNA, 20 bp, Artificial Sequence
  Description of Artificial Sequence: Synthetic oligonucleotide
  Target: ATXN1; (-) strand; PAM type: NRG; PAM sequence: AAG
ttcattcattgttttaaaaa

SEQ ID NO: 85882 - DNA, 20 bp, Artificial Sequence
  Description of Artificial Sequence: Synthetic oligonucleotide
  Target: ATXN1; (-) strand; PAM type: NRG; PAM sequence: CAG
tttgctcgcagtggccacta

SEQ ID NO: 85883 - DNA, 20 bp, Artificial Sequence
  Description of Artificial Sequence: Synthetic oligonucleotide
  Target: ATXN1; (-) strand; PAM type: NRG; PAM sequence: TGG
ccatggtgctttgctcgcag

SEQ ID NO: 85884 - DNA, 20 bp, Artificial Sequence
  Description of Artificial Sequence: Synthetic oligonucleotide
  Target: ATXN1; (-) strand; PAM type: NRG; PAM sequence: CAG
ttcccatggtgctttgctcg

SEQ ID NO: 85885 - DNA, 20 bp, Artificial Sequence
  Description of Artificial Sequence: Synthetic oligonucleotide
  Target: ATXN1; (-) strand; PAM type: NRG; PAM sequence: TGG
gttcctttttacatttccca

SEQ ID NO: 85886 - DNA, 20 bp, Artificial Sequence
  Description of Artificial Sequence: Synthetic oligonucleotide
  Target: ATXN1; (-) strand; PAM type: NRG; PAM sequence: AGG
gttggaaatctttaaggaca

SEQ ID NO: 85887 - DNA, 20 bp, Artificial Sequence
  Description of Artificial Sequence: Synthetic oligonucleotide
  Target: ATXN1; (-) strand; PAM type: NRG; PAM sequence: AAG
ggttggaaatctttaaggac

SEQ ID NO: 85888 - DNA, 20 bp, Artificial Sequence
  Description of Artificial Sequence: Synthetic oligonucleotide
  Target: ATXN1; (-) strand; PAM type: NRG; PAM sequence: AGG
actcaggttggaaatcttta

SEQ ID NO: 85889 - DNA, 20 bp, Artificial Sequence
  Description of Artificial Sequence: Synthetic oligonucleotide
  Target: ATXN1; (-) strand; PAM type: NRG; PAM sequence: AAG
gactcaggttggaaatcttt

SEQ ID NO: 85890 - DNA, 20 bp, Artificial Sequence
  Description of Artificial Sequence: Synthetic oligonucleotide
  Target: ATXN1; (-) strand; PAM type: NRG; PAM sequence: TGG
tttgtctccctgactcaggt

SEQ ID NO: 85891 - DNA, 20 bp, Artificial Sequence
  Description of Artificial Sequence: Synthetic oligonucleotide
  Target: ATXN1; (-) strand; PAM type: NRG; PAM sequence: AGG
catgtttgtctccctgactc

SEQ ID NO: 85892 - DNA, 20 bp, Artificial Sequence
  Description of Artificial Sequence: Synthetic oligonucleotide
  Target: ATXN1; (-) strand; PAM type: NRG; PAM sequence: CAG
acatgtttgtctccctgact

SEQ ID NO: 85893 - DNA, 20 bp, Artificial Sequence
  Description of Artificial Sequence: Synthetic oligonucleotide
  Target: ATXN1; (-) strand; PAM type: NRG; PAM sequence: CAG
gttctttgctcgtcatctct

SEQ ID NO: 85894 - DNA, 20 bp, Artificial Sequence
  Description of Artificial Sequence: Synthetic oligonucleotide
  Target: ATXN1; (-) strand; PAM type: NRG; PAM sequence: GAG
ctgggagctctctgccagca

SEQ ID NO: 85895 - DNA, 20 bp, Artificial Sequence
  Description of Artificial Sequence: Synthetic oligonucleotide
  Target: ATXN1; (-) strand; PAM type: NRG; PAM sequence: CAG
agctgggagctctctgccag

SEQ ID NO: 85896 - DNA, 20 bp, Artificial Sequence
  Description of Artificial Sequence: Synthetic oligonucleotide
  Target: ATXN1; (-) strand; PAM type: NRG; PAM sequence: CAG
tgcagctgggagctctctgc

SEQ ID NO: 85897 - DNA, 20 bp, Artificial Sequence
  Description of Artificial Sequence: Synthetic oligonucleotide
  Target: ATXN1; (-) strand; PAM type: NRG; PAM sequence: GAG
aatgcctgtgttgcagctgg

SEQ ID NO: 85898 - DNA, 20 bp, Artificial Sequence
  Description of Artificial Sequence: Synthetic oligonucleotide
  Target: ATXN1; (-) strand; PAM type: NRG; PAM sequence: GGG
ttaatgcctgtgttgcagct

SEQ ID NO: 85899 - DNA, 20 bp, Artificial Sequence
  Description of Artificial Sequence: Synthetic oligonucleotide
  Target: ATXN1; (-) strand; PAM type: NRG; PAM sequence: TGG
attaatgcctgtgttgcagc

SEQ ID NO: 85900 - DNA, 20 bp, Artificial Sequence
  Description of Artificial Sequence: Synthetic oligonucleotide
  Target: ATXN1; (-) strand; PAM type: NRG; PAM sequence: CAG
cgtaattaatgcctgtgttg

SEQ ID NO: 85901 - DNA, 20 bp, Artificial Sequence
  Description of Artificial Sequence: Synthetic oligonucleotide
  Target: ATXN1; (-) strand; PAM type: NRG; PAM sequence: GAG
tagaagactcccctctccca

SEQ ID NO: 85902 - DNA, 20 bp, Artificial Sequence
  Description of Artificial Sequence: Synthetic oligonucleotide
  Target: ATXN1; (-) strand; PAM type: NRG; PAM sequence: CAG
aatagaagactcccctctcc

SEQ ID NO: 85903 - DNA, 20 bp, Artificial Sequence
  Description of Artificial Sequence: Synthetic oligonucleotide
  Target: ATXN1; (-) strand; PAM type: NRG; PAM sequence: AAG
ggaggggaatcaaaaaatag

SEQ ID NO: 85904 - DNA, 20 bp, Artificial Sequence
  Description of Artificial Sequence: Synthetic oligonucleotide
  Target: ATXN1; (-) strand; PAM type: NRG; PAM sequence: TAG
tggggaggggaatcaaaaaa

SEQ ID NO: 85905 - DNA, 20 bp, Artificial Sequence
  Description of Artificial Sequence: Synthetic oligonucleotide
  Target: ATXN1; (-) strand; PAM type: NRG; PAM sequence: GGG
atagcactgattctggggag

SEQ ID NO: 85906 - DNA, 20 bp, Artificial Sequence
  Description of Artificial Sequence: Synthetic oligonucleotide
  Target: ATXN1; (-) strand; PAM type: NRG; PAM sequence: GGG
aatagcactgattctgggga

SEQ ID NO: 85907 - DNA, 20 bp, Artificial Sequence
  Description of Artificial Sequence: Synthetic oligonucleotide
  Target: ATXN1; (-) strand; PAM type: NRG; PAM sequence: AGG
aaatagcactgattctgggg

SEQ ID NO: 85908 - DNA, 20 bp, Artificial Sequence
  Description of Artificial Sequence: Synthetic oligonucleotide
  Target: ATXN1; (-) strand; PAM type: NRG; PAM sequence: GAG
caaatagcactgattctggg

SEQ ID NO: 85909 - DNA, 20 bp, Artificial Sequence
  Description of Artificial Sequence: Synthetic oligonucleotide
  Target: ATXN1; (-) strand; PAM type: NRG; PAM sequence: GGG
ttcaaatagcactgattctg

SEQ ID NO: 85910 - DNA, 20 bp, Artificial Sequence
  Description of Artificial Sequence: Synthetic oligonucleotide
  Target: ATXN1; (-) strand; PAM type: NRG; PAM sequence: GGG
tttcaaatagcactgattct

SEQ ID NO: 85911 - DNA, 20 bp, Artificial Sequence
  Description of Artificial Sequence: Synthetic oligonucleotide
  Target: ATXN1; (-) strand; PAM type: NRG; PAM sequence: TGG
ttttcaaatagcactgattc

SEQ ID NO: 85912 - DNA, 20 bp, Artificial Sequence
  Description of Artificial Sequence: Synthetic oligonucleotide
  Target: ATXN1; (-) strand; PAM type: NRG; PAM sequence: TAG
acctacgtgggattttcaaa

SEQ ID NO: 85913 - DNA, 20 bp, Artificial Sequence
  Description of Artificial Sequence: Synthetic oligonucleotide
  Target: ATXN1; (-) strand; PAM type: NRG; PAM sequence: GGG
ccctgtcctcttacctacgt

SEQ ID NO: 85914 - DNA, 20 bp, Artificial Sequence
  Description of Artificial Sequence: Synthetic oligonucleotide
  Target: ATXN1; (-) strand; PAM type: NRG; PAM sequence: TGG
tccctgtcctcttacctacg

SEQ ID NO: 85915 - DNA, 20 bp, Artificial Sequence
  Description of Artificial Sequence: Synthetic oligonucleotide
  Target: ATXN1; (-) strand; PAM type: NRG; PAM sequence: AGG
cttgtaaaaataacatggct

SEQ ID NO: 85916 - DNA, 20 bp, Artificial Sequence
  Description of Artificial Sequence: Synthetic oligonucleotide
  Target: ATXN1; (-) strand; PAM type: NRG; PAM sequence: TAG
acttgtaaaaataacatggc

SEQ ID NO: 85917 - DNA, 20 bp, Artificial Sequence
  Description of Artificial Sequence: Synthetic oligonucleotide
  Target: ATXN1; (-) strand; PAM type: NRG; PAM sequence: TGG
tttgacttgtaaaaataaca

SEQ ID NO: 85918 - DNA, 20 bp, Artificial Sequence
  Description of Artificial Sequence: Synthetic oligonucleotide
  Target: ATXN1; (-) strand; PAM type: NRG; PAM sequence: TAG
taagtattagataaacgcag

SEQ ID NO: 85919 - DNA, 20 bp, Artificial Sequence
  Description of Artificial Sequence: Synthetic oligonucleotide
  Target: ATXN1; (-) strand; PAM type: NRG; PAM sequence: CAG
atctaagtattagataaacg

SEQ ID NO: 85920 - DNA, 20 bp, Artificial Sequence
  Description of Artificial Sequence: Synthetic oligonucleotide
  Target: ATXN1; (-) strand; PAM type: NRG; PAM sequence: TAG
aataatttttatctaagtat

SEQ ID NO: 85921 - DNA, 20 bp, Artificial Sequence
  Description of Artificial Sequence: Synthetic oligonucleotide
  Target: ATXN1; (-) strand; PAM type: NRG; PAM sequence: AAG
ctgaaaaataatttttatct

SEQ ID NO: 85922 - DNA, 20 bp, Artificial Sequence
  Description of Artificial Sequence: Synthetic oligonucleotide
  Target: ATXN1; (-) strand; PAM type: NRG; PAM sequence: TGG
agagaaaattcaataagcaa

SEQ ID NO: 85923 - DNA, 20 bp, Artificial Sequence
  Description of Artificial Sequence: Synthetic oligonucleotide
  Target: ATXN1; (-) strand; PAM type: NRG; PAM sequence: AAG
acacagagagaaaattcaat

SEQ ID NO: 85924 - DNA, 20 bp, Artificial Sequence
  Description of Artificial Sequence: Synthetic oligonucleotide
  Target: ATXN1; (-) strand; PAM type: NRG; PAM sequence: GAG
cctaatgatgaggacacaga

SEQ ID NO: 85925 - DNA, 20 bp, Artificial Sequence
  Description of Artificial Sequence: Synthetic oligonucleotide
  Target: ATXN1; (-) strand; PAM type: NRG; PAM sequence: GAG
gacctaatgatgaggacaca

SEQ ID NO: 85926 - DNA, 20 bp, Artificial Sequence
  Description of Artificial Sequence: Synthetic oligonucleotide
  Target: ATXN1; (-) strand; PAM type: NRG; PAM sequence: CAG
ctgacctaatgatgaggaca

SEQ ID NO: 85927 - DNA, 20 bp, Artificial Sequence
  Description of Artificial Sequence: Synthetic oligonucleotide
  Target: ATXN1; (-) strand; PAM type: NRG; PAM sequence: AGG
ccactcctgacctaatgatg

SEQ ID NO: 85928 - DNA, 20 bp, Artificial Sequence
  Description of Artificial Sequence: Synthetic oligonucleotide
  Target: ATXN1; (-) strand; PAM type: NRG; PAM sequence: GAG
accactcctgacctaatgat

SEQ ID NO: 85929 - DNA, 20 bp, Artificial Sequence
  Description of Artificial Sequence: Synthetic oligonucleotide
  Target: ATXN1; (-) strand; PAM type: NRG; PAM sequence: TGG
gctctttgtggagcacctac

SEQ ID NO: 85930 - DNA, 20 bp, Artificial Sequence
  Description of Artificial Sequence: Synthetic oligonucleotide
  Target: ATXN1; (-) strand; PAM type: NRG; PAM sequence: GAG
ccatctttttgctctttgtg

SEQ ID NO: 85931 - DNA, 20 bp, Artificial Sequence
  Description of Artificial Sequence: Synthetic oligonucleotide
  Target: ATXN1; (-) strand; PAM type: NRG; PAM sequence: TGG
ccccatctttttgctctttg

SEQ ID NO: 85932 - DNA, 20 bp, Artificial Sequence
  Description of Artificial Sequence: Synthetic oligonucleotide
  Target: ATXN1; (-) strand; PAM type: NRG; PAM sequence: AAG
gaaaaaaaattctactatac

SEQ ID NO: 85933 - DNA, 20 bp, Artificial Sequence
  Description of Artificial Sequence: Synthetic oligonucleotide
  Target: ATXN1; (-) strand; PAM type: NRG; PAM sequence: TGG
cagatgagataaataggact

SEQ ID NO: 85934 - DNA, 20 bp, Artificial Sequence
  Description of Artificial Sequence: Synthetic oligonucleotide
  Target: ATXN1; (-) strand; PAM type: NRG; PAM sequence: AGG
gcaaaacagatgagataaat

SEQ ID NO: 85935 - DNA, 20 bp, Artificial Sequence
  Description of Artificial Sequence: Synthetic oligonucleotide
  Target: ATXN1; (-) strand; PAM type: NRG; PAM sequence: TAG
ggcaaaacagatgagataaa

SEQ ID NO: 85936 - DNA, 20 bp, Artificial Sequence
  Description of Artificial Sequence: Synthetic oligonucleotide
  Target: ATXN1; (-) strand; PAM type: NRG; PAM sequence: GAG
aagatacaggcaaaacagat

SEQ ID NO: 85937 - DNA, 20 bp, Artificial Sequence
  Description of Artificial Sequence: Synthetic oligonucleotide
  Target: ATXN1; (-) strand; PAM type: NRG; PAM sequence: CAG
gaagcaagatacaggcaaaa

SEQ ID NO: 85938 - DNA, 20 bp, Artificial Sequence
  Description of Artificial Sequence: Synthetic oligonucleotide
  Target: ATXN1; (-) strand; PAM type: NRG; PAM sequence: AGG
gtgtgaatgaagcaagatac

SEQ ID NO: 85939 - DNA, 20 bp, Artificial Sequence
  Description of Artificial Sequence: Synthetic oligonucleotide
  Target: ATXN1; (-) strand; PAM type: NRG; PAM sequence: CAG
ggtgtgaatgaagcaagata

SEQ ID NO: 85940 - DNA, 20 bp, Artificial Sequence
  Description of Artificial Sequence: Synthetic oligonucleotide
  Target: ATXN1; (-) strand; PAM type: NRG; PAM sequence: AAG
ttttctggtgtgaatgaagc

SEQ ID NO: 85941 - DNA, 20 bp, Artificial Sequence
  Description of Artificial Sequence: Synthetic oligonucleotide
  Target: ATXN1; (-) strand; PAM type: NRG; PAM sequence: AAG
agctttttctggtgtgaatg

SEQ ID NO: 85942 - DNA, 20 bp, Artificial Sequence
  Description of Artificial Sequence: Synthetic oligonucleotide
  Target: ATXN1; (-) strand; PAM type: NRG; PAM sequence: TGG
acaaatgtgtcagctttttc

SEQ ID NO: 85943 - DNA, 20 bp, Artificial Sequence
  Description of Artificial Sequence: Synthetic oligonucleotide
  Target: ATXN1; (-) strand; PAM type: NRG; PAM sequence: CAG
agacaacggcacaaatgtgt

SEQ ID NO: 85944 - DNA, 20 bp, Artificial Sequence
  Description of Artificial Sequence: Synthetic oligonucleotide
  Target: ATXN1; (-) strand; PAM type: NRG; PAM sequence: CGG
gactaaccttcagcagacaa

SEQ ID NO: 85945 - DNA, 20 bp, Artificial Sequence
  Description of Artificial Sequence: Synthetic oligonucleotide
  Target: ATXN1; (-) strand; PAM type: NRG; PAM sequence: CAG
tcatgaagactaaccttcag

SEQ ID NO: 85946 - DNA, 20 bp, Artificial Sequence
  Description of Artificial Sequence: Synthetic oligonucleotide
  Target: ATXN1; (-) strand; PAM type: NRG; PAM sequence: CAG
atttcatgaagactaacctt

SEQ ID NO: 85947 - DNA, 20 bp, Artificial Sequence
  Description of Artificial Sequence: Synthetic oligonucleotide
  Target: ATXN1; (-) strand; PAM type: NRG; PAM sequence: AAG
tgttcatgttaaatttcatg

SEQ ID NO: 85948 - DNA, 20 bp, Artificial Sequence
  Description of Artificial Sequence: Synthetic oligonucleotide
  Target: ATXN1; (-) strand; PAM type: NRG; PAM sequence: AGG
aaaggaattagctgcttgaa

SEQ ID NO: 85949 - DNA, 20 bp, Artificial Sequence
  Description of Artificial Sequence: Synthetic oligonucleotide
  Target: ATXN1; (-) strand; PAM type: NRG; PAM sequence: AAG
aaaaggaattagctgcttga

SEQ ID NO: 85950 - DNA, 20 bp, Artificial Sequence
  Description of Artificial Sequence: Synthetic oligonucleotide
  Target: ATXN1; (-) strand; PAM type: NRG; PAM sequence: TAG
ttagctgcttaaaaaggaat

SEQ ID NO: 85951 - DNA, 20 bp, Artificial Sequence
  Description of Artificial Sequence: Synthetic oligonucleotide
  Target: ATXN1; (-) strand; PAM type: NRG; PAM sequence: AGG
gaacatttagctgcttaaaa

SEQ ID NO: 85952 - DNA, 20 bp, Artificial Sequence
  Description of Artificial Sequence: Synthetic oligonucleotide
  Target: ATXN1; (-) strand; PAM type: NRG; PAM sequence: AAG
tgaacatttagctgcttaaa

SEQ ID NO: 85953 - DNA, 20 bp, Artificial Sequence
  Description of Artificial Sequence: Synthetic oligonucleotide
  Target: ATXN1; (-) strand; PAM type: NRG; PAM sequence: TAG
gaaagacataggtgaacatt

SEQ ID NO: 85954 - DNA, 20 bp, Artificial Sequence
  Description of Artificial Sequence: Synthetic oligonucleotide
  Target: ATXN1; (-) strand; PAM type: NRG; PAM sequence: AGG
agtcatcccgtgaaagacat

SEQ ID NO: 85955 - DNA, 20 bp, Artificial Sequence
  Description of Artificial Sequence: Synthetic oligonucleotide
  Target: ATXN1; (-) strand; PAM type: NRG; PAM sequence: TAG
tagtcatcccgtgaaagaca

SEQ ID NO: 85956 - DNA, 20 bp, Artificial Sequence
  Description of Artificial Sequence: Synthetic oligonucleotide
  Target: ATXN1; (-) strand; PAM type: NRG; PAM sequence: AAG
cacaattagtcatcccgtga

SEQ ID NO: 85957 - DNA, 20 bp, Artificial Sequence
  Description of Artificial Sequence: Synthetic oligonucleotide
  Target: ATXN1; (-) strand; PAM type: NRG; PAM sequence: TAG
gtcttgcttacattcacaat

SEQ ID NO: 85958 - DNA, 20 bp, Artificial Sequence
  Description of Artificial Sequence: Synthetic oligonucleotide
  Target: ATXN1; (-) strand; PAM type: NRG; PAM sequence: CAG
caattatatctgaatttcat

SEQ ID NO: 85959 - DNA, 20 bp, Artificial Sequence
  Description of Artificial Sequence: Synthetic oligonucleotide
  Target: ATXN1; (-) strand; PAM type: NRG; PAM sequence: TAG
gaatgaattaagagcagtaa

SEQ ID NO: 85960 - DNA, 20 bp, Artificial Sequence
  Description of Artificial Sequence: Synthetic oligonucleotide
  Target: ATXN1; (-) strand; PAM type: NRG; PAM sequence: CAG
gaaacagaatgaattaagag

SEQ ID NO: 85961 - DNA, 20 bp, Artificial Sequence
  Description of Artificial Sequence: Synthetic oligonucleotide
  Target: ATXN1; (-) strand; PAM type: NRG; PAM sequence: GAG
acagaaacagaatgaattaa

SEQ ID NO: 85962 - DNA, 20 bp, Artificial Sequence
  Description of Artificial Sequence: Synthetic oligonucleotide
  Target: ATXN1; (-) strand; PAM type: NRG; PAM sequence: AAG
tgacagaaacagaatgaatt

SEQ ID NO: 85963 - DNA, 20 bp, Artificial Sequence
  Description of Artificial Sequence: Synthetic oligonucleotide
  Target: ATXN1; (-) strand; PAM type: NRG; PAM sequence: CAG
ggtatgatagttgacagaaa

SEQ ID NO: 85964 - DNA, 20 bp, Artificial Sequence
  Description of Artificial Sequence: Synthetic oligonucleotide
  Target: ATXN1; (-) strand; PAM type: NRG; PAM sequence: CAG
aaatagggtatgatagttga

SEQ ID NO: 85965 - DNA, 20 bp, Artificial Sequence
  Description of Artificial Sequence: Synthetic oligonucleotide
  Target: ATXN1; (-) strand; PAM type: NRG; PAM sequence: TAG
atatagaaaatagggtatga

SEQ ID NO: 85966 - DNA, 20 bp, Artificial Sequence
  Description of Artificial Sequence: Synthetic oligonucleotide
  Target: ATXN1; (-) strand; PAM type: NRG; PAM sequence: GGG
cactgtaaatatagaaaata

SEQ ID NO: 85967 - DNA, 20 bp, Artificial Sequence
  Description of Artificial Sequence: Synthetic oligonucleotide
  Target: ATXN1; (-) strand; PAM type: NRG; PAM sequence: AGG
gcactgtaaatatagaaaat

SEQ ID NO: 85968 - DNA, 20 bp, Artificial Sequence
  Description of Artificial Sequence: Synthetic oligonucleotide
  Target: ATXN1; (-) strand; PAM type: NRG; PAM sequence: TAG
tgcactgtaaatatagaaaa

SEQ ID NO: 85969 - DNA, 20 bp, Artificial Sequence
  Description of Artificial Sequence: Synthetic oligonucleotide
  Target: ATXN1; (-) strand; PAM type: NRG; PAM sequence: TAG
tttcaagtgcactgtaaata

SEQ ID NO: 85970 - DNA, 20 bp, Artificial Sequence
  Description of Artificial Sequence: Synthetic oligonucleotide
  Target: ATXN1; (-) strand; PAM type: NRG; PAM sequence: AAG
taagttgcataaacaatttc

SEQ ID NO: 85971 - DNA, 20 bp, Artificial Sequence
  Description of Artificial Sequence: Synthetic oligonucleotide
  Target: ATXN1; (-) strand; PAM type: NRG; PAM sequence: AAG
gatgaccatttaattttttt

SEQ ID NO: 85972 - DNA, 20 bp, Artificial Sequence
  Description of Artificial Sequence: Synthetic oligonucleotide
  Target: ATXN1; (-) strand; PAM type: NRG; PAM sequence: CAG
cgagtgcaccaaacactttt

SEQ ID NO: 85973 - DNA, 20 bp, Artificial Sequence
  Description of Artificial Sequence: Synthetic oligonucleotide
  Target: ATXN1; (-) strand; PAM type: NRG; PAM sequence: GAG
gcaagaaaaaaatctcattc

SEQ ID NO: 85974 - DNA, 20 bp, Artificial Sequence
  Description of Artificial Sequence: Synthetic oligonucleotide
  Target: ATXN1; (-) strand; PAM type: NRG; PAM sequence: AAG
cagcccctgataaaagttgc

SEQ ID NO: 85975 - DNA, 20 bp, Artificial Sequence
  Description of Artificial Sequence: Synthetic oligonucleotide
  Target: ATXN1; (-) strand; PAM type: NRG; PAM sequence: AAG
aggcaaacagcccctgataa

SEQ ID NO: 85976 - DNA, 20 bp, Artificial Sequence
  Description of Artificial Sequence: Synthetic oligonucleotide
  Target: ATXN1; (-) strand; PAM type: NRG; PAM sequence: CAG
gcagcaagtttttaggcaaa

SEQ ID NO: 85977 - DNA, 20 bp, Artificial Sequence
  Description of Artificial Sequence: Synthetic oligonucleotide
  Target: ATXN1; (-) strand; PAM type: NRG; PAM sequence: AGG
ggctagagcagcaagttttt

SEQ ID NO: 85978 - DNA, 20 bp, Artificial Sequence
  Description of Artificial Sequence: Synthetic oligonucleotide
  Target: ATXN1; (-) strand; PAM type: NRG; PAM sequence: TAG
tggctagagcagcaagtttt

SEQ ID NO: 85979 - DNA, 20 bp, Artificial Sequence
  Description of Artificial Sequence: Synthetic oligonucleotide
  Target: ATXN1; (-) strand; PAM type: NRG; PAM sequence: AAG
aacattttggctagagcagc

SEQ ID NO: 85980 - DNA, 20 bp, Artificial Sequence
  Description of Artificial Sequence: Synthetic oligonucleotide
  Target: ATXN1; (-) strand; PAM type: NRG; PAM sequence: CAG
taaaaacattttggctagag

SEQ ID NO: 85981 - DNA, 20 bp, Artificial Sequence
  Description of Artificial Sequence: Synthetic oligonucleotide
  Target: ATXN1; (-) strand; PAM type: NRG; PAM sequence: GAG
tgctaaaaacattttggcta

SEQ ID NO: 85982 - DNA, 20 bp, Artificial Sequence
  Description of Artificial Sequence: Synthetic oligonucleotide
  Target: ATXN1; (-) strand; PAM type: NRG; PAM sequence: TAG
tgtgctaaaaacattttggc

SEQ ID NO: 85983 - DNA, 20 bp, Artificial Sequence
  Description of Artificial Sequence: Synthetic oligonucleotide
  Target: ATXN1; (-) strand; PAM type: NRG; PAM sequence: TGG
attttgtgctaaaaacattt

SEQ ID NO: 85984 - DNA, 20 bp, Artificial Sequence
  Description of Artificial Sequence: Synthetic oligonucleotide
  Target: ATXN1; (-) strand; PAM type: NRG; PAM sequence: TAG
gatagctctgaggttattgc

SEQ ID NO: 85985 - DNA, 20 bp, Artificial Sequence
  Description of Artificial Sequence: Synthetic oligonucleotide
  Target: ATXN1; (-) strand; PAM type: NRG; PAM sequence: AGG
gcaaagaaaagatagctctg

SEQ ID NO: 85986 - DNA, 20 bp, Artificial Sequence
  Description of Artificial Sequence: Synthetic oligonucleotide
  Target: ATXN1; (-) strand; PAM type: NRG; PAM sequence: GAG
ggcaaagaaaagatagctct

SEQ ID NO: 85987 - DNA, 20 bp, Artificial Sequence
  Description of Artificial Sequence: Synthetic oligonucleotide
  Target: ATXN1; (-) strand; PAM type: NRG; PAM sequence: TAG
attaagtggcaaagaaaaga

SEQ ID NO: 85988 - DNA, 20 bp, Artificial Sequence
  Description of Artificial Sequence: Synthetic oligonucleotide
  Target: ATXN1; (-) strand; PAM type: NRG; PAM sequence: AAG
taaaattaagtggcaaagaa

SEQ ID NO: 85989 - DNA, 20 bp, Artificial Sequence
  Description of Artificial Sequence: Synthetic oligonucleotide
  Target: ATXN1; (-) strand; PAM type: NRG; PAM sequence: AAG
cttggtaaaattaagtggca

SEQ ID NO: 85990 - DNA, 20 bp, Artificial Sequence
  Description of Artificial Sequence: Synthetic oligonucleotide
  Target: ATXN1; (-) strand; PAM type: NRG; PAM sequence: TGG
ttgctcttggtaaaattaag

SEQ ID NO: 85991 - DNA, 20 bp, Artificial Sequence
  Description of Artificial Sequence: Synthetic oligonucleotide
  Target: ATXN1; (-) strand; PAM type: NRG; PAM sequence: AAG
tttttgctcttggtaaaatt

SEQ ID NO: 85992 - DNA, 20 bp, Artificial Sequence
  Description of Artificial Sequence: Synthetic oligonucleotide
  Target: ATXN1; (-) strand; PAM type: NRG; PAM sequence: TGG
ttttcccttctttttgctct

SEQ ID NO: 85993 - DNA, 20 bp, Artificial Sequence
  Description of Artificial Sequence: Synthetic oligonucleotide
  Target: ATXN1; (-) strand; PAM type: NRG; PAM sequence: GAG
ccatgcaatggcaaaatgaa

SEQ ID NO: 85994 - DNA, 20 bp, Artificial Sequence
  Description of Artificial Sequence: Synthetic oligonucleotide
  Target: ATXN1; (-) strand; PAM type: NRG; PAM sequence: AAG
tgccatgcaatggcaaaatg

SEQ ID NO: 85995 - DNA, 20 bp, Artificial Sequence
  Description of Artificial Sequence: Synthetic oligonucleotide
  Target: ATXN1; (-) strand; PAM type: NRG; PAM sequence: TGG
tgtgcatttttgccatgcaa

SEQ ID NO: 85996 - DNA, 20 bp, Artificial Sequence
  Description of Artificial Sequence: Synthetic oligonucleotide
  Target: ATXN1; (-) strand; PAM type: NRG; PAM sequence: AAG
atttctgccatagaagagtt

SEQ ID NO: 85997 - DNA, 20 bp, Artificial Sequence
  Description of Artificial Sequence: Synthetic oligonucleotide
  Target: ATXN1; (-) strand; PAM type: NRG; PAM sequence: GAG
tttgtatttctgccatagaa

SEQ ID NO: 85998 - DNA, 20 bp, Artificial Sequence
  Description of Artificial Sequence: Synthetic oligonucleotide
  Target: ATXN1; (-) strand; PAM type: NRG; PAM sequence: AAG
catttgtatttctgccatag

SEQ ID NO: 85999 - DNA, 20 bp, Artificial Sequence
  Description of Artificial Sequence: Synthetic oligonucleotide
  Target: ATXN1; (-) strand; PAM type: NRG; PAM sequence: TAG
tttcatttgtatttctgcca

SEQ ID NO: 86000 - DNA, 20 bp, Artificial Sequence
  Description of Artificial Sequence: Synthetic oligonucleotide
  Target: ATXN1; (-) strand; PAM type: NRG; PAM sequence: TGG
agtaacttaaacattggcat

SEQ ID NO: 86001 - DNA, 20 bp, Artificial Sequence
  Description of Artificial Sequence: Synthetic oligonucleotide
  Target: ATXN1; (-) strand; PAM type: NRG; PAM sequence: TGG
cctaaaagtaacttaaacat

SEQ ID NO: 86002 - DNA, 20 bp, Artificial Sequence
  Description of Artificial Sequence: Synthetic oligonucleotide
  Target: ATXN1; (-) strand; PAM type: NRG; PAM sequence: AAG
atagtcaacggaaatcctaa

SEQ ID NO: 86003 - DNA, 20 bp, Artificial Sequence
  Description of Artificial Sequence: Synthetic oligonucleotide
  Target: ATXN1; (-) strand; PAM type: NRG; PAM sequence: CGG
tgaaaaaataagatagtcaa

SEQ ID NO: 86004 - DNA, 20 bp, Artificial Sequence
  Description of Artificial Sequence: Synthetic oligonucleotide
  Target: ATXN1; (-) strand; PAM type: NRG; PAM sequence: TAG
cagattatgaaaaaataaga

SEQ ID NO: 86005 - DNA, 20 bp, Artificial Sequence
  Description of Artificial Sequence: Synthetic oligonucleotide
  Target: ATXN1; (-) strand; PAM type: NRG; PAM sequence: AAG
aagtcagattatgaaaaaat

SEQ ID NO: 86006 - DNA, 20 bp, Artificial Sequence
  Description of Artificial Sequence: Synthetic oligonucleotide
  Target: ATXN1; (-) strand; PAM type: NRG; PAM sequence: CAG
aaaatagatatccaagaagt

SEQ ID NO: 86007 - DNA, 20 bp, Artificial Sequence
  Description of Artificial Sequence: Synthetic oligonucleotide
  Target: ATXN1; (-) strand; PAM type: NRG; PAM sequence: AAG
aattaaaatagatatccaag

SEQ ID NO: 86008 - DNA, 20 bp, Artificial Sequence
  Description of Artificial Sequence: Synthetic oligonucleotide
  Target: ATXN1; (-) strand; PAM type: NRG; PAM sequence: AAG
aagaattaaaatagatatcc

SEQ ID NO: 86009 - DNA, 20 bp, Artificial Sequence
  Description of Artificial Sequence: Synthetic oligonucleotide
  Target: ATXN1; (-) strand; PAM type: NRG; PAM sequence: TAG
caaaatcaaaagaattaaaa

SEQ ID NO: 86010 - DNA, 20 bp, Artificial Sequence
  Description of Artificial Sequence: Synthetic oligonucleotide
  Target: ATXN1; (-) strand; PAM type: NRG; PAM sequence: AAG
gtacattttctcaaaatcaa

SEQ ID NO: 86011 - DNA, 20 bp, Artificial Sequence
  Description of Artificial Sequence: Synthetic oligonucleotide
  Target: ATXN1; (-) strand; PAM type: NRG; PAM sequence: TGG
gttggctgagactttagaat

SEQ ID NO: 86012 - DNA, 20 bp, Artificial Sequence
  Description of Artificial Sequence: Synthetic oligonucleotide
  Target: ATXN1; (-) strand; PAM type: NRG; PAM sequence: TAG
tgaatagttggctgagactt

SEQ ID NO: 86013 - DNA, 20 bp, Artificial Sequence
  Description of Artificial Sequence: Synthetic oligonucleotide
  Target: ATXN1; (-) strand; PAM type: NRG; PAM sequence: GAG
aaaatattgaatagttggct

SEQ ID NO: 86014 - DNA, 20 bp, Artificial Sequence
  Description of Artificial Sequence: Synthetic oligonucleotide
  Target: ATXN1; (-) strand; PAM type: NRG; PAM sequence: TGG
cgctgaaaatattgaatagt

SEQ ID NO: 86015 - DNA, 20 bp, Artificial Sequence
  Description of Artificial Sequence: Synthetic oligonucleotide
  Target: ATXN1; (-) strand; PAM type: NRG; PAM sequence: TAG
aaatcgctgaaaatattgaa

SEQ ID NO: 86016 - DNA, 20 bp, Artificial Sequence
  Description of Artificial Sequence: Synthetic oligonucleotide
  Target: ATXN1; (-) strand; PAM type: NRG; PAM sequence: AAG
tgttagtaagaatttgaagt

SEQ ID NO: 86017 - DNA, 20 bp, Artificial Sequence
  Description of Artificial Sequence: Synthetic oligonucleotide
  Target: ATXN1; (-) strand; PAM type: NRG; PAM sequence: AAG
gcattgttagtaagaatttg

SEQ ID NO: 86018 - DNA, 20 bp, Artificial Sequence
  Description of Artificial Sequence: Synthetic oligonucleotide
  Target: ATXN1; (-) strand; PAM type: NRG; PAM sequence: AAG
tactatgtggcattgttagt

SEQ ID NO: 86019 - DNA, 20 bp, Artificial Sequence
  Description of Artificial Sequence: Synthetic oligonucleotide
  Target: ATXN1; (-) strand; PAM type: NRG; PAM sequence: TAG
ggtatactatgtggcattgt

SEQ ID NO: 86020 - DNA, 20 bp, Artificial Sequence
  Description of Artificial Sequence: Synthetic oligonucleotide
  Target: ATXN1; (-) strand; PAM type: NRG; PAM sequence: TGG
ataatgattggtatactatg

SEQ ID NO: 86021 - DNA, 20 bp, Artificial Sequence
  Description of Artificial Sequence: Synthetic oligonucleotide
  Target: ATXN1; (-) strand; PAM type: NRG; PAM sequence: TGG
agaataaaaatgataatgat

SEQ ID NO: 86022 - DNA, 20 bp, Artificial Sequence
  Description of Artificial Sequence: Synthetic oligonucleotide
  Target: ATXN1; (-) strand; PAM type: NRG; PAM sequence: TAG
agccatcttctaatataaga

SEQ ID NO: 86023 - DNA, 20 bp, Artificial Sequence
  Description of Artificial Sequence: Synthetic oligonucleotide
  Target: ATXN1; (-) strand; PAM type: NRG; PAM sequence: AAG
taaaagccatcttctaatat

SEQ ID NO: 86024 - DNA, 20 bp, Artificial Sequence
  Description of Artificial Sequence: Synthetic oligonucleotide
  Target: ATXN1; (-) strand; PAM type: NRG; PAM sequence: AAG
aaaataacattttggcttaa

SEQ ID NO: 86025 - DNA, 20 bp, Artificial Sequence
  Description of Artificial Sequence: Synthetic oligonucleotide
  Target: ATXN1; (-) strand; PAM type: NRG; PAM sequence: TGG
actgtaagaaaataacattt

SEQ ID NO: 86026 - DNA, 20 bp, Artificial Sequence
  Description of Artificial Sequence: Synthetic oligonucleotide
  Target: ATXN1; (-) strand; PAM type: NRG; PAM sequence: AAG
tagcatatcaaactaactgt

SEQ ID NO: 86027 - DNA, 20 bp, Artificial Sequence
  Description of Artificial Sequence: Synthetic oligonucleotide
  Target: ATXN1; (-) strand; PAM type: NRG; PAM sequence: TAG
agccaggttctctgtgagca

SEQ ID NO: 86028 - DNA, 20 bp, Artificial Sequence
  Description of Artificial Sequence: Synthetic oligonucleotide
  Target: ATXN1; (-) strand; PAM type: NRG; PAM sequence: GAG
aagacagccaggttctctgt

SEQ ID NO: 86029 - DNA, 20 bp, Artificial Sequence
  Description of Artificial Sequence: Synthetic oligonucleotide
  Target: ATXN1; (-) strand; PAM type: NRG; PAM sequence: AGG
atcccagccaaaagacagcc

SEQ ID NO: 86030 - DNA, 20 bp, Artificial Sequence
  Description of Artificial Sequence: Synthetic oligonucleotide
  Target: ATXN1; (-) strand; PAM type: NRG; PAM sequence: CAG
catcccagccaaaagacagc

SEQ ID NO: 86031 - DNA, 20 bp, Artificial Sequence
  Description of Artificial Sequence: Synthetic oligonucleotide
  Target: ATXN1; (-) strand; PAM type: NRG; PAM sequence: CAG
ggaacatcccagccaaaaga

SEQ ID NO: 86032 - DNA, 20 bp, Artificial Sequence
  Description of Artificial Sequence: Synthetic oligonucleotide
  Target: ATXN1; (-) strand; PAM type: NRG; PAM sequence: AAG
gctgggaacatcccagccaa

SEQ ID NO: 86033 - DNA, 20 bp, Artificial Sequence
  Description of Artificial Sequence: Synthetic oligonucleotide
  Target: ATXN1; (-) strand; PAM type: NRG; PAM sequence: CAG
atttttagctgggaacatcc

SEQ ID NO: 86034 - DNA, 20 bp, Artificial Sequence
  Description of Artificial Sequence: Synthetic oligonucleotide
  Target: ATXN1; (-) strand; PAM type: NRG; PAM sequence: GGG
ctgatttctcatttttagct

SEQ ID NO: 86035 - DNA, 20 bp, Artificial Sequence
  Description of Artificial Sequence: Synthetic oligonucleotide
  Target: ATXN1; (-) strand; PAM type: NRG; PAM sequence: TGG
tctgatttctcatttttagc

SEQ ID NO: 86036 - DNA, 20 bp, Artificial Sequence
  Description of Artificial Sequence: Synthetic oligonucleotide
  Target: ATXN1; (-) strand; PAM type: NRG; PAM sequence: TAG
tgtctctgatttctcatttt

SEQ ID NO: 86037 - DNA, 20 bp, Artificial Sequence
  Description of Artificial Sequence: Synthetic oligonucleotide
  Target: ATXN1; (-) strand; PAM type: NRG; PAM sequence: CAG
ccacatcctatgttcctact

SEQ ID NO: 86038 - DNA, 20 bp, Artificial Sequence
  Description of Artificial Sequence: Synthetic oligonucleotide
  Target: ATXN1; (-) strand; PAM type: NRG; PAM sequence: AGG
atgataaaaatattctataa

SEQ ID NO: 86039 - DNA, 20 bp, Artificial Sequence
  Description of Artificial Sequence: Synthetic oligonucleotide
  Target: ATXN1; (-) strand; PAM type: NRG; PAM sequence: AAG
aatgataaaaatattctata

SEQ ID NO: 86040 - DNA, 20 bp, Artificial Sequence
  Description of Artificial Sequence: Synthetic oligonucleotide
  Target: ATXN1; (-) strand; PAM type: NRG; PAM sequence: AGG
gctgaatattccaatctctt

SEQ ID NO: 86041 - DNA, 20 bp, Artificial Sequence
  Description of Artificial Sequence: Synthetic oligonucleotide
  Target: ATXN1; (-) strand; PAM type: NRG; PAM sequence: TAG
tgctgaatattccaatctct

SEQ ID NO: 86042 - DNA, 20 bp, Artificial Sequence
  Description of Artificial Sequence: Synthetic oligonucleotide
  Target: ATXN1; (-) strand; PAM type: NRG; PAM sequence: TAG
tatttaaatcagaaaattat

SEQ ID NO: 86043 - DNA, 20 bp, Artificial Sequence
  Description of Artificial Sequence: Synthetic oligonucleotide
  Target: ATXN1; (-) strand; PAM type: NRG; PAM sequence: CAG
atgtctacttatatttaaat

SEQ ID NO: 86044 - DNA, 20 bp, Artificial Sequence
  Description of Artificial Sequence: Synthetic oligonucleotide
  Target: ATXN1; (-) strand; PAM type: NRG; PAM sequence: TGG
tttttttggtgaaattaata

SEQ ID NO: 86045 - DNA, 20 bp, Artificial Sequence
  Description of Artificial Sequence: Synthetic oligonucleotide
  Target: ATXN1; (-) strand; PAM type: NRG; PAM sequence: TGG
attaacttaaacattttttt

SEQ ID NO: 86046 - DNA, 20 bp, Artificial Sequence
  Description of Artificial Sequence: Synthetic oligonucleotide
  Target: ATXN1; (-) strand; PAM type: NRG; PAM sequence: CAG
caggcgtgagccaccgcacc

SEQ ID NO: 86047 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 86048 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 86049 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 86050 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 86051 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 86052 - DNA, 20 bp, Artificial Sequence
  Description of Artificial Sequence: Synthetic oligonucleotide
  Target: ATXN1; (-) strand; PAM type: NRG; PAM sequence: AAG
ccacccgcctcggcctccca

SEQ ID NO: 86053 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatccacccgcct

SEQ ID NO: 86054 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacctc

SEQ ID NO: 86055 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgacct

SEQ ID NO: 86056 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggtcaggc

SEQ ID NO: 86057 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggtc

SEQ ID NO: 86058 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggt

SEQ ID NO: 86059 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcaccatgt

SEQ ID NO: 86060 - DNA, 20 bp, Artificial Sequence
  Description of Artificial Sequence: Synthetic oligonucleotide
  Target: ATXN1; (-) strand; PAM type: NRG; PAM sequence: GGG
tgtatgtttttgtagagatg

SEQ ID NO: 86061 - DNA, 20 bp, Artificial Sequence
  Description of Artificial Sequence: Synthetic oligonucleotide
  Target: ATXN1; (-) strand; PAM type: NRG; PAM sequence: GGG
ttgtatgtttttgtagagat

SEQ ID NO: 86062 - DNA, 20 bp, Artificial Sequence
  Description of Artificial Sequence: Synthetic oligonucleotide
  Target: ATXN1; (-) strand; PAM type: NRG; PAM sequence: TGG
tttgtatgtttttgtagaga

SEQ ID NO: 86063 - DNA, 20 bp, Artificial Sequence
  Description of Artificial Sequence: Synthetic oligonucleotide
  Target: ATXN1; (-) strand; PAM type: NRG; PAM sequence: GAG
taattttgtatgtttttgta

SEQ ID NO: 86064 - DNA, 20 bp, Artificial Sequence
  Description of Artificial Sequence: Synthetic oligonucleotide
  Target: ATXN1; (-) strand; PAM type: NRG; PAM sequence: TAG
gctaattttgtatgtttttg

SEQ ID NO: 86065 - DNA, 20 bp, Artificial Sequence
  Description of Artificial Sequence: Synthetic oligonucleotide
  Target: ATXN1; (-) strand; PAM type: NRG; PAM sequence: CAG
taggcatgctccaccacagc

SEQ ID NO: 86066 - DNA, 20 bp, Artificial Sequence
  Description of Artificial Sequence: Synthetic oligonucleotide
  Target: ATXN1; (-) strand; PAM type: NRG; PAM sequence: CAG
attataggcatgctccacca

SEQ ID NO: 86067 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattat

SEQ ID NO: 86068 - DNA, 20 bp, Artificial Sequence
  Description of Artificial Sequence: Synthetic oligonucleotide
  Target: ATXN1; (-) strand; PAM type: NRG; PAM sequence: TAG
ctcccaagtagctgggatta

SEQ ID NO: 86069 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 86070 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 86071 - DNA, 20 bp, Artificial Sequence
  Description of Artificial Sequence: Synthetic oligonucleotide
  Target: ATXN1; (-) strand; PAM type: NRG; PAM sequence: TAG
tactgcctcagcctcccaag

SEQ ID NO: 86072 - DNA, 20 bp, Artificial Sequence
  Description of Artificial Sequence: Synthetic oligonucleotide
  Target: ATXN1; (-) strand; PAM type: NRG; PAM sequence: AAG
ttctactgcctcagcctccc

SEQ ID NO: 86073 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctactgcct

SEQ ID NO: 86074 - DNA, 20 bp, Artificial Sequence
  Description of Artificial Sequence: Synthetic oligonucleotide
  Target: ATXN1; (-) strand; PAM type: NRG; PAM sequence: AAG
aacctctgtctctcgagttc

SEQ ID NO: 86075 - DNA, 20 bp, Artificial Sequence
  Description of Artificial Sequence: Synthetic oligonucleotide
  Target: ATXN1; (-) strand; PAM type: NRG; PAM sequence: GAG
taccgcaacctctgtctctc

SEQ ID NO: 86076 - DNA, 20 bp, Artificial Sequence
  Description of Artificial Sequence: Synthetic oligonucleotide
  Target: ATXN1; (-) strand; PAM type: NRG; PAM sequence: CGG
ggggtgcagtggcgtgatct

SEQ ID NO: 86077 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggggtgcag

SEQ ID NO: 86078 - DNA, 20 bp, Artificial Sequence
  Description of Artificial Sequence: Synthetic oligonucleotide
  Target: ATXN1; (-) strand; PAM type: NRG; PAM sequence: CAG
ttgttgcccaggctggggtg

SEQ ID NO: 86079 - DNA, 20 bp, Artificial Sequence
  Description of Artificial Sequence: Synthetic oligonucleotide
  Target: ATXN1; (-) strand; PAM type: NRG; PAM sequence: GGG
cactcttgttgcccaggctg

SEQ ID NO: 86080 - DNA, 20 bp, Artificial Sequence
  Description of Artificial Sequence: Synthetic oligonucleotide
  Target: ATXN1; (-) strand; PAM type: NRG; PAM sequence: GGG
tcactcttgttgcccaggct

SEQ ID NO: 86081 - DNA, 20 bp, Artificial Sequence
  Description of Artificial Sequence: Synthetic oligonucleotide
  Target: ATXN1; (-) strand; PAM type: NRG; PAM sequence: TGG
ttcactcttgttgcccaggc

SEQ ID NO: 86082 - DNA, 20 bp, Artificial Sequence
  Description of Artificial Sequence: Synthetic oligonucleotide
  Target: ATXN1; (-) strand; PAM type: NRG; PAM sequence: AGG
gagtttcactcttgttgccc

SEQ ID NO: 86083 - DNA, 20 bp, Artificial Sequence
  Description of Artificial Sequence: Synthetic oligonucleotide
  Target: ATXN1; (-) strand; PAM type: NRG; PAM sequence: CAG
ggagtttcactcttgttgcc

SEQ ID NO: 86084 - DNA, 20 bp, Artificial Sequence
  Description of Artificial Sequence: Synthetic oligonucleotide
  Target: ATXN1; (-) strand; PAM type: NRG; PAM sequence: GAG
ctttttttttttttgagatg

SEQ ID NO: 86085 - DNA, 20 bp, Artificial Sequence
  Description of Artificial Sequence: Synthetic oligonucleotide
  Target: ATXN1; (-) strand; PAM type: NRG; PAM sequence: TGG
ttctttttttttttttgaga

SEQ ID NO: 86086 - DNA, 20 bp, Artificial Sequence
  Description of Artificial Sequence: Synthetic oligonucleotide
  Target: ATXN1; (-) strand; PAM type: NRG; PAM sequence: GAG
tcctttcttttttttttttt

SEQ ID NO: 86087 - DNA, 20 bp, Artificial Sequence
  Description of Artificial Sequence: Synthetic oligonucleotide
  Target: ATXN1; (-) strand; PAM type: NRG; PAM sequence: AAG
ggaaagccaaaggattttca

SEQ ID NO: 86088 - DNA, 20 bp, Artificial Sequence
  Description of Artificial Sequence: Synthetic oligonucleotide
  Target: ATXN1; (-) strand; PAM type: NRG; PAM sequence: AGG
gtgtcttgtgggaaagccaa

SEQ ID NO: 86089 - DNA, 20 bp, Artificial Sequence
  Description of Artificial Sequence: Synthetic oligonucleotide
  Target: ATXN1; (-) strand; PAM type: NRG; PAM sequence: AAG
agtgtcttgtgggaaagcca

SEQ ID NO: 86090 - DNA, 20 bp, Artificial Sequence
  Description of Artificial Sequence: Synthetic oligonucleotide
  Target: ATXN1; (-) strand; PAM type: NRG; PAM sequence: AAG
gtgtggagtgtcttgtggga

SEQ ID NO: 86091 - DNA, 20 bp, Artificial Sequence
  Description of Artificial Sequence: Synthetic oligonucleotide
  Target: ATXN1; (-) strand; PAM type: NRG; PAM sequence: GGG
tcctgtgtggagtgtcttgt

SEQ ID NO: 86092 - DNA, 20 bp, Artificial Sequence
  Description of Artificial Sequence: Synthetic oligonucleotide
  Target: ATXN1; (-) strand; PAM type: NRG; PAM sequence: TGG
atcctgtgtggagtgtcttg

SEQ ID NO: 86093 - DNA, 20 bp, Artificial Sequence
  Description of Artificial Sequence: Synthetic oligonucleotide
  Target: ATXN1; (-) strand; PAM type: NRG; PAM sequence: GAG
tatacataaaatcctgtgtg

SEQ ID NO: 86094 - DNA, 20 bp, Artificial Sequence
  Description of Artificial Sequence: Synthetic oligonucleotide
  Target: ATXN1; (-) strand; PAM type: NRG; PAM sequence: TGG
agtatacataaaatcctgtg

SEQ ID NO: 86095 - DNA, 20 bp, Artificial Sequence
  Description of Artificial Sequence: Synthetic oligonucleotide
  Target: ATXN1; (-) strand; PAM type: NRG; PAM sequence: CAG
aagtgcagtaaaggattgtg

SEQ ID NO: 86096 - DNA, 20 bp, Artificial Sequence
  Description of Artificial Sequence: Synthetic oligonucleotide
  Target: ATXN1; (-) strand; PAM type: NRG; PAM sequence: AGG
gtacatgaaaagtgcagtaa

SEQ ID NO: 86097 - DNA, 20 bp, Artificial Sequence
  Description of Artificial Sequence: Synthetic oligonucleotide
  Target: ATXN1; (-) strand; PAM type: NRG; PAM sequence: AAG
tgtacatgaaaagtgcagta

SEQ ID NO: 86098 - DNA, 20 bp, Artificial Sequence
  Description of Artificial Sequence: Synthetic oligonucleotide
  Target: ATXN1; (-) strand; PAM type: NRG; PAM sequence: CAG
ttcagtgtacatgaaaagtg

SEQ ID NO: 86099 - DNA, 20 bp, Artificial Sequence
  Description of Artificial Sequence: Synthetic oligonucleotide
  Target: ATXN1; (-) strand; PAM type: NRG; PAM sequence: AAG
cacacttcagtgtacatgaa

SEQ ID NO: 86100 - DNA, 20 bp, Artificial Sequence
  Description of Artificial Sequence: Synthetic oligonucleotide
  Target: ATXN1; (-) strand; PAM type: NRG; PAM sequence: CAG
acccaatagttatcacactt

SEQ ID NO: 86101 - DNA, 20 bp, Artificial Sequence
  Description of Artificial Sequence: Synthetic oligonucleotide
  Target: ATXN1; (-) strand; PAM type: NRG; PAM sequence: TAG
tttcttgtagtctaacccaa

SEQ ID NO: 86102 - DNA, 20 bp, Artificial Sequence
  Description of Artificial Sequence: Synthetic oligonucleotide
  Target: ATXN1; (-) strand; PAM type: NRG; PAM sequence: TAG
ttccattgagttctttcttg

SEQ ID NO: 86103 - DNA, 20 bp, Artificial Sequence
  Description of Artificial Sequence: Synthetic oligonucleotide
  Target: ATXN1; (-) strand; PAM type: NRG; PAM sequence: GAG
tttacatgtgttcttccatt

SEQ ID NO: 86104 - DNA, 20 bp, Artificial Sequence
  Description of Artificial Sequence: Synthetic oligonucleotide
  Target: ATXN1; (-) strand; PAM type: NRG; PAM sequence: CAG
agaggaatggtttgaatgta

SEQ ID NO: 86105 - DNA, 20 bp, Artificial Sequence
  Description of Artificial Sequence: Synthetic oligonucleotide
  Target: ATXN1; (-) strand; PAM type: NRG; PAM sequence: TGG
acttaattttaaaagaggaa

SEQ ID NO: 86106 - DNA, 20 bp, Artificial Sequence
  Description of Artificial Sequence: Synthetic oligonucleotide
  Target: ATXN1; (-) strand; PAM type: NRG; PAM sequence: AGG
acaatacttaattttaaaag

SEQ ID NO: 86107 - DNA, 20 bp, Artificial Sequence
  Description of Artificial Sequence: Synthetic oligonucleotide
  Target: ATXN1; (-) strand; PAM type: NRG; PAM sequence: GAG
tacaatacttaattttaaaa

SEQ ID NO: 86108 - DNA, 20 bp, Artificial Sequence
  Description of Artificial Sequence: Synthetic oligonucleotide
  Target: ATXN1; (-) strand; PAM type: NRG; PAM sequence: AAG
gatacaatacttaattttaa

SEQ ID NO: 86109 - DNA, 20 bp, Artificial Sequence
  Description of Artificial Sequence: Synthetic oligonucleotide
  Target: ATXN1; (-) strand; PAM type: NRG; PAM sequence: TAG
ctaatccccccgtttaactg

SEQ ID NO: 86110 - DNA, 20 bp, Artificial Sequence
  Description of Artificial Sequence: Synthetic oligonucleotide
  Target: ATXN1; (-) strand; PAM type: NRG; PAM sequence: TGG
cagaatgaagtaatacttgc

SEQ ID NO: 86111 - DNA, 20 bp, Artificial Sequence
  Description of Artificial Sequence: Synthetic oligonucleotide
  Target: ATXN1; (-) strand; PAM type: NRG; PAM sequence: AAG
cttactattacaacagaatg

SEQ ID NO: 86112 - DNA, 20 bp, Artificial Sequence
  Description of Artificial Sequence: Synthetic oligonucleotide
  Target: ATXN1; (-) strand; PAM type: NRG; PAM sequence: CAG
aaagaagcttactattacaa

SEQ ID NO: 86113 - DNA, 20 bp, Artificial Sequence
  Description of Artificial Sequence: Synthetic oligonucleotide
  Target: ATXN1; (-) strand; PAM type: NRG; PAM sequence: AAG
aatattcattaaagttaaag

SEQ ID NO: 86114 - DNA, 20 bp, Artificial Sequence
  Description of Artificial Sequence: Synthetic oligonucleotide
  Target: ATXN1; (-) strand; PAM type: NRG; PAM sequence: AAG
gttaatattcattaaagtta

SEQ ID NO: 86115 - DNA, 20 bp, Artificial Sequence
  Description of Artificial Sequence: Synthetic oligonucleotide
  Target: ATXN1; (-) strand; PAM type: NRG; PAM sequence: AAG
acatttgttaatattcatta

SEQ ID NO: 86116 - DNA, 20 bp, Artificial Sequence
  Description of Artificial Sequence: Synthetic oligonucleotide
  Target: ATXN1; (-) strand; PAM type: NRG; PAM sequence: CAG
agttcctttaactttaacaa

SEQ ID NO: 86117 - DNA, 20 bp, Artificial Sequence
  Description of Artificial Sequence: Synthetic oligonucleotide
  Target: ATXN1; (-) strand; PAM type: NRG; PAM sequence: CAG
gaactcaataggagatccta

SEQ ID NO: 86118 - DNA, 20 bp, Artificial Sequence
  Description of Artificial Sequence: Synthetic oligonucleotide
  Target: ATXN1; (-) strand; PAM type: NRG; PAM sequence: GAG
ccacattatgaactcaatag

SEQ ID NO: 86119 - DNA, 20 bp, Artificial Sequence
  Description of Artificial Sequence: Synthetic oligonucleotide
  Target: ATXN1; (-) strand; PAM type: NRG; PAM sequence: AGG
taccacattatgaactcaat

SEQ ID NO: 86120 - DNA, 20 bp, Artificial Sequence
  Description of Artificial Sequence: Synthetic oligonucleotide
  Target: ATXN1; (-) strand; PAM type: NRG; PAM sequence: TAG
ttaccacattatgaactcaa

SEQ ID NO: 86121 - DNA, 20 bp, Artificial Sequence
  Description of Artificial Sequence: Synthetic oligonucleotide
  Target: ATXN1; (-) strand; PAM type: NRG; PAM sequence: AAG
cattaaatatttatctttaa

SEQ ID NO: 86122 - DNA, 20 bp, Artificial Sequence
  Description of Artificial Sequence: Synthetic oligonucleotide
  Target: ATXN1; (-) strand; PAM type: NRG; PAM sequence: TAG
ttttgaaaaggcagataata

SEQ ID NO: 86123 - DNA, 20 bp, Artificial Sequence
  Description of Artificial Sequence: Synthetic oligonucleotide
  Target: ATXN1; (-) strand; PAM type: NRG; PAM sequence: CAG
gctttaactttttgaaaagg

SEQ ID NO: 86124 - DNA, 20 bp, Artificial Sequence
  Description of Artificial Sequence: Synthetic oligonucleotide
  Target: ATXN1; (-) strand; PAM type: NRG; PAM sequence: AGG
tgtgctttaactttttgaaa

SEQ ID NO: 86125 - DNA, 20 bp, Artificial Sequence
  Description of Artificial Sequence: Synthetic oligonucleotide
  Target: ATXN1; (-) strand; PAM type: NRG; PAM sequence: AAG
atgtgctttaactttttgaa

SEQ ID NO: 86126 - DNA, 20 bp, Artificial Sequence
  Description of Artificial Sequence: Synthetic oligonucleotide
  Target: ATXN1; (-) strand; PAM type: NRG; PAM sequence: TGG
aataaaggtgtattgggcct

SEQ ID NO: 86127 - DNA, 20 bp, Artificial Sequence
  Description of Artificial Sequence: Synthetic oligonucleotide
  Target: ATXN1; (-) strand; PAM type: NRG; PAM sequence: GGG
aagaaaaataaaggtgtatt

SEQ ID NO: 86128 - DNA, 20 bp, Artificial Sequence
  Description of Artificial Sequence: Synthetic oligonucleotide
  Target: ATXN1; (-) strand; PAM type: NRG; PAM sequence: TGG
aaagaaaaataaaggtgtat

SEQ ID NO: 86129 - DNA, 20 bp, Artificial Sequence
  Description of Artificial Sequence: Synthetic oligonucleotide
  Target: ATXN1; (-) strand; PAM type: NRG; PAM sequence: AGG
aaactaggaaagaaaaataa

SEQ ID NO: 86130 - DNA, 20 bp, Artificial Sequence
  Description of Artificial Sequence: Synthetic oligonucleotide
  Target: ATXN1; (-) strand; PAM type: NRG; PAM sequence: AAG
aaaactaggaaagaaaaata

SEQ ID NO: 86131 - DNA, 20 bp, Artificial Sequence
  Description of Artificial Sequence: Synthetic oligonucleotide
  Target: ATXN1; (-) strand; PAM type: NRG; PAM sequence: AAG
aagacagtgaaaaactagga

SEQ ID NO: 86132 - DNA, 20 bp, Artificial Sequence
  Description of Artificial Sequence: Synthetic oligonucleotide
  Target: ATXN1; (-) strand; PAM type: NRG; PAM sequence: AGG
cttcaagacagtgaaaaact

SEQ ID NO: 86133 - DNA, 20 bp, Artificial Sequence
  Description of Artificial Sequence: Synthetic oligonucleotide
  Target: ATXN1; (-) strand; PAM type: NRG; PAM sequence: TAG
acttcaagacagtgaaaaac

SEQ ID NO: 86134 - DNA, 20 bp, Artificial Sequence
  Description of Artificial Sequence: Synthetic oligonucleotide
  Target: ATXN1; (-) strand; PAM type: NRG; PAM sequence: CAG
gtgggtaaaagacttcaaga

SEQ ID NO: 86135 - DNA, 20 bp, Artificial Sequence
  Description of Artificial Sequence: Synthetic oligonucleotide
  Target: ATXN1; (-) strand; PAM type: NRG; PAM sequence: AAG
gactgtgggtaaaagacttc

SEQ ID NO: 86136 - DNA, 20 bp, Artificial Sequence
  Description of Artificial Sequence: Synthetic oligonucleotide
  Target: ATXN1; (-) strand; PAM type: NRG; PAM sequence: AAG
atatgggagactgtgggtaa

SEQ ID NO: 86137 - DNA, 20 bp, Artificial Sequence
  Description of Artificial Sequence: Synthetic oligonucleotide
  Target: ATXN1; (-) strand; PAM type: NRG; PAM sequence: GGG
tattgaatatgggagactgt

SEQ ID NO: 86138 - DNA, 20 bp, Artificial Sequence
  Description of Artificial Sequence: Synthetic oligonucleotide
  Target: ATXN1; (-) strand; PAM type: NRG; PAM sequence: TGG
gtattgaatatgggagactg

SEQ ID NO: 86139 - DNA, 20 bp, Artificial Sequence
  Description of Artificial Sequence: Synthetic oligonucleotide
  Target: ATXN1; (-) strand; PAM type: NRG; PAM sequence: GAG
attatctgtattgaatatgg

SEQ ID NO: 86140 - DNA, 20 bp, Artificial Sequence
  Description of Artificial Sequence: Synthetic oligonucleotide
  Target: ATXN1; (-) strand; PAM type: NRG; PAM sequence: GGG
ttattatctgtattgaatat

SEQ ID NO: 86141 - DNA, 20 bp, Artificial Sequence
  Description of Artificial Sequence: Synthetic oligonucleotide
  Target: ATXN1; (-) strand; PAM type: NRG; PAM sequence: TGG
tttattatctgtattgaata

SEQ ID NO: 86142 - DNA, 20 bp, Artificial Sequence
  Description of Artificial Sequence: Synthetic oligonucleotide
  Target: ATXN1; (-) strand; PAM type: NRG; PAM sequence: TAG
ttgaactttacacattctga

SEQ ID NO: 86143 - DNA, 20 bp, Artificial Sequence
  Description of Artificial Sequence: Synthetic oligonucleotide
  Target: ATXN1; (-) strand; PAM type: NRG; PAM sequence: CAG
agagcaaagaggcagggcag

SEQ ID NO: 86144 - DNA, 20 bp, Artificial Sequence
  Description of Artificial Sequence: Synthetic oligonucleotide
  Target: ATXN1; (-) strand; PAM type: NRG; PAM sequence: CAG
tacagagcaaagaggcaggg

SEQ ID NO: 86145 - DNA, 20 bp, Artificial Sequence
  Description of Artificial Sequence: Synthetic oligonucleotide
  Target: ATXN1; (-) strand; PAM type: NRG; PAM sequence: GGG
gagtacagagcaaagaggca

SEQ ID NO: 86146 - DNA, 20 bp, Artificial Sequence
  Description of Artificial Sequence: Synthetic oligonucleotide
  Target: ATXN1; (-) strand; PAM type: NRG; PAM sequence: AGG
agagtacagagcaaagaggc

SEQ ID NO: 86147 - DNA, 20 bp, Artificial Sequence
  Description of Artificial Sequence: Synthetic oligonucleotide
  Target: ATXN1; (-) strand; PAM type: NRG; PAM sequence: CAG
aagagtacagagcaaagagg

SEQ ID NO: 86148 - DNA, 20 bp, Artificial Sequence
  Description of Artificial Sequence: Synthetic oligonucleotide
  Target: ATXN1; (-) strand; PAM type: NRG; PAM sequence: AGG
aacaagagtacagagcaaag

SEQ ID NO: 86149 - DNA, 20 bp, Artificial Sequence
  Description of Artificial Sequence: Synthetic oligonucleotide
  Target: ATXN1; (-) strand; PAM type: NRG; PAM sequence: GAG
aaacaagagtacagagcaaa

SEQ ID NO: 86150 - DNA, 20 bp, Artificial Sequence
  Description of Artificial Sequence: Synthetic oligonucleotide
  Target: ATXN1; (-) strand; PAM type: NRG; PAM sequence: AAG
aaaaacaagagtacagagca

SEQ ID NO: 86151 - DNA, 20 bp, Artificial Sequence
  Description of Artificial Sequence: Synthetic oligonucleotide
  Target: ATXN1; (-) strand; PAM type: NRG; PAM sequence: GAG
cagaaaaaaacaagagtaca

SEQ ID NO: 86152 - DNA, 20 bp, Artificial Sequence
  Description of Artificial Sequence: Synthetic oligonucleotide
  Target: ATXN1; (-) strand; PAM type: NRG; PAM sequence: CAG
accagaaaaaaacaagagta

SEQ ID NO: 86153 - DNA, 20 bp, Artificial Sequence
  Description of Artificial Sequence: Synthetic oligonucleotide
  Target: ATXN1; (-) strand; PAM type: NRG; PAM sequence: GAG
ctcccaccagaaaaaaacaa

SEQ ID NO: 86154 - DNA, 20 bp, Artificial Sequence
  Description of Artificial Sequence: Synthetic oligonucleotide
  Target: ATXN1; (-) strand; PAM type: NRG; PAM sequence: AAG
tgctcccaccagaaaaaaac

SEQ ID NO: 86155 - DNA, 20 bp, Artificial Sequence
  Description of Artificial Sequence: Synthetic oligonucleotide
  Target: ATXN1; (-) strand; PAM type: NRG; PAM sequence: CAG
caggccaattctgctcccac

SEQ ID NO: 86156 - DNA, 20 bp, Artificial Sequence
  Description of Artificial Sequence: Synthetic oligonucleotide
  Target: ATXN1; (-) strand; PAM type: NRG; PAM sequence: AGG
ctacccctgaccctctacac

SEQ ID NO: 86157 - DNA, 20 bp, Artificial Sequence
  Description of Artificial Sequence: Synthetic oligonucleotide
  Target: ATXN1; (-) strand; PAM type: NRG; PAM sequence: CAG
tctacccctgaccctctaca

SEQ ID NO: 86158 - DNA, 20 bp, Artificial Sequence
  Description of Artificial Sequence: Synthetic oligonucleotide
  Target: ATXN1; (-) strand; PAM type: NRG; PAM sequence: GGG
acagtgtcccaaagatgcct

SEQ ID NO: 86159 - DNA, 20 bp, Artificial Sequence
  Description of Artificial Sequence: Synthetic oligonucleotide
  Target: ATXN1; (-) strand; PAM type: NRG; PAM sequence: TGG
tacagtgtcccaaagatgcc

SEQ ID NO: 86160 - DNA, 20 bp, Artificial Sequence
  Description of Artificial Sequence: Synthetic oligonucleotide
  Target: ATXN1; (-) strand; PAM type: NRG; PAM sequence: AAG
taattagttacagtgtccca

SEQ ID NO: 86161 - DNA, 20 bp, Artificial Sequence
  Description of Artificial Sequence: Synthetic oligonucleotide
  Target: ATXN1; (-) strand; PAM type: NRG; PAM sequence: CAG
aatgttgtgataattagtta

SEQ ID NO: 86162 - DNA, 20 bp, Artificial Sequence
  Description of Artificial Sequence: Synthetic oligonucleotide
  Target: ATXN1; (-) strand; PAM type: NRG; PAM sequence: TAG
aaagcaaatgttgtgataat

SEQ ID NO: 86163 - DNA, 20 bp, Artificial Sequence
  Description of Artificial Sequence: Synthetic oligonucleotide
  Target: ATXN1; (-) strand; PAM type: NRG; PAM sequence: AAG
ggcctttctggggcttctga

SEQ ID NO: 86164 - DNA, 20 bp, Artificial Sequence
  Description of Artificial Sequence: Synthetic oligonucleotide
  Target: ATXN1; (-) strand; PAM type: NRG; PAM sequence: GGG
gggggtagggggcctttctg

SEQ ID NO: 86165 - DNA, 20 bp, Artificial Sequence
  Description of Artificial Sequence: Synthetic oligonucleotide
  Target: ATXN1; (-) strand; PAM type: NRG; PAM sequence: GGG
ggggggtagggggcctttct

SEQ ID NO: 86166 - DNA, 20 bp, Artificial Sequence
  Description of Artificial Sequence: Synthetic oligonucleotide
  Target: ATXN1; (-) strand; PAM type: NRG; PAM sequence: TGG
tggggggtagggggcctttc

SEQ ID NO: 86167 - DNA, 20 bp, Artificial Sequence
  Description of Artificial Sequence: Synthetic oligonucleotide
  Target: ATXN1; (-) strand; PAM type: NRG; PAM sequence: GGG
ggacatgtttggggggtagg

SEQ ID NO: 86168 - DNA, 20 bp, Artificial Sequence
  Description of Artificial Sequence: Synthetic oligonucleotide
  Target: ATXN1; (-) strand; PAM type: NRG; PAM sequence: GGG
aggacatgtttggggggtag

SEQ ID NO: 86169 - DNA, 20 bp, Artificial Sequence
  Description of Artificial Sequence: Synthetic oligonucleotide
  Target: ATXN1; (-) strand; PAM type: NRG; PAM sequence: GGG
aaggacatgtttggggggta

SEQ ID NO: 86170 - DNA, 20 bp, Artificial Sequence
  Description of Artificial Sequence: Synthetic oligonucleotide
  Target: ATXN1; (-) strand; PAM type: NRG; PAM sequence: AGG
gaaggacatgtttggggggt

SEQ ID NO: 86171 - DNA, 20 bp, Artificial Sequence
  Description of Artificial Sequence: Synthetic oligonucleotide
  Target: ATXN1; (-) strand; PAM type: NRG; PAM sequence: TAG
agaaggacatgtttgggggg

SEQ ID NO: 86172 - DNA, 20 bp, Artificial Sequence
  Description of Artificial Sequence: Synthetic oligonucleotide
  Target: ATXN1; (-) strand; PAM type: NRG; PAM sequence: GGG
aacagaaggacatgtttggg

SEQ ID NO: 86173 - DNA, 20 bp, Artificial Sequence
  Description of Artificial Sequence: Synthetic oligonucleotide
  Target: ATXN1; (-) strand; PAM type: NRG; PAM sequence: GGG
gaacagaaggacatgtttgg

SEQ ID NO: 86174 - DNA, 20 bp, Artificial Sequence
  Description of Artificial Sequence: Synthetic oligonucleotide
  Target: ATXN1; (-) strand; PAM type: NRG; PAM sequence: GGG
ggaacagaaggacatgtttg

SEQ ID NO: 86175 - DNA, 20 bp, Artificial Sequence
  Description of Artificial Sequence: Synthetic oligonucleotide
  Target: ATXN1; (-) strand; PAM type: NRG; PAM sequence: GGG
aggaacagaaggacatgttt

SEQ ID NO: 86176 - DNA, 20 bp, Artificial Sequence
  Description of Artificial Sequence: Synthetic oligonucleotide
  Target: ATXN1; (-) strand; PAM type: NRG; PAM sequence: TGG
aaggaacagaaggacatgtt

SEQ ID NO: 86177 - DNA, 20 bp, Artificial Sequence
  Description of Artificial Sequence: Synthetic oligonucleotide
  Target: ATXN1; (-) strand; PAM type: NRG; PAM sequence: AGG
aaagaaaaggaaggaacaga

SEQ ID NO: 86178 - DNA, 20 bp, Artificial Sequence
  Description of Artificial Sequence: Synthetic oligonucleotide
  Target: ATXN1; (-) strand; PAM type: NRG; PAM sequence: AAG
gaaagaaaaggaaggaacag

SEQ ID NO: 86179 - DNA, 20 bp, Artificial Sequence
  Description of Artificial Sequence: Synthetic oligonucleotide
  Target: ATXN1; (-) strand; PAM type: NRG; PAM sequence: CAG
aaagaaagaaaaggaaggaa

SEQ ID NO: 86180 - DNA, 20 bp, Artificial Sequence
  Description of Artificial Sequence: Synthetic oligonucleotide
  Target: ATXN1; (-) strand; PAM type: NRG; PAM sequence: AGG
aaggaaaagaaagaaaagga

SEQ ID NO: 86181 - DNA, 20 bp, Artificial Sequence
  Description of Artificial Sequence: Synthetic oligonucleotide
  Target: ATXN1; (-) strand; PAM type: NRG; PAM sequence: AAG
gaaggaaaagaaagaaaagg

SEQ ID NO: 86182 - DNA, 20 bp, Artificial Sequence
  Description of Artificial Sequence: Synthetic oligonucleotide
  Target: ATXN1; (-) strand; PAM type: NRG; PAM sequence: AGG
agagaaggaaaagaaagaaa

SEQ ID NO: 86183 - DNA, 20 bp, Artificial Sequence
  Description of Artificial Sequence: Synthetic oligonucleotide
  Target: ATXN1; (-) strand; PAM type: NRG; PAM sequence: AAG
tagagaaggaaaagaaagaa

SEQ ID NO: 86184 - DNA, 20 bp, Artificial Sequence
  Description of Artificial Sequence: Synthetic oligonucleotide
  Target: ATXN1; (-) strand; PAM type: NRG; PAM sequence: AAG
tagattagagaaggaaaaga

SEQ ID NO: 86185 - DNA, 20 bp, Artificial Sequence
  Description of Artificial Sequence: Synthetic oligonucleotide
  Target: ATXN1; (-) strand; PAM type: NRG; PAM sequence: AAG
actgtagattagagaaggaa

SEQ ID NO: 86186 - DNA, 20 bp, Artificial Sequence
  Description of Artificial Sequence: Synthetic oligonucleotide
  Target: ATXN1; (-) strand; PAM type: NRG; PAM sequence: AGG
agcacactgtagattagaga

SEQ ID NO: 86187 - DNA, 20 bp, Artificial Sequence
  Description of Artificial Sequence: Synthetic oligonucleotide
  Target: ATXN1; (-) strand; PAM type: NRG; PAM sequence: AAG
cagcacactgtagattagag

SEQ ID NO: 86188 - DNA, 20 bp, Artificial Sequence
  Description of Artificial Sequence: Synthetic oligonucleotide
  Target: ATXN1; (-) strand; PAM type: NRG; PAM sequence: GAG
actcagcacactgtagatta

SEQ ID NO: 86189 - DNA, 20 bp, Artificial Sequence
  Description of Artificial Sequence: Synthetic oligonucleotide
  Target: ATXN1; (-) strand; PAM type: NRG; PAM sequence: TAG
gaactcagcacactgtagat

SEQ ID NO: 86190 - DNA, 20 bp, Artificial Sequence
  Description of Artificial Sequence: Synthetic oligonucleotide
  Target: ATXN1; (-) strand; PAM type: NRG; PAM sequence: TAG
ctttggaactcagcacactg

SEQ ID NO: 86191 - DNA, 20 bp, Artificial Sequence
  Description of Artificial Sequence: Synthetic oligonucleotide
  Target: ATXN1; (-) strand; PAM type: NRG; PAM sequence: CAG
tgagaatttgctttggaact

SEQ ID NO: 86192 - DNA, 20 bp, Artificial Sequence
  Description of Artificial Sequence: Synthetic oligonucleotide
  Target: ATXN1; (-) strand; PAM type: NRG; PAM sequence: TGG
taatggatgagaatttgctt

SEQ ID NO: 86193 - DNA, 20 bp, Artificial Sequence
  Description of Artificial Sequence: Synthetic oligonucleotide
  Target: ATXN1; (-) strand; PAM type: NRG; PAM sequence: GAG
agctgaaaagtataatggat

SEQ ID NO: 86194 - DNA, 20 bp, Artificial Sequence
  Description of Artificial Sequence: Synthetic oligonucleotide
  Target: ATXN1; (-) strand; PAM type: NRG; PAM sequence: TGG
aaagaagctgaaaagtataa

SEQ ID NO: 86195 - DNA, 20 bp, Artificial Sequence
  Description of Artificial Sequence: Synthetic oligonucleotide
  Target: ATXN1; (-) strand; PAM type: NRG; PAM sequence: AAG
gtttcaaaaaagaagctgaa

SEQ ID NO: 86196 - DNA, 20 bp, Artificial Sequence
  Description of Artificial Sequence: Synthetic oligonucleotide
  Target: ATXN1; (-) strand; PAM type: NRG; PAM sequence: AAG
gaatgtatgtttcaaaaaag

SEQ ID NO: 86197 - DNA, 20 bp, Artificial Sequence
  Description of Artificial Sequence: Synthetic oligonucleotide
  Target: ATXN1; (-) strand; PAM type: NRG; PAM sequence: AAG
gaggaatgtatgtttcaaaa

SEQ ID NO: 86198 - DNA, 20 bp, Artificial Sequence
  Description of Artificial Sequence: Synthetic oligonucleotide
  Target: ATXN1; (-) strand; PAM type: NRG; PAM sequence: AGG
cagtttgttaatcctcccgg

SEQ ID NO: 86199 - DNA, 20 bp, Artificial Sequence
  Description of Artificial Sequence: Synthetic oligonucleotide
  Target: ATXN1; (-) strand; PAM type: NRG; PAM sequence: GAG
tcagtttgttaatcctcccg

SEQ ID NO: 86200 - DNA, 20 bp, Artificial Sequence
  Description of Artificial Sequence: Synthetic oligonucleotide
  Target: ATXN1; (-) strand; PAM type: NRG; PAM sequence: CGG
tctcagtttgttaatcctcc

SEQ ID NO: 86201 - DNA, 20 bp, Artificial Sequence
  Description of Artificial Sequence: Synthetic oligonucleotide
  Target: ATXN1; (-) strand; PAM type: NRG; PAM sequence: CAG
cacacagcttgttagtatct

SEQ ID NO: 86202 - DNA, 20 bp, Artificial Sequence
  Description of Artificial Sequence: Synthetic oligonucleotide
  Target: ATXN1; (-) strand; PAM type: NRG; PAM sequence: TAG
gaatgaaccacacagcttgt

SEQ ID NO: 86203 - DNA, 20 bp, Artificial Sequence
  Description of Artificial Sequence: Synthetic oligonucleotide
  Target: ATXN1; (-) strand; PAM type: NRG; PAM sequence: CAG
ggtctgatgaatgaaccaca

SEQ ID NO: 86204 - DNA, 20 bp, Artificial Sequence
  Description of Artificial Sequence: Synthetic oligonucleotide
  Target: ATXN1; (-) strand; PAM type: NRG; PAM sequence: GGG
tgggtccttcttcccttgaa

SEQ ID NO: 86205 - DNA, 20 bp, Artificial Sequence
  Description of Artificial Sequence: Synthetic oligonucleotide
  Target: ATXN1; (-) strand; PAM type: NRG; PAM sequence: AGG
ctgggtccttcttcccttga

SEQ ID NO: 86206 - DNA, 20 bp, Artificial Sequence
  Description of Artificial Sequence: Synthetic oligonucleotide
  Target: ATXN1; (-) strand; PAM type: NRG; PAM sequence: AAG
cctgggtccttcttcccttg

SEQ ID NO: 86207 - DNA, 20 bp, Artificial Sequence
  Description of Artificial Sequence: Synthetic oligonucleotide
  Target: ATXN1; (-) strand; PAM type: NRG; PAM sequence: GGG
cccagtgtcagagctgccct

SEQ ID NO: 86208 - DNA, 20 bp, Artificial Sequence
  Description of Artificial Sequence: Synthetic oligonucleotide
  Target: ATXN1; (-) strand; PAM type: NRG; PAM sequence: TGG
ccccagtgtcagagctgccc

SEQ ID NO: 86209 - DNA, 20 bp, Artificial Sequence
  Description of Artificial Sequence: Synthetic oligonucleotide
  Target: ATXN1; (-) strand; PAM type: NRG; PAM sequence: GAG
tcacccctgccccagtgtca

SEQ ID NO: 86210 - DNA, 20 bp, Artificial Sequence
  Description of Artificial Sequence: Synthetic oligonucleotide
  Target: ATXN1; (-) strand; PAM type: NRG; PAM sequence: CAG
cctcacccctgccccagtgt

SEQ ID NO: 86211 - DNA, 20 bp, Artificial Sequence
  Description of Artificial Sequence: Synthetic oligonucleotide
  Target: ATXN1; (-) strand; PAM type: NRG; PAM sequence: CAG
gtgatgcctcacccctgccc

SEQ ID NO: 86212 - DNA, 20 bp, Artificial Sequence
  Description of Artificial Sequence: Synthetic oligonucleotide
  Target: ATXN1; (-) strand; PAM type: NRG; PAM sequence: GGG
cctgccccttgctctctctt

SEQ ID NO: 86213 - DNA, 20 bp, Artificial Sequence
  Description of Artificial Sequence: Synthetic oligonucleotide
  Target: ATXN1; (-) strand; PAM type: NRG; PAM sequence: TGG
acctgccccttgctctctct

SEQ ID NO: 86214 - DNA, 20 bp, Artificial Sequence
  Description of Artificial Sequence: Synthetic oligonucleotide
  Target: ATXN1; (-) strand; PAM type: NRG; PAM sequence: TGG
aactggtttcccttgttttc

SEQ ID NO: 86215 - DNA, 20 bp, Artificial Sequence
  Description of Artificial Sequence: Synthetic oligonucleotide
  Target: ATXN1; (-) strand; PAM type: NRG; PAM sequence: TGG
ttggagcataggacagtaac

SEQ ID NO: 86216 - DNA, 20 bp, Artificial Sequence
  Description of Artificial Sequence: Synthetic oligonucleotide
  Target: ATXN1; (-) strand; PAM type: NRG; PAM sequence: CAG
taggcagttggagcatagga

SEQ ID NO: 86217 - DNA, 20 bp, Artificial Sequence
  Description of Artificial Sequence: Synthetic oligonucleotide
  Target: ATXN1; (-) strand; PAM type: NRG; PAM sequence: AGG
ggtttaggcagttggagcat

SEQ ID NO: 86218 - DNA, 20 bp, Artificial Sequence
  Description of Artificial Sequence: Synthetic oligonucleotide
  Target: ATXN1; (-) strand; PAM type: NRG; PAM sequence: TAG
aggtttaggcagttggagca

SEQ ID NO: 86219 - DNA, 20 bp, Artificial Sequence
  Description of Artificial Sequence: Synthetic oligonucleotide
  Target: ATXN1; (-) strand; PAM type: NRG; PAM sequence: GAG
ttttaaggtttaggcagttg

SEQ ID NO: 86220 - DNA, 20 bp, Artificial Sequence
  Description of Artificial Sequence: Synthetic oligonucleotide
  Target: ATXN1; (-) strand; PAM type: NRG; PAM sequence: TGG
cattttaaggtttaggcagt

SEQ ID NO: 86221 - DNA, 20 bp, Artificial Sequence
  Description of Artificial Sequence: Synthetic oligonucleotide
  Target: ATXN1; (-) strand; PAM type: NRG; PAM sequence: CAG
gtttcattttaaggtttagg
